United States Patent 10,767,156 (POLYNUCLEOTIDES ENCODING BREX SYSTEM POLYPEPTIDES AND METHODS OF USING SAME) - sequence listing, part 7

SEQ ID NO: 4853 - DNA, 585 bp, Fusobacterium sp.
atgcaatatagaggaattacctcagaaaatttctatttaactgaaattagaaatacttgtagatttattttagagaatggaattcaagaaaatttaaaagagttattaaaaaaaaataatattttagaaacatttagtgaaagtaatttctcaaaaaaatataatactataaacaaaagattaaaatctttaactgataatttaaaaaaacaaatagtagacactgatttagcttctgcaaaatttataaatctttatagcatattgtgtaatgaaaggtttatattagagtttttagaagaagtagtcaaagagaagtatgataattatgattacaatataaaagaaagtgattttttaatttatctagctactaagtctgaacaatcagagattattaataattggacagaagctggtaaaagaaaaatgttagtaaagattaaaaactttttaacagaaggaggcttcttagaaaaaaataaagatggttataatataataaaacctgttgttgagtcagctgttatagatgaaattaaagaaaatggtaatagaaaaattttaaaaataatgttctattaa

SEQ ID NO: 4854 - DNA, 801 bp, Vibrio cholerae; identical to SEQ ID NO: 4836

SEQ ID NO: 4855 - DNA, 630 bp, Aurantimonas manganoxydans
atgcataaccgaccgatatggatcgacgattctgtggaagcgcctctctataaagctgacatcgcaggcggcgctctgatgctgccagaaagccggcgtgtcgctcgcctgctgatcgatggtgtcggcaaggaagaatggcgtcggaagatcgagcaggagaacatcctgcagaagcgatccccgtcgaccgcgatccggcaggctaatctcatccgcagtcgtctgcagtcgacgaactcagagctttggcagctcatcgtcgagggtccgtcaactgttgcgacccaggctctgtttgcggccgcgatcgagcacagcccgcttctggctgatttccttcccgtggtccgcgcccgcttccgcgtcctccattccgatctccctcgtcggatctggatcgactatgtcgagcgatgccacgacgtcgatccgcggatgccgcgttgggaaatctccacgattgacaagcttggcgacaccgccttccgcatccttcacgaagttggcttcctgacaggcggccggcgtaatcttctccggcccgttggcattgatccgtccatcatcaagaacctgaaggcctggcatcacgaccgcgccctagagcggattcgggtgtcggcatga

SEQ ID NO: 4856 - DNA, 621 bp, Sinorhizobium meliloti
atgccggatttgcgggatcagccctaccttatgtccttcggaaccggtgggctgtacatcaatgaaagtgctgccgttgccgaattgcacgatgacgtcggagactgggatgcgacgctcggtgccgcgctggagcgaggcgtgtttccggtgcgaaaggcgagctctgcgcggcgctccgttcgggaaatcgtgaaccgcctgagatgtctgaagccggcagagttgactttactgattgaagggcagcgcaacgagcaatgcgctctcctctggctggcgacctgtcgagcatacaggttcatccgcgaatttgcgatcgaagtgctaagcgacagatttctcacgttgaggacaaaactcacctacgatgatttcgatacattcctgtcggttaaggaggagtggtcccctaagctcgcgacactatcggcctcgacccgtgccaagcttcgagcggtgctatttcgcctgatgcgcgagtcagagatcctgtcgcaggatgaccggatactcggggcgatgttgtcgccgcgcgtgttggcaataatccagaccgaaaaccccaatgaactgcgatacttccctggtgccgaacggcaggggggaggaaagagatag

SEQ ID NO: 4857 - DNA, 603 bp, Sphingobium yanoikuyae
atgatggtggccgcagcgaaatatcggatgtcctttggcgtgggcgggctgatgctcaatgagagcatcgtgattgctcaagcttatcaacccggtgagaactgggcatctgctcgtgagcggttgctggcccagggcgcgtcatccttacccaaactggcctcgcaaacccgcgcgcttcgtgaagtgtacgaccggataggccatctctccgatgccgaacgtcattacctgtcggtagaggctgaccgcgccgagcagcaggcgatgatgtggctggcggtctgccggacctatcgttttgtctacgaattcgcagtcgaggtgatcagcgaacgctaccaatcatggcggctcgacctgggccatgaggtttttgaccgctttctagcggagaaggctgaaagcgatcccggcctcgccggtctttcagcttcaacctgcgcaaaattgcgtcaggtcttgtttcggatactacgtgaagttggtttgataagcgtcgagggtagaattcagccgatttggttatcggagcgcatgaagcggctgattgaggagagtaatccggcggacttgcaggtctttcccggaaatggggggtaa

SEQ ID NO: 4858 - DNA, 612 bp, Pseudomonas fragi
atgcatagcttccattacgactctgacttaatcggcggctcgttgcaggtgcgtgaatcacgcatcgttgcagacctgctgctgcaggacgccagccctgaacaatggcatgaggtcatacagaaacagaaccggctgcagaaacgcgcaccagcttcggccaagcgtgtggctcaagccatccgcaagcgtctggaacgactggatgcccctttctggcgggcaattcgagatggagatgatgaactcgctacccaagtggtgttctgctcggccttggagcgcaacctgctcctcgtcgaattcatcgagaccgtcctcaaagacgctttcgtcacccgcgccggcgtgctcgaaccctaccactggaatgagtttctggatgaacgcagccatcgagattcgaccatcaccacctggacggagtccagtcgtaagaagatggcgcaggttgtctatcgcatgctggccgaagtcggtctgttgaaaaacacccgcaacatgaaactacaaaatctgatgattcggtcagaggtccgcgtattgctggatgacagctaccgctatcgcataaaagcctgtttggaagtatccaatgccaccggacagtag

SEQ ID NO: 4859 - DNA, 606 bp, Lactobacillus helveticus
atgtcacgcagttataatggtggaattgcttcttatgcaatttggctgccagaacttacaaaatttattgagctttatcagtcaggttatagtattaatgatattaagcaaatgagtgatgaagaaaatatctttcaaatgccaacgaaagcacgtgctaaaagatgttccagaaaccttgccgtcagagtaaaagcattgcctgaatcagttttaaatatattctcgcaacttgatacttccaatcaaaaaatcatttctttattgtcagtaatgttaactagtcgtattttagatgagtttatctatgatgtgtatcgtcccaaagtgcaaatgcgagaggatattttgaaaagctatgaagtggaagcatttattaatcaaaaaaggatagagagtcctacaattgcttcgtggtcgctaaatacttataagcgaattaagggagcactaaagacatatatgcgggatggaggattgatgaagattgatcctcaaaataaaaaacaagataagcttctgtttccattacttgattctcaattagttttagcaatgaaagttgcaaagttagattatgaattagctgctttaggagggatgtaa

SEQ ID NO: 4860 - DNA, 801 bp, Vibrio cholerae; identical to SEQ ID NO: 4596

SEQ ID NO: 4861 - DNA, 621 bp, Faecalibacterium prausnitzii
atgcagaatacaaacagagcacaagaaagtggatataaagcttctctgacaagagaacagtttttattccacgaaatgcgaattgtagcgaagcaaatggtgcaaggagaggatcttgcatcaatgatacaaataattgccgccaataatctcttccagtatccaactgaacgcatgacagctggtatggttcgggcgtgttatcggcggctaaatcttttgaatagtgaacaactgcttcggaatattgcagagcattccgtggaagaggcaaaacaaatttgtctttacgcgattatgaaggataatagacttgtctgggattttatggtgacagttattggagaaaaatatcgaaaccaagatttcagctatggaaaacttgacatgacaagtttcttcataagattacaagagcaaaatgatgctatcgcagattggagcgaatctacagtcaaaaagctgaaatcggttctaaatcgaattttaagagaaaatgattatctggatagtataaaagcaggccatttgaacccggtttggctttatccggaattggaaaatgtgattcttacaaatggggatcaggcggtattgcccgcatttaaccgttttgagtga

SEQ ID NO: 4862 - DNA, 612 bp, Acinetobacter sp.
atgttagaacaatttcattatgacagtgacctgattggtggctccctgatggtgcgtgaaagccggctgatcgctgatctgttattacgagaagcgactccagaacaatggcatcaggcaattcagattgacaatattctgcaaaaaagaacgcctgcttcagcccaacgtaacgccactgccattcgtaagcgtcttgagcgcttagagcctgatttctggaaagctttgcgtgatggggatgatgagctggcgacccaggtggctttttgtggggcactggaacgcaacctgttgctgcttgagtttatggaaacggtgatgagggatgcctatatctcccaggcgcaatacttggacagttatatctggtcagattttttggatgagcgctcacaacgcgatccggatatctgcgaatggaaagagtccagcaagaaaaaaatggggcaggtggtgtttcgcatgctggcagaagccggttacttaaaaagtacccgtaagctggagttacagcgcgtgatcgtcagagcagagctgcgtagcctgttggaagaacattataaacaacgcattaaaagatctatggaagtgtcgctatggacgcgttag

SEQ ID NO: 4863 - DNA, 624 bp, Bacteroides sp.
atgaagataaatagcccttatacggctgcaattacgggtggaggttttctacttaatgagacgcttgctctgcttcctctcttgcaaagtgaagatcgagaagaacttctcaaagatgaacgattgaacaaccgtgtactgatgattaatgctgaaacatcaagaaagaaggcaatcctagagattagtcgtcgttatgatacgatgtcacctgctttctggcaggactttttagtgatgactgccgcagagcagcctattgctctcttttttgtgatgttgaagacgtacaaaatactttttgattttcatgtaaacgtgacgatacgtcgttggaacagcgtcgctaagtctgtgaagagagaagatatcctcatggagtttaatgaaatatctgctcgtgatgcatttgttgactcgtggagtgaagctacgaaggacaaagtgattagtgcctatttatctattttgcgaaagataggaattcttgatagaactaaccaattgcaagtgcttgattgtaccaactatccatactatttgcagattggcgaatcttggtttttggaggcttgtttgttacagccttatcaaatagaaaagattaaaaacagtttggcatga

SEQ ID NO: 4864 - DNA, 600 bp, Proteus mirabilis
atgaatataaaagaatatttaggcgatcttatcggaagcagtttattgataactgaatctagaataatcgcagaatcgctactgaaaaaacttccagaagatgagtggaagtcgctgatcgttgagcaaaatgttcttcagaaaaaatccggtcagacggctattcgttatgccagaacaatccgttggcgtattgaaggcctgggtgatgagtttatgactgatcttttaaccgcgagtgaacgtgcctatgtccaaatgctgatgatgtcattactcattcattctccggttgtcgctgattttatgcgacataccttagccgaggctcgtcgcacctataaacccgctttaaccgctgatgcatggtctgagttttatgacacgagagtgcgggcatatgccgaacttggcggtttttctgactcaactgtcaaaaaaatgggtaacaacgcaattaaggcattggttgatagtggctacctgagtgatagcaggacaaagaaaatacaacctgtttacctaatgccagaagttaaagactggttagttcgtctgggccgggaagatttgattgaggtcatggagtgcacaatatga

SEQ ID NO: 4865 - DNA, 744 bp, Bacteroides sp.
atggcaatcaatgataaacaagtaaagtatgattccggaattaatgttttgggtagtattcctgattatgtagtcatgcttgaatttatttgtgagaacataggaaagaaatcggaaccagagcaggtgttttctttcagaactcataaaacttttaataggttcttggctgctatcaaggcttctattcttcaatttgccaatgataatcagaagaagatgtttcttaccgctatcagttcagaagatttttctgtaagagaaaaattgcttgtattgttttggcagttggtttacggtaacgctctttttgctaaagtgaccaaagaagtgtttatgagagctgtatatcagggaagaacttcactttctgttatagatgtattgagtctgttacatcatattaaggaaacggaagagggtgaattgaactggtcggaagatactttgaaaataacagcatccaagtatttgacaatgctcaagaaactgaacttggctgaaggcaaaacagctaaggagatatgctatcctatcattacaggacaactgtttgtttattttatccgttggataatcgttacatatccagagaacaggacgttggaaaatccatttgtcatctttgggtttatggacaagagaagcattatcgagagattaaaaaaagttgagtatcttacgctatggcagattagccagatgggtgaagatgtaaccatagatttgatagaccatgagtag

SEQ ID NO: 4866 - DNA, 609 bp, Salmonella enterica; identical to SEQ ID NO: 4572

SEQ ID NO: 4867 - DNA, 618 bp, Pseudomonas fuscovaginae
gtgagcgtgaaggctttcagttatgactccgacctgattggcggctcactgcaggttcgagaatctcgcattgtggctgacctgctgctgcagaacgtcagcaccgagcagtggtacgaggtcatccagcaggagaaccggttgcagaaacgtacttccgcttcggccaagcgtgttgcccaggccttacgcaagcgcttggaacgaatggacgaggccttttggcgggctattcgcgatggtgacaatgaactcgctactcaagtggtgttctgctcggccctagagcgcaaccttcttctcgtcgagttcatcgaaactgtcgtccgggatgcctttgtcactcgtacaggagtgcttgagccctaccactggagcgaatttctggatgagcgcactcatcgagatccagccatcacttcctggactgaatccagccgcaaaaaaatgggtcaagtcgtctaccgcatgctggctgaggtcggtctgttggaaagtacgcgcagcatgagattgcaaaacttaaggatccggccagagacccgcgcattgctggacgacagctaccgacaacgaatcaaggcctgtctggaagtatccagcgccgctgcgcagtaa

SEQ ID NO: 4868 - DNA, 603 bp, Lachnospiraceae bacterium
atggagaaaaagccttacagtgcaggtgcggtgaagatgtctttttggtttatggagtttcgcaaggtggtggagcttcttgctgccggtaaaacattggaagaaattaaagagatgaataaaaacgaaaatatattcggtgcgccgactgccgcccgtgccaatcagatttttgttacagtatcgggaagaattaagacgcttgataaaagttttgtggaagtgtttcaaagaagtgatgttgcaatgcaaaagatatttgtgctggtttcatcacttgcctatgacagcctgttttttgagtttgtatatgaagtgattcgtgaaaagcttattttgggggcggatactttaaccgacagcgatataaggattttctttaaggataaaagccttcaggatgaaagggttgccaagtggacagccgccactctaaagcgccttggagcatactataagacaatgctttgtgaggcgggacttttagataagggcaaggcggacagaaagattataagacctgtcttaagtcctacagtcgaggagtggttaaatacacatgatatggaagtatgtgtgaaagcattgaatggagtaagataa

SEQ ID NO: 4869 - DNA, 801 bp, Vibrio cholerae; identical to SEQ ID NO: 4596

SEQ ID NO: 4870 - DNA, 609 bp, Roseburia inulinivorans
atggaaagaaaaccgtatagtgccggagcagtgaaattttcgttctggttcatggaatttcggaaaaccgtgcagcttttgagcgagggtaagagctttgcggatattaaaaagttgaatgaagagacaaacatctatggtgcaccgacaaaactacgagcgcagcagatttattctaccgtaacagcccgtatcaagacattagatgaaagcttttatccaatctttttgagcagtgatcttgctacacaaaaactatttgtgctgactgcggctcttttgcatgacacgctgttctttgattttgtgtatgaagtagtgcgggaaaaaatgattcttggttccgatgagctgacggatgcagatatccggatatttttcaaaaataagcaggaacagagtgagaaagtggcttctcttcaagactatacgctgcgccgcctcggttcctgctataaaacgcagctttatgaagcggggcttttagaaagcaaccgggcaaacagcacaagaaaaatactgaagccaattcttgatattgcatttgagcattggctttatgaccatgatcttggcatcatggtaaaaacactgacgggggtaagatga

SEQ ID NO: 4871 - DNA, 609 bp, Salmonella enterica
atgacgatgaaaaacgacaaggcatggattggagacctgctaggcgggccgctgatgagcagggaaagtcgaatcatcgctgagctcatgcttaccgctcccaatgaacaaacctggcaagagcagatcgtgggtcataacattctccaggcttcctctgccaatacggcgaagcgctatgctacaacgataaaactacgcctgaatacgcttgataaagtggcgtggtcgcttattgctgaagggagcgagcgcgagcgtcagcaattgctgttcgtcgctctgatcctccattcaccggttgttaaagacttcctggctgaagtggtgaacgacctgtgcagacaatttaaagaaaagctccctatggatagctgggatgagtttgtggctaaccatcttcgtcagcagcccgtactcaccagttactcagattcatccatcaaaaaaatgggtaacaacttgatcaaagcactggctgaagcgggttatctggatacacctcgtcggcgtaatctccagtcggtctttcttttaccagaaactcaggcgaccttgcagcgccttggacaacaagaattagtttctattctggagggacaacggtga

SEQ ID NO: 4872 - DNA, 555 bp, Acidovorax sp.
atgccgctcgaaagcaggcgcattgccgtgctgctgcttacgcagccggacgaggcagcttggcgacatgccatcgagatcgaaaacattctgcaaaagaacacgcccgccacggcgcgacgccaagctacgttgattcgaaagcgcctgatgactctagatgcccagggttgggaaatgatcgccaacaatggaagcgaggtgcaaattcaattgctgctcgccgcagcggtcaagcacagtccgctactcggcgacttcatgcgcaacgtctatgcaatgcgccagcgaaagctcgaaccaactgtcgatcctcacgactggtctgactttttggcggaatgcacattgcactatcctgcaatcgcgaactggacagacgcaacaagggccaaactgttccaagtcattgtccgcgtacttgtcgaggctaaatacttagacaatgcccgcagcttacgacttacccctaagtcgctgaaccccgacgtaaggcgctacctcgctgaccgccatgaaacctatgccctcgactgcttggagcgcgcgcaatga

SEQ ID NO: 4873 - DNA, 603 bp, Oribacterium sp.; identical to SEQ ID NO: 4653

SEQ ID NO: 4874 - DNA, 600 bp, Magnetospirillum sp.
atggcgggaccgcgatacaaggcggacatcggcggcggatcactcaaaatccccgaaagccgtatcattgccgggctgctccttgatggagtcagcgacgagcagtggcgtcatgccatcgaggtcgagaatgttctccagcggcgtagccccggtacggcgaagcggcagtcgtcgctgatccgtgcccggcttcaatccatgggggcggacctatggcggctggtccgggacggctcaacccaggtcgccacccaagcggttttcgccgccgccatcaagcattccgccctgcttggcgatttcctcgatttggtggtgcgggaccagttccgcatgttccgcaccgacctgccgaggaagatgtgggatcaatatctggagcagtgccgaaaccgtgatccgctgatgccggtatggcaggacagcaccgccaacaagctggcggattgcgtctacagaattctggcggaggttggatacgtcaccgattcgaaaacgtaccgcctgaagcccgtcagaatttccggtgaggtgatgagctaccttcgcgagaacgacgagcaatacgtcattcgctgcatccaggtgtccatatga

SEQ ID NO: 4875 - DNA, 606 bp, Escherichia coli; identical to SEQ ID NO: 4534

SEQ ID NO: 4876 - DNA, 801 bp, Vibrio cholerae; identical to SEQ ID NO: 4596

SEQ ID NO: 4877 - DNA, 612 bp, Acinetobacter baumannii
atgttagagcaatttcattatgacagtgacctgattggtggttcattgatggtgcgtgaaagtcggttaatcgcggatctgttattgcgtgaagccacaacagagcaatggcatcaggcgattcaggtggacaatattctgcaaaaaagaactgcggcttcggcgcaacgcaatgccaccgctattcgcaagcgtctggagcgtttagaacctgatttctggaaagctttgcgtgatggcgatgatgagctggcgacccaggtggctttttgtggtgcattggaacgcaacctgttgctgcttgagtttatggaaacggtgatgagagaagcttatatctctcaggctcaatacttggacagttatatctggtccgactttctggaggaacgtacacaacgagatctggatatctgtgaatggaaagagtccagcaagaaaaaaatggggcaggtggtctttcgcatgctgacagaagccggttacttaaaaagtacccgtaagctggagttgcagcgtgtgatcgtcagagcagagctacgtagcctgttggaagaacattataaacaacgcattaaaagatctatggaagtgtcgctatggatgcggtag

SEQ ID NO: 4878 - DNA, 612 bp, Acinetobacter baumannii; identical to SEQ ID NO: 4720

SEQ ID NO: 4879 - DNA, 624 bp, Magnetospirillum sp.
ttgcgattcgacggcggggcggcaatggctgatcctcgatacaaggcagatatcggcggcggatcgctcaaactgccggaaagtcggatcattgcgggcttgcttctcgatggcgtcaccgaagatcagtggcgtcatgccattgaagtcgagaacgtccttcaacgtcgcagccccggaactgcaaagcggcagtcgtcgctgatgcggaatcggcttgaaaccatggggccagaactctggcaaatggtacgggatggctcgacccaggttgcaatccaggcggtgtttgccgctgcgatcaagcattccacacttctgggcgacttccttgatctggtggtgcgggaccagttccgcatgttccgccccgacctgccaaggaagatgtgggatcaatatctggagcagtgccgaaaccgtgatccgctgatgcctgtgtggcaggacagtaccgccaacaaactggctgattgcgtctatcgcatcttggtggaggttggatacatcaccgattccaaaacctatcggttgaaatcagttcggatttcgggcgaggtgatgagctatcttcgcgagaataacgagcagtacgttatccgctgcatccaggtgtccatatga

SEQ ID NO: 4880 - DNA, 606 bp, Escherichia coli; identical to SEQ ID NO: 4534

SEQ ID NO: 4881 - DNA, 801 bp, Vibrio cholerae; identical to SEQ ID NO: 4596

SEQ ID NO: 4882 - DNA, 765 bp, Bacteroides sp.; identical to SEQ ID NO: 4812

SEQ ID NO: 4883 - DNA, 606 bp, Escherichia coli; identical to SEQ ID NO: 4534

SEQ ID NO: 4884 - DNA, 801 bp, Vibrio cholerae; identical to SEQ ID NO: 4836

SEQ ID NO: 4885 - DNA, 570 bp, Methylophaga aminisulfidivorans
atggccttcattgggggcagcctgctcaggcaggagtcactggatgtagcaaatctctatcttcagcttcaagactgggacttagtcaaagaaaaggtaattgccgacaatatccttcagagtaagcgcgtttcgagtgccaagcgtttcaccacagaaatcatttcaaggttaagtgtgcttgattcagagcagttggaattttttgttggagcaagcattcaggaacaagcccacacattatggttggctatttgccgacgttatgactttatcgctgaatttgctgtagaacttcttcatgagcattacgtgtatctccgaggagaagtgtcccaggaagactttgaggcgtttataaacaagaaatctgagtggcatccagagatagataaactgactgatagctcaagaaacaaggtccggcagataatttttagaatactcaaacaagctgagatattggataaaaataatcaaattatttctgtgattcttagtggctctatgagagaagcgctctcaattaatgagagtgagctgttgtttttcccagtaattggtgagtga

SEQ ID NO: 4886 - DNA, 606 bp, Escherichia coli; identical to SEQ ID NO: 4534

SEQ ID NO: 4887 - DNA, 801 bp, Vibrio cholerae; identical to SEQ ID NO: 4596

SEQ ID NO: 4888 - DNA, 591 bp, Photobacterium sp.
atgagtaattctaaatacaagttatctcttacgctaaggcctgcgttaattcatgaaagtagagtcgttgcagagcaatatactcaactaaaagactggcagttggttcgtgacgaagtgctaacgaataatctattgcaagctcggactgagagcacatctaaaaccatatatggcgaagtctctaagcgtctgaagaatttaactgatgatgagctgttgttaatgactacgtcagacttagatgcgaagcacctagtttggctagctatttgtcgtgaatacctgttcacatatcaatttgctgttgaggtcttatgtgagcatttcaacaaaagtcggcttcatctctaccctgaagattatgttgcattttttaacgcaaaagctgaatggcatagtaatttagacagcattactcaacagtcaagatataaagctcagcaaactatgttcaagatgcttgctgagtgcggcttagtcaatgaggataaagagattctacatcaacacgtctctgcgcaacttcaagagcttatcaagcaaactaatgcagatttcttaagaatatatcctggggactacagctaa

SEQ ID NO: 4889 - DNA, 801 bp, Vibrio cholerae; identical to SEQ ID NO: 4596

SEQ ID NO: 4890 - DNA, 585 bp, Fusobacterium sp.; identical to SEQ ID NO: 4724

SEQ ID NO: 4891 - DNA, 594 bp, Clostridium perfringens
atggaatataaatcaacaataaaatcaagaccatatttatataaagaaactaaaaaggctataagccttataaacaaagggttagatgttgatggtataaaagggaagtctttagaagataatatttttcaacttgagagtgaagcgagaaaaaaggaagttgcatcaataattacttctagaatcaaagtgttggattcttacattttaaataaaattgaaaatagcaacatagaaacatcaaaaattttggttttatatgctatagctaaaacagatagacttttctttgaatttttaaatgaagtttataaagaaaagatagttttaaaggatttttatatcagagacaaagattttagcgtatttttccaaagtaaaagagaacaaagtgagaaggttgattcttggagtgaatacacatttaagaaattaaaacaggtttacataagaatactttttgaaagtggacttattggtaatcaaaaaggtgatagagaaatagtagttcctataattgattcagatgttaaagaatatttatatgaaataggaagtaaaccttatgcggatgctatattgggaatagattaa

SEQ ID NO: 4892 - DNA, 639 bp, Actinomyces neuii
atgtccgattcaggctacgagctcggtttcacttcgggcacgctcatgcttgccggctaccgtgaagccgccgagctattccttgaaggcctcccgcaaacccaggttagtaagcgactttttgccgaaaatctggtgcgtatcgagggcggaaaccaccgccgcgcaatggcttctcttactgcctcccgcctggccccgctaggcagaccggcctggcagtatttggcgtctggcctgcagggggccgaattcctaatgtggctgtctctttgcttgcgctcccggctaacggccgattttgctcgcgaagtgttgcgcgatcatgcactaatccaggcgagcgccactaccgaccaggattttttggagttttggaagcagaaggcgctctggcacccccatttgcagggccgcagcgataagtcaataaataaagttcgccagtttgtgttcacgcaggcgcgcaaggcgggttttttggacaggcacaacgttccgcaagaggtttttatccccacccaggttgcgcaaataatcgtggccgccaaaagcaggtggggttggcctatgcgtgaggcgtttccggtgcccccgcaacagtttgaattacttcccgatgatcaggtaggtgcgtga

SEQ ID NO: 4893 - DNA, 600 bp, Enterococcus faecium; identical to SEQ ID NO: 4687

SEQ ID NO: 4894 - DNA, 606 bp, Escherichia coli; identical to SEQ ID NO: 4690

SEQ ID NO: 4895 - DNA, 801 bp, Vibrio cholerae; identical to SEQ ID NO: 4596

SEQ ID NO: 4896 - DNA, 780 bp, Vibrio cholerae; identical to SEQ ID NO: 4703

SEQ ID NO: 4897 - DNA, 591 bp, Fusobacterium necrophorum
atgaaataccgagcgattacaggagaaaatttctatgtacaggaactaaaaaatgcttgtcaatttctattacaacatcctgagttggaaaataagagacaagcttttcaagaacgagatatcttaaattgtgtcagtgagagcaattttaataaaaaatttcaaaccattcaaaaaagattgcaagtatttactcctaaattgatggaattgtttttgaaagtagattatactacaacaaaatttatcaatctttacgccattctttcacaagaaaggttttttgcagagtttatggacgaagtgataaaagaaaaatattttctcttagattttgaattaacaaattatgacttttatgaatttatggagagaaaaaaagagcagtcagaaattattcaacaatggtccgatgccgggtgtcataaaatgatacataaattgaaaaatttccttgtggaagctaactttttagagaaatctccttccggagagctatacttgataaaaagacccttggtagatatggctgttattgaggaaatagaaaagcatggaaatgcaaaaatattaaaattgatgttatattaa

SEQ ID NO: 4898 - DNA, 780 bp, Vibrio cholerae; identical to SEQ ID NO: 4703

SEQ ID NO: 4899 - DNA, 600 bp, Lactobacillus zeae
gtgaaaaaactgtctgctagtattgtgtctcaaggtttttggtttagggaatttgttgcaacggcatcaatgctgaactctgggaaatcctggaatgacgtcgatcaggccattatagaagacaacgtgttccagctgtcttcgaaaaaccgacaaaacgatgtgcgccttgcgatgcaccggcgttaccacgaattaccagatgatttcacaaagaatttggaccagtttaccttaagcaatcaaaagttaattaatctagttgccatcatgaagatgtcagcgttagttgaagatttcgttttaactgtggttaagacagaatttgtgatgggtgatttaaagctggaaccatatgagatcgggacttacatgagaaacttacctttgatgcatccggaagcgagccactggcgttcggtcacagtaaaaaagcttaagaacaagttacgtgaatatttagttgccagtggattggcggagcataaggaggaaaaccttgtgttgcagcgagcagttttagatccccaagtcgaacggctactaaaacaacacgatatgacgcaatatatcgaggcactaacagggagacaagtatga

SEQ ID NO: 4900 - DNA, 765 bp, Bacteroides ovatus; identical to SEQ ID NO: 4812

SEQ ID NO: 4901 - DNA, 498 bp, Escherichia coli
atgttgggtggagcggacaatccaaatggtgaattactgtcttatatcattggcgctgacaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgccagcatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4902 - DNA, 606 bp, Escherichia coli; identical to SEQ ID NO: 4819

SEQ ID NO: 4903 - DNA, 366 bp, Coprobacillus sp.
gtgaatataaatgagccttataaagcgacatttactcgtgaacagtttttatttcacgaaatgagaacagtggcacagttaatggtagaaggtaaaaatgataatgaaattaatgaaattgtctttaacgataacttatttcaatatcctacagaaaaatcaataaaaagaatggtacgtaattgtttaaaaagattacatctattagaagatatgcgtttggttgggattattgctaatggctcatctgatagcgcaaaacaagtttgtttatatgccatgatgaaccaatatcgagtaattaatgaatttatgaacagtgttattggtgaaaagtatcgcttaaaagattttttctttttctaa

SEQ ID NO: 4904 - DNA, 756 bp, Natronorubrum tibetense
ttgactcattgcggactccaagccgagagaacgcacgatatcgcatctctctacgcggacgaactcgattggacgtcggtcaaggagatctggtacgacgagcgagtcgcgaaccgaagcagtcggaacagcgctgaaaagccacttatcgctattcgggcacgacttcagtcagcgggtgaagggcttccatcggtcccggtgcttccgacgattatagaccagtgtcgaaacgaacgcgatcaggcacaggtcctcttcctctatctcgtcaaccacgacgggctggcccgctatgtcgtccacgagtacctccgccgactgatgaaacaaggaccctccgcactcaacttcgagacggatactgttctcaacatcctcgacgacttccgcgacaaggctggcgaaccgctagagtactcggaatcaacacagaaacgatgggtgcagggacttcggtctgcccttcgtgatatcggtgtgctcgaagggaagaccgagaccatgggtcaaccgccaaaggtcggcgacgtgcccctccaggtcgcggcctactactcctgggcccagaacggcgacgggtggctcacgaagccgattggctggctctacctgttccagtccgaagagtactgggaaccgcaaagcaagcgtctggctggatatgagggctggacacaccacgaagctcggagtcgcgtctggttcgaacccatcgacgacttctacacgatgctcgcggagggatcggcatga

SEQ ID NO: 4905 - DNA, 768 bp, Haloarcula argentinensis
atggttctcactaaatgcgggcttctcgttgatagagcggagacgcttgctcgactgtatgcccaccatcgggactggacggttgtcgaagagaagtggatcgaagagcgatttgacgagcgtagcacgcgtgggagttcgaaaggaatctaccgcgctctcagttcgcggttcaagaccgctggtagcaagcttccgtctattgtccaactcccctctatactcgaccagtgtgagacggtacgtgacaaagctcaggtgttgtatttctatttgctagaagacgatcccctcgtgaagtacacggtgcatcgatacgtcgaccgcctgcaggagtccggtgtcgacggactgggcttcgagcaggagacgttagagcgtctcctgagcgagttccattacgaggacgggagcgagtttgactacgctgaatcgacgacgcgccggtggggagaggggctccgatcggtgctgcgcgatatcggtgttctcgacactcaacagaccttgcagggacagatcccaaatctcgggtcgacgccgttactcgtcgcatcaggctactcgtgggagagccagggcgacgactggctctcccagccgaccggctggctctacctcttccagtcggaccagtactgggactccttggccgagcgcgtgagcgacgatccgaactgggaagcgagcgggattcacggtgaattacggctccagccggtcgacgacacgtacggctgggctgaaccgtgggagggcgaagtatga

SEQ ID NO: 4906 - DNA, 762 bp, Rhodopirellula sp.
atgatgaaatgtacccttgaaatcgaaccctctcgttcatactggcatctgtgtgcctccgccggcggcagcgtttcaaaggaaaaagcctttgaggaatctgttttcggatccaagacgtttctgcgcgttgagcgtttgatcgcagacatgcgacaccgatacgatgcctatccatttgccctggaagtactcggcaaatggcgaccaatggaactcagcgatcgagcactcatttgtcactggcatacccagctcgccgacccgatttatcgcaaatttactggcgactacctggtcgagcgttattacggtcccgctggcaacgtggacaacgacatgaccagtcgttggatcgaattgaccgtgcccgatcgttggcagattcccacgcggaataagattgccagcaaaatgctcacgtcagcgctctccgcaggcatcatcgcatccaaccgcaacccacggccgatccatttcccgcgtgtcagtgatttagcattgtgctacctgatgtatctgctgcgagagattcaatacgagggcactgcgatctccaatccctacctgacatcggtcgggctggatcaagatgaagccgttcggcgaattcgtggaatccgagaattaggattttctaaacaaggcgacttgcttcagtttgattggcagcacgattcgatgatggaatgggcacgcagcgcagggatcctttctgaagtcgacaacgagacgaataacgttcagagggctgcgacatga

SEQ ID NO: 4907 - DNA, 885 bp, Pseudanabaena biceps
atggttagtttgagtaaaaatatggacttatctatggacttatctatggacttatctgcaaattatggcgcggaggttaggtcgttgcacacaaggctaatgcgagttcctttggcgattgaagaaagttatagctactggcaaaattgccatccaaatgtcctgaatttggaagttgatcgagatcgcattactaataaaactgacaaaatcaatcaacttgctgaaattgcttttgagaagcgctggtttggtagtaagagcatggcacgaacgcaattactactcaaggagttttcgcagcgctatgatgcttatcccgtggcgctattggttttgcagcaatggcagccccgtgatttattaacaagacgtaatctctgtcattggcatttacaactcgtcgatccactctatcgcgcctttacagatcattatctgggacaacggcggattttaagcacagatattacggactcgaatattgatcgtgacatcgtaggacgatgggtcagccaaaacatgggaagagatcactggtcacctgcaacgatcgccagaatggcaacagggctaattgcggcggcagcatcggtggggctatgttcggacaaaatgggtaaacgcaatttgctatatccccaagtaagtgatcgcgctgtggagtattggttatattttttacgggctttaacttttgagggaactttgctcgataatccttactggcgatcagtgggtttgactgggagtttgctagagactcgtttacaacgtttaccaaatcttgattttcgccgcatgggagaacttattgactttgggtggcaatgtgctgatcttaaggattgggcgttgcgattagatcgggagaatttagagtaa

SEQ ID NO: 4908 - DNA, 756 bp, Planctomycete KSU-1
atgaaaagagaagttggatttagtcaacgtatcaggcttgagtggcttgagaagacagcggaactccttgcagaaggcaaatcgaaaaaagagatagaatcagtgttatacaacatcctgagtgaccagcttcattctgatggtaacacaaagcggggaagcagggaaaaggcactaactattctgctcaagatttgggtttcatcacctgaaagtgtgcaaccacttaaagaagatgctataacctattttagaaaattaccttttagcgatcacatcatccttcattggggattgtcaatagctatttatcctttttttggaataatggcagatacggttggtcgtcttttgaaattacaagggtcatttacacctgtgcaggtcttaagacgtattaaggaacaatttggcgagcgtgaaaccgtaacaagggcagcaagacgcgttttacgctgtttcgttgattggggtgtgttaaaagatgctacgaaaaaaggtatttatctaccagttacttctcacttaattactgataaaaagcttatagcatggcttgttgaagcaattttaatttccagaaattcccattctggattgatctctgttatcacacaaagcccaatactcttcccttttactttagatcaattctcacaacaagaccttacaaataataaacggctggagatttttcatcagggagccaatgaagtggttgttgtaataaaaactatggaagttaaagtaaattga

SEQ ID NO: 4909 - DNA, 717 bp, Bacillus cereus
atgaccaaacctgttggatttgatcaaaaggtattattgcatcatttagattttacagcgaatcataccaaaaaatattctcgcaaagatatgtatgaagtgttagatgggtatttacgaaatgatattacaggagcgaagtctagaaaaaacgctgttacgatgttaatgaaaatatggtatttagttgataaggatttaatcgagattcgtgatagagttttggaagtattacctgtgttaacaaaagaagagcgtgtgtttgtacactggggaatgacattagcagcttatccattttttaaagatactgtacatgagctaggaaagttgtttcaattacaagatacagttcctagtacagtgattggaaaaagaatgaaagaagagtatggtgacaggagaagagtggaagtagctactagcgcagtattaatgagtataaaagcatggggaattataattccaactaaaaaccgtttatatcagttatcagataaaatatttattagtaatccgcttctacaggtatttattgtgaaaataatgctccatgttttagagcatacagcattacagattgatatactaaaaaatcatcctatattatttccatttgatcatgagattgatttgtttgaattacgtcaaaatgaagggctgacattacatcatcaagagatagatacgttaatagtagagtgtaagaaaagttaa

SEQ ID NO: 4910 - DNA, 264 bp, Clostridium thermocellum
ttgaaacaaattggagctatagaaaatgagaaggttggtgtatatcgaataaaaaagtacccggttaccgatgtaaaaaccatacaggtgttgttattggccattcttcacttaagggaaagagcctactatgaaatagcagagctatcttcggtaccccaggtctttccttttgaattcaatgtttcatatgaatggctgcatgactcagacttatttaccttaagtaactttggcggtaaagttgtgttaacattggattaa

SEQ ID NO: 4911 - DNA, 444 bp, Clostridium thermocellum
atggcaaagatgattggactatcccgttccattagattggaatggcttaataaaactgcagaacttgtattggaaggcaaggactatacgcaaattaaagatgagttaaacgaatacttgtcttttgaaattaaaagtcctactaacatcagaaaaacgagagaaattcttacgaatatatgggtgaagattcctgatgcactttcaactttaaaacggcaagctttagaagcttataaggatgacaagtcgaataaactagcattgcattggagcatgatgttggttgcttaccctgtattctgtgatgtatgtgctttaataggcaaacttactagcatccaggatacatttacgcatcctggcttaaagaaaagctgtttgaaatatggggggaacgtgctactctgttccattccatcgataagatattacaaaccttga

SEQ ID NO: 4912 - DNA, 708 bp, Lachnospiraceae bacterium
atggcaaaaatggtaggtctgtcaagaaatttgaagctgtcatggttgaatcaaaccgttgagcttgtttcgagcaatttggtagagaacgaaataaaagaaaaattgaatgaatatttgagcttcgaaataggaagccctacaaatattcgtaagaccagagaaatcttgatgtacatctggcattatgaaaatgaatacacagaaaaattacggcccacagcacttgagctgattaagaagtatccggattatgcacttgaaatccactggtgcatgatgctggcggcatatcctgtttttatggatatgtgcaaacttatcggtaaaatgtcggagtttcaagacgaaatcacgctggcccagctgaagcagaagctatttgatgaatggggtgagcgcacgacgctataccactctatcgacaagctgatttctactctaaaagagtttggtgtacttgcctgcgataaaccgggaaaataccacatcaacaggcacaaggttgcaaaagatgaaatcaacagttttatggtttatactataataaatgttgatggtagcggttattatttattccaagaggttaatgcatcttcgtacttattcccatttgagtgcactgtatcaaaggaaatgctgctgcaagacgaacgttttaccatgaataattttggtggtagtttgtcagttgctttgaaaaattaa

SEQ ID NO: 4913 - DNA, 708 bp, Enterococcus faecium
atgaaaaaaatggtgggattatttcgtgtaatgacatttgaagagttggacaaagctgctgaagtaatgttgaaatattcacctacagacgcatatcaaatattagatgagacctttgccaaaacaattaaaggggatacgttccgtagaaaagctctaaacaatttaatgaacgtatgggggaacggccagaagccactttctgattttcaagagaaagtactagaacgatatgctatttcaaattatgatgagaaaaaatcgttgcaagttttgatgatgctttattctttttcatttttttcagacaccataaatataattgggaagtatctacgtatgcaggatacttttcaatcaaaaacgattatggaagaagttcgtagtacgtatggaatgactgagacagtgaataaagggttgttgacggttttgggttccttggttgattggggatttctatttcgtagcaagcctggtgtatatgaacttacgaagcacaaaattctgattactgatgagtttataaagaacgtattgatacgctctattttagctcatacggatgctgaataccttccgctagaaattataaataatcaagcgggattatttatgtttgattatcaggttagcagattagaagttcatcttgatgatttaaacgtgttacgagaaagaacggatactttcatagggttaaagtaa

SEQ ID NO: 4914 - DNA, 708 bp, Caloramator australicus
atgaagcttgtaggatttttaaaaccagtaaagttagaatggctaaatttaactgtcgaagaacttaaaaaaggtaatgatagcgaaaatattaggcaatttttaaaagattacataagtaatttttatcaaagtaaagatacgataagaaaagctgctgcaatattaatgaatgcatgggtggatgtagaatataaaaacattagagattttgcgttagatttatatgataatgtaaaagaagaagaaaagattgctcttcattatggccttatgatgattgcctttccaattttcaacgatattgtttctttgattggtaaagcattatatttagatgagagatttaagcttgaaaatataaaaaacaaaatttatgaaaaatggggcgaaagacagactttaaaatattctatagatagaattattatgagcttaaaggaatggggattaattgaaaatgaaaagattggaatttataaatctggtaaaaaaataataatagaaaatgcacaagttaaggcctttttgattgcttgctacttaatagcacaaaatagagattatatagatatagttgaagcagaaaatctatattcattttttccatttttatacaacttgaatttgacagaacttaataatatagatatattgagtaaaaataacattggttctaacattgttatcggagtaaaggatctttaa

SEQ ID NO: 4915 - DNA, 708 bp, Pseudoalteromonas marina
ttgaaagtatcaattggttttaatcgacatttagagtcgaactggcttgctcaaacagcatcttgggtggcaaatggaattgaaggtaaagagctaaaggataaaattgatactttactaactcctgattttacaagccaagtggctaaagacaaaacacgtaatttacttttcggtatttggagtaaattacccaaacatatccccaatgattttcaacgagatgcagctaatttactgatggaatatagtgaattgaacttagtttttcactgggggatgatgcttgcaaagtaccctttctttaaatctgtagttgaacaaattggtcgtttaaccaagttaaatgactcttttttatattctcaacttgaacagcgaattaccgagaattatggtgatacttcaacaatcaaaagaagtatgcagtttgtagtaagaacgttgatgaacttggaattactagctaaccctaagcaaggtatatatcaacttagaaagcctattcaagttaataatccatcaataaaagcttggttaatagaagcaagtgtttattctgaacaagtaacaagtcgaagcttaactgccattaacgatgaaaatgtttggttcccatttgagctatattttgatgagaatgatctgagtcaaaatgatcgtcttgaagctcatcaccaagccgctgatgtgatagtgtttgtttag

SEQ ID NO: 4916 - DNA, 711 bp, Pseudoalteromonas marina
atgtctaaaagggttaattatagtcgtcatattgaggctcattggttagatcaaacggcactttgggttgccgaagggttaaacaaacaagaattgcacgacaaaattaattcaatgctttcaccgttgattaactgcaaggttaatttggggaaaacacgaaatcaattaacatcattgtggtttgataagaacgaaaatgtcagtagtgagttctcagcattcgcagttgattacgtgaaagagagtcatgatattcctcttgttattcattgggggttattaattgcgaaaaagaaattctttgctgatgtagctcgatttattggacgaaattcaaagtttaatgactcatttacatatgctcaagtacaaaagcgaatggttgagttatacggtgatactgaaacagtaaaacgtgggctgcgctctgtattgaagactatggttgattttggagttttgctacgaagcaactccagaagttaccaagtaaatcaaaataatttggcagtacctaaaaaattaatgaactggttattatgcgctttactatttagtgaagacgtaataagcagaacactatcagatattattgatgatgcaatttggtttccatttgagattagtatcgagccagaagacattgataagcaatggtttgaagtgcatcagcaaggatatgagctgatgttgtttagaaagaaataa

SEQ ID NO: 4917 - DNA, 729 bp, Desulfotomaculum nigrificans
atggtaaaaccagtggggtttgatcaaaagattaaaatacaccatctggactatattgccagagaatttaacaatactgagcgtaaagtgatgtacgaaaaattagatgaatatttaagtggcgatattcgcggggccaaagccagaaaaaacgccatcacgatcctaatgaagatctggtttttggtacccgatgcaataaaaaacctgcgccaaagagctttggaactgtggcctactttagaccaccgagaacgcagggttcttcattatggcatgactctgctggcctatcccttttttaaggatgtggccgcagaaatgggtaatttatttgggttgcaaaatgaagtgcccagtgtgcaaataggccgtaaaatgaaaggtctctatggggatagacggcgggtggaggtagcaaccaaggcagtattaatgagtctgaaagcctggggactgattgagctgggtaagggtaatgtgtacaccttattggaaaaacaagaagtaaccaatacagcattaaagctatggctggctgaggtggtgctgcgggtgtctggttatcattatctgcccctggagatgattccggctgcccaggtggtctttccttttaggtttagcttaaacatccgggaagtggaaactggcaattttgtaatcaatcgccagggactggatatgcaattggttgggctagtaggtggtgtccgagaatatgcttga

SEQ ID NO: 4918 - DNA, 756 bp, Dethiosulfovibrio peptidovorans
gtgagcaagcgacacgataaactaggcatcaagcagaccattcaaaaacactggatggactatgttgttaaaatgatgttagccggtctcaaagaaaaagagatccgagtcgaattagatgagtttttagcaacgcaaaaacaaagcggtggcactggtcagcgaggtaaaaaaacatatggcatggctatcagtattctcgcatcgtggtttgcaccagataaagatttaattacctttagggatcatgctcttgcacttattcggaatgagaatccacgaaactggcttccgtatcactgggcggtgatctctgcatcgtatccattctggtttaatgtctcaaaacagaccgggaggcttttcaacctccaggatcagatcacccaggcccaagttttgtgccggctcaaagagcaatacggtgatagagaaacggtggctaggaatgctcgatatacagttcgatcttttgttgcgtggggcatgttaaaggattccaatgtcaagggctgttatgaacaatgcaaaacgacggcaatcagtgaaccgaacctcacaatacttttatacgaagctgctctgtgtgctgataaagaaggaaaagcggttcttggattattgaaaagcaacccggcattcttcccgtttcaattgccagtattgacaggcgactacatttcacagcagagcaataccattgacattgtccgctacgggctggatgatgatcttttgaagctgaagtatttataa

SEQ ID NO: 4919 - DNA, 723 bp, Kingella denitrificans
atgaattcatcagccccaaaaataggctttgatcggttcattcagcttgattgggcggctgcggcactgaatgttcgtgcaggcgtggctgggctagatgatctgaatgcactgctcgatgcagccgagcttggcttggaagccaagaagaaaacacgcaccgtgctgaatcggttgtggctggagccgcgcgccgaactggtcgattacgcggatcgcggcgcggccatccacaagacgcagccggacataccggtcgcagcgctgtgctggggtatgtccgtggcgacctacccgttttttggcaaagtggccgagctggtgggccgcctctccgccatccagggcgactgcgcgtccgccgaggtccatcgccgcatgagcgaaacctacggagagcgcgaaggcacccggcgcatgaccaacatggtcatccagagccaggcgagctggggagctgtggagcgggttgagaaaggcaagcgcgtcatccgcctggcaccaaccacgatcgacaacgacggactcacggcctggttgatcgaggcggcagtgcgctacgccggcaagcccgtttcagtgcccagtctgcagtcactgcccgtgttgttcccgttcaccctgacgcggcccctggcctacgtggtgtcgaacagtgcaaacctgatccttcggtcggaaggaccgagtaaccagttcgtcgctttgcgcagcacgatatga

SEQ ID NO: 4920 - DNA, 726 bp, Alcanivorax hongdengensis
atgaaaccctctgcacctaaaattggctttgatcgcttcataccgctcgaatgggcggcggcagcgcttgatgtccgtgcagagtcaaataccctagacgacttgaacgcactgctggatcaagctgaacttggggcggctgcccgcaagaaaacccgcaccgttctcaaccgactttggcttgaaccgcgaccagagttagcagcattcgctgatcgtggcattgccattcataaagctgacccaaacactcccgtcgccgcactaacctgggggatggcgatagccacctacccgtttttcggcagggtaagtgagcttgttggacgactttcttccctgcaaggcgattgtgcgtcggcggaaattcatcgccgtatgagtgaaacctacggggagcgcgaaggcacctatcgaatgacgaatatggtcttgcagtcgcaagcaagctggggagccattgaacgtattgagaaaggcaagcggttagtgcgcatgcagccgatcgtggtcagcaatgagcaggctgttagctggctgatcgaagccgcattgatgtacagcggaaaggcgcttccagtatccagcctgtcatcactggccgtgctttatcctttcattctcgatcagccgctaagctaccttgtttccagaggtgcaagcctgggtgtgaggactgaagggactggcaatcaattcgtttatttggacagacggcaactctga

SEQ ID NO: 4921 - DNA, 732 bp, Bacillus cereus
atgaaagcagtcggttttgatcagaaaatccaactagctcatcttgatataacagctaatttattacgacaacattccgctaaggatatgtataacctattggatacagaattaatgacatctattaaaggtgataaatctcgaaaaaatgccattacgatgttgatgaaaacttggagtttaattgacccgattattaaagatttaagggatcagttggtactagagtatccctatttaacagcctctgaaaaacgattagcaaattactgcttaacctgcattgcctatccattctttagagagcaaatgtattacatcggaaaacagttaaagatgtcggatgaagtacacagtaaacttattgtttccgagatgaaaaaccgatatggcgatcgccgtcgtgtagaagtcgcagctggtgccgttttttcttctgcaaaagattggcagctactcacaatgcgaaaaccaggtgtatatcaagcaaataaatctgaaatcgatatacaaaatccgatacttaaagctttgataattgaagtattaatgatgcattatgaagcctttacggtttctacagatattgtaaatagtagtgcaatctttttctcattcgattaccatatacgtataggggatttagatcaacaacgctttacaatcattaaaaatatacgtgatacgattatcgaacgaaatcctaagatcccttactcacatccagagtaa

SEQ ID NO: 4922 - DNA, 714 bp, Nitrosococcus oceani
atgcaaaaagccgcttacctccttcttgccgggctggatgctaaggctattcgacaggaactccatgactacttgagcgatcgcatgggcagcggtgtgcgtgcagaacgcagtacagaagcgaggtcattcgctgtcacgattttaatgaacatatgggttacccccgacccggtattggaaacattgagaaacgatgctctgccctatctggcacagggccgaagcgctgaacttgcggtccactggtcgatgatcggcgcggcgtaccccttttggttcaatgtggcgcgccaaacagggcgtttgctagcgctccaagatcaggtcacgatgaaacaggtctctaggcgtttgattgaggtctacggtgagcgccaaaccgtgagccgcaatgctcagtttgtcgttcgctctttcgctttctggggcgttctcaaagatactgcacagcaaggttgttatcaaaagatagtatcagcgcctatttccgatcttaacttagtatctttaatgctcgaggcagccctacatgccatccccgagggcaagggaactttagacctgctattaaataacccggcattctttccattccagctcccgctgatgacaggcgactttatcggacagcgtagggagcatattgagataatccgctatgggttggatgatgagctgttgatgctgaagaaaaaacaaggagagcgctaa

SEQ ID NO: 4923 - DNA, 723 bp, Methyloversatilis universalis
atgaattcatcagccccaaaaataggctttgatcggttcattcagcttgattgggcggctgcggcactgaatattcgtgcgggcgtggctggactagatgatctgaatgcactgctcgatgcagccgagcttggcgtggaagctaagaagaaaacacgcaccgtactgaatcggctgtggctggagccacgcgccgaactggtcgattacgcggatcgcggcgtggccatccacaagacgccgccggatataccggtcgcggcgctgtgctggggcatgtcggtggcgacatacccgttctttggcaaggtggccgagctggtgggccgcctctccgccatccagggcgactgcgcgtccgccgaagtgcatcgccggatgagcgagacctacggagagcgcgaaggcactcggcgcatgaccaacatggtcatccagagccaggcgagctggggcgccgtagagcgggtcgagaaaggcaagcgggtcatccggctggcaccaaccgcgatcgacaacgacgaactcacggcctggttgatcgaggcggccgtgcgttacgccggcaagccggtttcagtgcccagcctgcagtcgctgcccgtgctgttcccgttcaccctgacgcggcccctggcctacgtggtgtcgaacagtgcaaacctgatccttcggtcggaaggaccgagtaaccagttcgtcgctttgcgcagcacgatttga

SEQ ID NO: 4924 - DNA, 753 bp, Thermoplasmatales archaeon
atgacaggatttgatcgacctttaaaaccgacatggatctataattttgtaaaaatagtcgaaattggagatacaataacagaccataaaacagaatttaataaaatactatgggaactagatggagaagaaggaaaaagaaaagtcagaactgtattaagcagatatttcatgaaaacacaaaaaaatccaaaaagtaaaacagtagaatatacgccaataatcgaaatttgtaaaacgtatccgttggaaaaaatcagacccttgatgctattttatttattatcaagatctgaagtcttaagaaatctatcaaaaataataaatgaggtatatggtaataaaaaagatatagactatcattttctaagaaaaaaaataattgaaaaatatggtgagagagacatttctagccgctcactaagaaattttttaacaactcttgaatactttgatattctaaaaaaacaaaatcatatctacaaatggacaaaaaaattacaacctgatgagatgaatatttgctatatgttaaaattctactcagatgaatacaaaagatcaccacaaatatttattgatgacatcgaacaatatataatgcagtattttgaaatccaagaccttggatctattggaagaaaatataacaaaaaactatgggaattcagtcaaaatttaaatcagaaacaaatagtatttcataaatcgtataaatgggaaaataaattaataaaacagctattttcttaa

SEQ ID NO: 4925 - DNA, 723 bp, Pseudomonas sp.
atgactacatctttacctcacattggttttgatcgctatattaagctcgaatgggcagcgaccgccttaaaggtgcgtgctggcttgaccagcattgatgagttgaatgctctcctggccagtgagaacctgggaaaagaagctctgggtaaaacccaaaccaagctgaacggcttgtggcttgcccctaggtcggtactgctcgattttgccgatcgtggtgccgcgattctcaaggcatctcctgctacatcagcagttgccctgacctggggaatggcgctggccagctatccattcttcgccaaactcgccgaacaggtgggccggctgacagctttacaggatgactgctcaactgcggaggttcaccgccgtatgaatgaggtttacggtgagcgcgaaatcacccggcgtgctgggcaagcggtgctgcaaactcacgagaattggggcgtcattgaacgtattgagaaagggcggcgtctgcggcgtcgaccggcaatccgcgttgatgatccacaactggttacttggttgatcgaggctgccttgcgttgccttggcaaaccgcttgcactgagctctgtgcaaaccttgcctgtgctgttcccgttcagcctcgagggctcactggcctttctggcatccggcagcgctcacattgagctgcgcagcgaaggtccgcacaaccagttcattgccttgcgtgagggtgcttga

SEQ ID NO: 4926 - DNA, 717 bp, Bacillus cereus
atgaccaaacatgttggatttgatcaaaaggtattattgcatcatttagattttacagcgaactataccaaaaaatattctcgcaaagatatgtatgaagtgctagatggttatttacgaaacgatattacaggagcgaagtctagaaaaaacgctgttacgatgttaatgaaaatatggtatttagttgataaggatttggtcgagattcgtgatagagttttggaagtattacctgtgttaacaaaagaagagcgtttgtttgtacactggggaatgacattagcagcttatccattttttagagatgctgtacatgagctaggaaagttgtttcaattgcaagacacagttcctagtacagtgattggaaaaagaatgaaagaagagtatggtgacaggcgaagagtggaagtagctactagtgcagtcttaatgagtataaaagcatggggagttataattccaactaaaaaccgttcatatcagttaccagataaagtattaattagcaatccgattctacaggtatttattgtacaaataattttacatgtcttagagaatacagcattacagcttgatatactgaaaaatcaccctatgttatttccatttgagcatgaatttgatttgtttgaattacgtcaatgtgaggggataacgttacatcatcaaggggtaggtacgttaatagtagaatgtaagaaaagttga

SEQ ID NO: 4927 - DNA, 714 bp, Bacillus methanolicus
atggttaaaccagtaggctttgatcagaaaataatgttacatcatttagattttactgagaatgaagcgaggaaattatcaagaaaggaaatgtatgaagctttagattattttttgcgaagtgatattcaaggggcgaagtctagaaaaaacgccatcacgatgttaatgaaaatttggtatttagtagacgaagaaactattccattacgagacaaagcacttgaaatgtttcctcatttgacaaaagaagagcgattacttgttcattggggaatgacgattcttgcttatccattttttaaagacttggtacaggaactaggaaagctgtttcgtttgcaagatgaagttccaagcgcagtaatcggaagaaaaatgaaggagttgtacggagatcgtagacgcgtagaagtggcaacaagtgcggtgttaacaagtataaaaacgtggggaatagtcgatctgttaaaaagccgttcatataaattacgcccaaaaatgtcaataacatcaacggatcttaatcaatttattacagaagtgattttacgagcaacgaatgttacagccatgcctattgatctgcttcataatcatgttttattctttccattttcatttgacataagtgtgacagagttgcgaaataataatcagtttcgtttaaatagacaaggaatcgatatagtgatagtcgaactatcttcgtga

SEQ ID NO: 4928 - DNA, 708 bp, Vibrio scophthalmi
ttgaaagtttcaattggttttaatcgtcacttagagcctgattggctagcacagacggcatcttgggtcgctaatggtatagaagggcaggcgttgaaaggccggattgattccatgcttgagcctgcatttaccagtaaagtagcaaaagataaaactcggaatttgttatttggaatttggaacaagctacctaagcatatctcagaaagattccaatcgagaggggctaacttgttaatggagcatagtgagcaacacttggtgtttcattggggcatgatgctgtcgaagtacccgttttttgcctttgttgtaggtcagattggtaagttgactaaacttaacgatacctttatatactctcagcttgaagatcgtgtaacggaacaatatggcgatacatctacaataaaacgtagcatgcaatttgttgtaagaactcttatgaaccttggagtgctcaaaaatccaaagcagggtgtttatgagctaaatacggtagtatctattgaacaaccagaggtaaaaggttggctcgtggaagcaataatgcgttcaaaccaaagctctagtcggagtctatcaagtataaatgacgatacggtttggtttccatttaagctgttttttgatttatcagatgtgcaaactaacaaagaactagaagcacatcttcaatcgtcggacacggttgtttttctttag

SEQ ID NO: 4929 - DNA, 423 bp, Vibrio scophthalmi
ttgctaaaaacaattttttttgctgatgtagtaagattcattgggcgacgtaaaaaacacgcagaggtgttcacctatgctcaagttcaaaagaacattgttgaactgtacggggataccgagacggttaaacgtagtcttcgttcggtgttaaaaacactggtcgattttagagttcttgagcgtcaaatgaataggacgtataaagcgtataagctcgaacataaggtagaaagtaagtataagagctggcttctgcaatctctgatgtataaccaaaggtatcgaagtcgttctcttgcagatatgcttgatgatctagtttggtttccatttgtattctcagtatcagtcaatgagcttgagacaacttggtttgatcttcaccaacaaggaaacgaccttgttttatttaagaaatag

SEQ ID NO: 4930 - DNA, 312 bp, Vibrio scophthalmi
atgtcaaagagagtcaactttagtcgtcatatcgagattcaatggttagattccgttgcggtctgggtcgccgagggaaaacaaaaaaaagaactcgacgaacagattgatttgatgctcgagccttcggtcacgtgtaaagtaaatagagggaaaactcgaaatcagttgaccaagttgtggtcccctaactctgatgatgtcacagaaagctttactcggtttgctattgaagccgtgcttggtagtgaacgtccagactttgtattgcactggggaatgttagttgctaaaaacaattttttttgctga

SEQ ID NO: 4931 - DNA, 744 bp, Thiorhodovibrio sp.
atgaacggacgtcaccaggccatcggcatcaaacaggtcattcgcctagactggatgcagcgcacggccaacctgctgttggctggcgtggatgccaagtcgattcgcatggaattgcacgaggcactcaatcgggaagccgatggccaacgcagcgcccagactcgggcttttgccgtcaataacctcatgaccatctggtgctccgccgatgccgagcttggtccttttcgcgcagccgtgctggagatactgcgccaagatcccaagagtggcctggcactgcattgggccatgatctcagctgcttaccccttctggttcaatatcgcccgccagaccggacgtttgctagcgctgcaggatcaggtcacccaggcgcagatcgtcgcgcggctgaaggaaaattatggcgaccggcaaaccgtgagccgttacgcgcgttttgtcattcgctccttcgttgactggggcgtgctccaggatgccccagtcaagggttgctacgaacaatcgagccccatcgcctttgatgatcggggactcgcactcttgctgtatgagtccgcgctgctagcgagtccggaggggaaagcctcattggcccgactggcgaatgagccggcattttttgccttcaaactcccccttctctcgggagggctgctctccgagtcccgcgcccgactggatgtcgtccacggcgctttggatgatcagatgttggtccgaaaaccaggatga

SEQ ID NO: 4932 - DNA, 708 bp, Clostridium papyrosolvens
atgcttgataggattggttttgatagagttgtaaagttgaattggcttaataaaacagtggaaatttataatcaggaaaaagattttaaaaaggtaaagttagatcttgactattacttaagggacgatgttggcggcgataatagaagaaagacaataaacatacttataaggacatgggtaaacgttgatccagtacatgtggcaattagagacaaagctctcgacctctttaaaatggctgatgcaaatgagagaattgctattcagtggtctatgctgctattggcatatcctatttttgataacttaactgctgttgcgggtaagctgcttaatttacaggacgaatttttattaagcatggtaagaagaagaatctatgagctgtggggcgagcgttccacgcttcaatatgccatagataagatgatacgctcacaaattgactggggagttctttcagatggagaaaagccaggagaatataagcggatacaaccattggagatcaaaaataaggaagtgaaattacttttgattgaagcataccttcttgcttcagggaagcctcatctccaatttgttgaggttaataagctggatgaattgtttccttttaagttggatatagggttagacgattttcatacagttgacaagtttaaacttaacaaaatgggtggggaagttgttattgggctataa

SEQ ID NO: 4933 - DNA, 708 bp, Thermoanaerobacter ethanolicus
atgaaaaaagtaggttttgctagaagaataaaacttgaatggcttgataaagttgtagaattttataaaaatgagcaggaggtttctaagataaaaaaagggttagatgattttctaattagtgaagttaaaagtaaggaaaatagaagaaaaagtatagatattttaataagcagttgggtagatgttcctgaggaatttaaatatgtgagagacaaagcagtggtattatttgataaggtgtctgaaggagaaaaaaagtttattcattggtttatgcttatatcagcttttcctttatttagtgatattagcactgttataggtaagttattgagtattcaagaagagtttaagttagatactgtaagacagagaatatttgaaatatggggagaaagaagtacagttaaatttagtacggataaaataatctcttcaatggtagaatggggagttttatcaaaagcacaaaaaccaggtatatataagaaagctaacacgattgaaataaagaataaagaattgaaacttttatttttggaagtatatcttaagtcaaataagaagtcattcataagttacgctgaaattgataaattgtatgtaatatttccatttgaattgtcttttgagttaggggatttttatgattcaccggttttaaatgtgaataaaatgggggataatacggtaattgttatttag

SEQ ID NO: 4934 - DNA, 708 bp, Thermoanaerobacter ethanolicus
atgaaaaaagtaggttttgctagaagaataaaacttgaatggcttgataaagttgtagaattttataaaaatgaaaaagatgttaaaaaaataaaggacgagttagatgcgtttttagtggatcaagtaaaaagtaaggtaaatagaggaaaaagtatagatgttttaataagtagttgggtagatgttccggaggaatttaaatatctgagagacaaagcagtggtattatttgataaggtgtctgaaggagaaaaaaagtttattcattggtttatgcttatatcagcttttcctttatttagtgatattagcagtgttataggtaagttattgagtattcaagaagaatttaagttagatactgtaaggcagagaatatttgaaatatggggagaaagaagtacagttaaatttagtacggataaaataatctcttcaatggtagaatggggagttttatcaaaagcacaaaaaccaggtatatataagaaagctaacacgattgaaataaagaataaagaattgaaacttttatttttggaagtatatcttaagtcaaataagaagtcattcataagttacgctgaaattgataaattgtatgtaatatttccatttgaattgtcttttgagttaggggatttttatgattcaccggttttaaatgtgaataaaatgggggataatattgtgattattagataa

SEQ ID NO: 4935 - DNA, 723 bp, Nitrococcus mobilis
atggcgccgtcagcaccgcaaattggctttgatcggttcataccgctcgagtgggcggctgctgcactcagagtgcgtgctgaactcggttcgctcgatgagctgaattacttgctggacgcggctggcctgggtgtggcggcgcgcaagaagacacgaaccgtgttgaatcggctatggctggatccacggcctgaactcgtcgatttcgcagaccggggtaccgggattttcaaagccgacccgagagtggctgtctctgcgctgacctgggggatggccattgcgacctatccgttcttcgggaaagtgtcagagctcgtggggcgcctttcggcgctacaaggtgactgcgcttctgcggaggtccatcgtcgaatgagcgagacctacggcgagcgagaaggcacctaccggatgaccaacatggtgctgcagtcgcagactagctggggggcgatcgaacgcgtcgagaaaggtaaacgcctcgtgcggctagagtcgatcgtggttggcgatgcgcagatggtggcgtggctgatcgaggcggcattacgttacatcggcaaagcagtgtcggttccgtcgctggcgtctttggctgtgatctatccattcgtgctcgaccagccgcttggatacgtcgcgtcgaagagtccacatctggaattgaagcgggagggcgctgggaatcaatgcgtgtgcctacaggttagccagtga

SEQ ID NO: 4936 - DNA, 600 bp, Enterococcus faecium; identical to SEQ ID NO: 4687

SEQ ID NO: 4937 - DNA, 669 bp, Eubacterium saburreum
atgccagaatcaaaagcggcagatacattaaaacaaaatccgggaatggagaggacgaagatggaaagaaaatcgtatagtgccggagcagtgaaattttcgttctggttcatggaatttcggaaaaccgtgcagcttttgagtgagggtgagagctttgtagacattaaaaagttgaatgaagagacaaatatttatggcgcaccgacaaaactgcgagcgcagcagatttattctactgtaacagcccgtatcaagacgttagatgaaagcttttacccaatctttttgagcagtgatcttgctacacaaaaattatttgtgctgactgcggctcttttgcatgacacgctgttctttgattttgtgtatgaagtagtgcgggaaaaaatgattcttggttccgatgagctgacggatgcagatatccggatatttttcaaaaataagcaggaacagagtgagaaagtggcttctcttcaagactatacgctgcgccgtctcggttcctgctataaaacacagctttatgaagcaggacttttagaaagcaaccgggcaaacagcacaagaaaaatactgaagccaattcttgatattgcatttgaacattggctttatgacaatgatcttggcatcatggtaaaaacactgacgggggtaagatga

SEQ ID NO: 4938 - DNA, 581 bp, Escherichia coli
taggagacttgctgggcgggccgctcatgagcagggaaagccgcgtcattgccgagctgttgctaaccgatcccgatgaacagacatggcaagagcaaattgttggccacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgtcagcatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4939 - DNA, 801 bp, Vibrio cholerae; identical to SEQ ID NO: 4596

SEQ ID NO: 4940 - DNA, 606 bp, Escherichia coli
atgacaaaaaatgacaaacgctggattggcgatctgctgggtggttcgttgatggttcgtgagagccgaaccattgctgagctgttgctctctgaaccagatgaaacaacctggcagcagcaaataatcaatgaaaatattcttcaggcgtcctccacgagtacggcaaatcgttatgcccgaaccttaaggctgcgattgatgaccctggatcgggagtgctggcaactgattgctgatggcagtgaaagcgagcgtctgcaaatgttgttggttgcgttgatgatccagtctccagttgttgcgacgtttattgctgaagttgtaaatccagctcgtcagcagtttaaagaaaagcttggtataaattgttggagtgagtttgtggatgagaatctccgtttacacccggaactggcagctttttctgattcatcgatccaaaagatgggtaacaatcttattaaggctctcgcagaagctggttacctggatagcccacgccgccgcaatttacaaaacgttttcctgctaccagttgttgcagcggccttgcatcgtttaaacaaagccgaactgctccctattctggagggtaacgcatga

SEQ ID NO: 4941 - DNA, 600 bp, Enterococcus faecium; identical to SEQ ID NO: 4687

SEQ ID NO: 4942 - DNA, 600 bp, Enterococcus faecium; identical to SEQ ID NO: 4687

SEQ ID NO: 4943 - DNA, 609 bp, Eubacterium saburreum
atggaaagaaaatcgtatagtgccggagcagtgaaattttcgttctggttcatggaatttcggaaaaccgtgcagcttttgagtgagggtgagagctttgtagacattaaaaagttgaatgaagagacaaatatttatggcgcaccgacaaaactgcgagcgcagcagatttattctactgtaacagcccgtatcaagacgttagatgaaagcttttacccaatctttttgagcagtgatcttgctacacaaaaattatttgtgctgactgcggctcttttgcatgacacgctgttctttgattttgtgtatgaagtagtgcgggaaaaaatgattcttggttccgatgagctgacggatgcagatatccggatatttttcaaaaataagcaggaacagagtgagaaagtggcttctcttcaagactatacgctgcgccgtctcggttcctgctataaaacacagctttatgaagcaggacttttagaaagcaaccgggcaaacagcacaagaaaaatactgaagccaattcttgatattgcatttgaacattggctttatgacaatgatcttggcatcatggtaaaaacactgacgggggtaagatga

SEQ ID NO: 4944 - DNA, 600 bp, Enterococcus faecium; identical to SEQ ID NO: 4687

SEQ ID NO: 4945 - DNA, 600 bp, Enterococcus faecium; identical to SEQ ID NO: 4687

SEQ ID NO: 4946 - DNA, 600 bp, Enterococcus faecium; identical to SEQ ID NO: 4687

SEQ ID NO: 4947 - DNA, 609 bp, Lachnospiraceae bacterium
atggaaagaaaaccgtatagtgccggagcagtgaaattttcgttctggttcatggaatttcggaaaaccgtgcagcttttgcgtgagggcaagagctttgcagatataaagaaattgaatgaagagacaaacatttacggggcgccgacaaaactgcgagcgcagcagatttattctacggtaatatcccgtatcaagaccttagatgaaagcttttatccggtatttctttgcagtgatcttgccacacaaaagttatttgtactgactgcggctcttttgcacgacacattattttttgattttgtgtacgaagtcgtgcgggaaaaaatgattctcggatccgatgaactgacggatgcggatatccgtatattcttcaaaaataagcaggaacagagtgagaaggtagcctcttttcaggacgctaccttgcgccgtctcggcgcctgctataaaacacagctttgtgaagcgggactcttagaaagcagccggctaaacagcacaagaaaaatacaaaagccgattcttgatattgcatttgagcactggctttatgaccatgctctcggcatcatggtaaaaacactgacaggggtaagatga

SEQ ID NO: 4948 - DNA, 600 bp, Lactobacillus reuteri; identical to SEQ ID NO: 4551

SEQ ID NO: 4949 - DNA, 606 bp, Lachnospiraceae bacterium
atgaaactatcatcgccatacaacggcgcactgacaagagagcagttccttttttatgagatgcgcactatggcaaaacttgttgcggctggccttactgacgaggaagcaacggaagctatcataaaggataatctctttcagtacccaacagaaaaatcaataaagaatctggctggagtgtgtcttaagcgtctgcattccatgaatgatgattgccttatggaggccattgcaaaactgccggcagatgctgcgaagcagatttgtctctacgctatgatgaagaaaaaccgtcttgtgtgggattttatgataaccgttatcggagagaagtaccgaatattggacacctcttttggtaaggtagacttaaacacatttttcatgcgcctcactgagcaggatgacaatgtagcttcctggagcgatgcaacggttcagaaaataaagcaggttctcgttcgtatattggtggagaatgagtatctggacagtacccgcgcagaccatctgaatccggttttgataggttcacttttagaagaacgtattcgggcaaacgacgacaatgccgcactgattgcattcaattgtctgagttag

SEQ ID NO: 4950 - DNA, 600 bp, Enterococcus faecium; identical to SEQ ID NO: 4687

SEQ ID NO: 4951 - DNA, 603 bp, Sporolactobacillus vineae
atgccggttggtatgaactattcgtcttcacttaagtcctttgccctgctatttacagaattaaagaatctttgcatgttgcgtatgcaaggactcagtgacgcggatctaaatgacaaaattcttcgtgacaacttgtttcaggttgcttcggaatcgcggagaaaggaactgaagtctgtcacgatgaaacggatgcgtgcacttgatccctatttaatgaagaaacttgtgacaggtgacctggccaccgggagagtgattgctctgtatgcgttgatcatgacggatcggttattcagggaattcatggttgaagtcgttgcggataaatttgcgatacgtgacgatcaactcactaatacagattttgaccatttttttgaaagaaagaggctgctgagtatgcgagtgaacaaatggacggattatacgttttacaagatgagacaagtcatgatccggatcttgtttgaatccggattcttgaagatcaataagtctgcccgttatctggtacgaccaattatcgatccggacgttcgcacatatctggcggatatcggtcagccggaaattatagctgctttggtaggtgattaa

SEQ ID NO: 4952 - DNA, 714 bp, Treponema primitia
atgttaaagtctgttggtttcctacgcgccgttagcaatgcatggcttgacaaaacagttgagctatatttgaccggacttgatcctgataaaatcagagaagaattaaccaatcatatttcttttgaactcaagggaaaagaaagtatacggaaaaccattgatgttttaatggcaacatggataaacattaatacagaaaatcagcaagccagaaaaacagcaataacagcatataaaaattgcgcggaaaaccataatattcagcattattgtatgcttcttctagcttatcccgtatttaatgatttctgtaatctcataggtaaaatatcaaaaatgcaggatacttttaccaaatcatggcttagggataaattatttgaacaatggggtgacagggtctccattgacaattctttaaagtatttgattcaaacacttctatcattacaaattcttgagagaattggggtaggaaaatatcaaataaaaaaacatgaaataatggacaatcaaaataaaatactattattacatgcattagccctattaggagggacaaaatattgtgtattatcatctgcaaatttccagccaattttattcccttacattgttgaattttctccagaattaatacttaataattcaatacttgaattatgcatattccaggggaaggcaattatatcattaaaaaaagatggctaa

SEQ ID NO: 4953 - protein, 261 aa, Acidiphilium multivorum
MTPAARSHVVSSFTLIKGAMIAETYAVFAAWDFGASKKANLDRLRSDNFIGAGSTTWLRDVAKVLNRRFDPVNRDRALVLLAKNGCPIDEWKPILLWHVTRDEFLLRDFLINWLFPTFVSGTYRVRTEDVYEHLRSVGRRGGIIEHAWSDTTLNRVSAALLKMAVDFGLLRGSSTKEFASYHLPERSFLYILYALREETRNPRKVLETAEWRMFLMLPSDVERELLRLHQYQKVDYQIAGSLVQLSLPCANACEYAKRMVA

SEQ ID NO: 4954 - protein, 210 aa, Acidithiobacillus ferrivorans
MRKGLVTTSDRYRLSFTTGGLFLQEAPLIATRYLALRDWAQTREQVRAENLLQVRTAATATRVSQELIARLELLDIEELQYLTEGSSHERGCLLWSAACRRYALIRDFAQEVLREHYLSLRGRLTASDYDTFCNAKALWHTELDEIAPSTQSKLRQNLFRMLREADLISAQLRIQPALLTPPLARLLARHGHEPLLVFPATDHDMQRWLQ

SEQ ID NO: 4955 - protein, 212 aa, Acinetobacter baumannii
MIKLHRRLAMLEQFYYDSDLIGGSLMVRESRLIADLLLREATPEQWHQAIQIDNILQKRTPASAQRNATAIRKRLERLEPDFWKALRDGDDELATQVAFCGALERNLLLLEFMETVMREAYISQAQYLDSYIWSDFLDERSQRDLDICDWKESSKKKMGQVVFRILAEAGYLKNTRKLELQRVIVRAELRSLLEEHYKQRIKRSMEVSLWTR

SEQ ID NO: 4956 - protein, 253 aa, Alteromonas macleodii
MFTQEQLTKLGFKFGKNGAHSARSLMIEELKHLLFSRDKSAQLKDYEDDVINFNLLHKPTEKSRRLTFRHLNDLYGLDPAIPLFKVFRDWWELHEDSQEILALQLSLARDPLLRASAEIIIKLEPGEHLARETMEEFLAKDDPERFSAASLKSFSQNINGTWTQAGFLSGKAKKYREIPKCSYVNVAYALFLAHCHGLSGMRLFDSFWCRTLVQDKETLYDLAHRASMRGLINFKQASEVVEVTFPHIELPEI

SEQ ID NO: 4957 - protein, 269 aa, Anaeromyxobacter dehalogenans
MSLAEIASIEFFPPGGPPAGAAKLGFRFGDKGTHSSRTLMLAELEAVLAAAPAIADRAAYSAAIIDGNCLEKPTASTRRLSSQRLGELYALDPFVALFRVLRGLWSLDPNARPLLAMLAALARDPLFMASAAPVLSQPPDIEIQRAPIREALRRVVGERMNDDTLDKVVRNVSSSWTQAGHLTGRTFKHRQRVSAPPTAVAFAIWLGNAAGFHGEDLLTNGWIAALDCTASSARALAIEAKRLGLIDLRTAGDVVEFELGRLDPGLGRQ

SEQ ID NO: 4958 - protein, 201 aa, Aromatoleum aromaticum
MTKSPALYNAEISAGSLMLVESRRIARLLLTHPDRVTWVDTLKHDNILQKKSPATARRQARLIRNRLETLDELGWQMVADGEQEIALQILLAAAIKHSRLLGDFMRDVVAEHLRRLEHTLSPANWDAFLADCAQRDSVVGTWSPGTQAKLLQVVLRMLAEARYLESTRNLQLTPPMLHPEVLRYLQARSETAVLAAMELKQ

SEQ ID NO: 4959 - protein, 239 aa, Arthrobacter sp.
MTGSTDVRVPKCQHSTERHLLTVTSEMRPPMVEQHAATQRYALSFTSGALLMREAAIVAPIYLRERHWAKVRSVIAEENLLQARTVSSGSRLAREVVQRLAVLTGDEIELLIEATATERGHLLWAAACRRYELIGDFAEEVVRERFLLMTPTLAYEDFDSFVRNQAVWHGELAELKKSTLQKLRQTVFRMLAEAGLLSGSGDLVPVVMSQRVAQALARREPSDLRFFPLSPVGIRKGVR

SEQ ID NO: 4960 - protein, 230 aa, Azospirillum lipoferum
MLAELSTLLSIEPQPSDRAEYAELIIQDNRLGKQTAATRRLSYTRLGELYALDPTVPLFRILRRLWRLDETSRPLLALLAGLARDPLLLATAPAVLQLRPGEDLQRGAVRSALLNTSGDRLSAAVLDKVLRNTASSWTQSGHLIGRTFKRRQQVIATPITVAFALWIACQAGFSDTEAFQSGWVNTLDLEQPHALRLAGEARRLRLLDMDIAEQVVTLDFARLDGTFWER

SEQ ID NO: 4961 - protein, 179 aa, Bifidobacterium animalis
MTVQTGAAIVSIRDEIVDINALAIRTASANKRITAEVCKRLSTLSYEELGFLASDRSSPQDRRYLLWIAMCRYYLFVGEFASEVLRERFLLGETISLADYDRFVLNKALWHPELESVSTATASKLRGNVFKAMREAELIEGGPRGACAIVPAVPGHTLSEMEGPDAASLLFLPVRGLVN

SEQ ID NO: 4962 - protein, 203 aa, Bordetella parapertussis
MSNDRYSMSFTTGSLFHRESVELAALYLDLGDWNAVRDKVIAENLLQTRTLNTLKRVCREVISRLRTLSPGELEFLVEGSHQEQAYLLWLAVCRRYRFIADFAVEVLRERYITLKSDLTHEDFDSFFNRKSEWHLELDEITPATRGKLRQVLFKMLREADLLTANNMIHAAMLSPRLLELFHQGSRRDVLYFPVFESELKGMA

SEQ ID NO: 4963 - protein, 421 aa, Burkholderia sp.
MAGARASVGATAVADETEVARPPLLCARGPETTGRPCARDAGRCAVPSAAQGAYLGRKAGPRWASERSNAVCGMLALRKQNAYRECVCRQAKTKLSVSGWSGISSRRCRRPPNAKCGASQIWLRSWWLPIVVPKAIRWMGFQATRCLIRCRKNSNVTEPREVLLSKLGFRFGMNGPHAARTMMLDDLRLLMSCAPPQATRAEYRAAVVDGNVLGKPTRKARELAFRHLSTLYALDVSNPIFRALRRLWPLDEAAQPLLALAVALARDPLLAVTRTFVLGQAIGAVVARESIESFIESRDPSRFSAESLKAFAQRIGGTWTAAGYLQGKVRKTRVAPKAHPESVTLLLFLSYLEGRTGLRLFSSEWLNLLGKTPDELEALASSASHRGLLVFMNAGGVKEVRFPAYLTPEEEKIRQEVSHVV

SEQ ID NO: 4964 - protein, 202 aa, Burkholderia gladioli
MLGRVAVGVYNAEISAGSLLIPESRRIATLLLSHPSDEQWEAALNDENLLQKKPATARRQARLIRKRLETLDDEGLQLVAGGDSELCRQVLLAAAMRHSRLLSDFIRDVYAADLRRLEHTLNHRQWDGFLAECEHRDETVAQWAVSTREKLFQVIVRILFEAKYLDSTRQRGLTPPLAHPRAKAYLRQLGDLETLERLELLA

SEQ ID NO: 4965 - protein, 220 aa, Burkholderia vietnamiensis
MQSMSMPPGQGVLRHPRGALGRQPVGIYNAEISAGSLMIPESRRIATLLLSQPSDEQWESALNDENLLQKKPATAKRQARLIRRRLETLDEEGIRLVAEGDSELCRQVLLSAAIRHSQLLGDFMRDVYAADLRRLEKHLSHRQWDAFLAECEHRDDAVARWAESTREKLFQVIVRILFEAKYLDSTGRRGLTPPLVHPRAEGYLKRFGDVETLARLENLA

SEQ ID NO: 4966 - protein, 189 aa, Calditerrivibrio nitroreducens
MPVLETLKLIELKKQGLSDKDIETEVLINNYLQKVRPSTIKRVFGEFKKRLSYMDKDFIDLITELPFESKKHLLFANILETYPIMLEFMTEVVSVKLENYDFILYVSDFFKFLNSKEGASIQSLSENTRRKVKQVTFKILEQAGIIDSVKNRKIIKPLLNDNIIRYYSNKKEILKGLLMNENEILANIG

SEQ ID NO: 4967 - protein, 200 aa, Carboxydothermus hydrogenoformans
MIEEMEYKTTIKTLPFLFLEMKKAANLVLQGLKDNEIKEKALYDNIFQVNTETRRKEIASMVLKRIKVLDEVLLHKLVHGDIETGKLIVLYSIMKTDRLFFEFMDEVFKEKLIVKDYVIEDKDFNIFFDRKREQSKKVASWDDYTFYKLKQVFIRILYEAGLISNKRNRKIIKPVLDPSIIEHLKEKGEKAILNIFLGLN

SEQ ID NO: 4968 - protein, 204 aa, Chlorobium phaeobacteroides
MSNDRYSMSFTTGSLFHRESVKLAALYLDLGDWNSVRDKVIAENLLQTRTLNTLKRVCREIISRLRTMNPGELDFLVEGSHQEQAYLLWLAVCRRYRFIADFAVEVLRERYITLKADLTHEDFDSFFNRKSEWHLELDEITPATRSKLRQVLFKILREADLLAANNMINAAMLSPRLSDVIHRGSRRDVSYFPLFESDLKGMAK

SEQ ID NO: 4969 - protein, 201 aa, Clostridium clariflavum
MVEELEYKSTIKSRPFLFREMKKAAELINKGFKEFEIKEKAKKDNIFQVNTETRRSEIASIVLQRLKAIDDFLIEKIVNGDIETSKQIVIYSIMKTDRLFFEFMYEVFREKILLRDFTLQDKDFNLFFNRKKEQSERVASWDDYTFYKLKQVYIRILFEAGFIKDQKKDREIVKPILEEEVVQHLKEIGDIKYLNALMGEI

SEQ ID NO: 4970 - protein, 201 aa, Clostridium clariflavum
MSFKWEYISTLKSKSFLYKETKKVAGLINQGFNEFEIKNKAKKDNIFQVNTEARRSEIASTVLKRLKVLDDFFIEKIVNGDIETGKQIVVYSIMKTDRLFFEFMHEVFREKMLFKDFILYDKDFNIFFNRKKEQSEKVASWSDSTFCKLKQVYIRILFESGLLKGQRRKREVVRPIIEEEVVQHLKEIGDSKYLNALIGEV

SEQ ID NO: 4971 - protein, 202 aa, Clostridium ljungdahlii
MTKQLEYKSTIKSMPYLYIETKKAASLILKGFNDYEIKNMSIKENIFQMKSEARKKEIASITLKRLKSLDEFLLDKLVNGDLETSKQIVIYMIMKTDRLFFEFMSEVYRNKNILREKYITDSDFNVYFQRKCEQSDTVASWKEYTFYKLKQVLTRILFEAGFIKNQKGDKEITIPIVDCDLAQHLKEIGDGIYLEVMLGHKS

SEQ ID NO: 4972 - protein, 198 aa, Clostridium saccharolyticum
MEKYSSGLVSESFWFIEFRKIIKLKHEGKTWDEIKDLCLTDNLLGISKEYRAKRNYGYLKNRIDALDTGLIQVFIHADLNTQKIINLIAIAKKNRLFFEFLYEVYREKVQMGAPELTESDINIFYKNKQGQDDDVSTWTDVTLRRLRSTYMNFLTDAGLLTVSGKEKKITPPILDITLENYLKDNGDNQMIKAITGVS

SEQ ID NO: 4973 - protein, 202 aa, Clostridium saccharolyticum
MERKPYSAGAVKFSFWFMEFRKTVQLLSEGKSFADIKKLNEETNIYGAPTKLRAQQIYSTVTARIKTLDESFYPIFLSSDLATQKLFVLTAALLHDTLFFDFVYEVVREKMILGSDELKDADIRIFFKNKQEQSEKVASFQDYTLHRLGSCYKTQLYEAGLLESNRANSTRKILKPILDIAFEHWLYDHDLGIMVKTLTGVR

SEQ ID NO: 4974 - protein, 198 aa, Clostridium sticklandii
MEKYSSGLVAESFWFTELKQIIKLRYNNVSWDEIKKLCVEENLLGIAKQSRSIRIYGYLKGRVDCIDKELMEIFLSSDLETQKLINIISVARKNKLFLEFLYEVYREKAIIGHSELTPSDINIFFKDKQLQDSNIATWTDVTFRRLRSTYMNFLTDAGMVRLHNKKRLITLPILDIVLENYLVAHNEITLLKALTGGR

SEQ ID NO: 4975 - protein, 200 aa, Clostridium sp.
MERKEYSAGAVKHSFWFMEFRKVVSLRAEGKSWDEIKQLNKDENIFGAPTPLRANQIWSTVSGRMKCLDDSFYPVFQACDIAAQKLFALVAAMAYDTLFAEFVYEVVREKMIIGTSELADSDIRIFFKNKQEQDDKVAKWTEATTKRLGACYKTMLFEAGVTDKAKDTRKILKPILDPAMERWLMDHGMEYCVKALTGVR

SEQ ID NO: 4976 - protein, 262 aa, Cupriavidus necator
MAKNKPYTTQLQAGLGLVNETKALLDLWSPGMSANQLHQVALGSGRFPTVTARRLRNIVVECFAPRYLVAGGASAAHLKRLSATISTADLTQLMFVHTSRANPILGDFVRQVYWTRYAGGYTQITNDDARAFVERGIDDSKTVKRWSETTVRRVSAYLTGCCADYGMLERGLRSSRRILPLRISPSVAAYLAYELHFAGVGDNALLTHEDWQLFGLAREDVLEEIKRLSLKGLLIVQAAGDVIRISWKQQDMEALCDVLTQS

SEQ ID NO: 4977 - protein, 266 aa, Dehalococcoides sp.
MIMENNFQRKYSTAISKGAGLIEETRRLLDHWRPDEPLDDFTHRVQVEGLLGNSTAYRTRDVVRRVFAPRLLRPNDKPARILKSVIESGLPARTFTELLFVFAARQDPLVYDFTVREYWPAARRGRSFLDTDPMLSFLSQAHYDGRLDNQWSENVSLRIARCVLGILRDVGFLRETVRGRREIVNYRMSDEGAAILARELNESGVTDSSICNHPDWSLFGMTPSDVVERLDEIGEQRGLIVQHGGSVVHFTWGVKSIQELINVLAR

SEQ ID NO: 4978 - protein, 261 aa, Dehalogenimonas lykanthroporepellens
MKQKRYTSQLGTGLGMIEETNALLNVWTPGMSSTQLFEEALNSGSFPGISARRLRNLISGCFAPRFLVNDGKPAEYLKNLRPDLSSREVEQLLFIYTCRANQILEDFVREVYWPAYAAGHESISNSEAQIFVTKAVQAGLTTTPWSEKTIKNVAGYLTGTCADFGMLERGQKVNRKIIPFRTEPNVAIVLAYDLHFSGLGDNTVVAHSDWALLGMDRSDVVTELRRLSLKGVFLVQTAGEVIRIGWQCKNPEELSSAISQG

SEQ ID NO: 4979 - protein, 201 aa, Desulfitobacterium hafniense
MDVTMPYNGGLTAEQFLFYEMRIVSKQYLEGKTIDEIIDYIKRDNLFQYPTERKISKLARACQRRIVALGNEKLVYELANAPVEVAKQINLYAMMSYNRLVREFMTDLIGEKYRQHDFSYTKKDINMFFSRLREQNDDIALWSEQTITKLKQVLTKCLIETEMLDNFRAHELNPVFISTELESGIRENNDLTALPAFNCFR

SEQ ID NO: 4980 - protein, 211 aa, Desulfobacula toluolica
MGLHNKNGSLPKYRMSFTVGGLFYQESVSAAELYLKIKDWAKVREKILKTNLFQARTSNSLERICREVLSRLKNLSSEQLKIIHDGSRQEQLQILWISVCKRYDFIRDFAVEVIREKFLLMNYSITDEDYTIFFDTKAEWHKNLGKLKDSTKKKLKQVLFRILRQAEITSERNIILPAILTKRVARALFTDKSGIYLVLPVSDTDFKEFIK

SEQ ID NO: 4981 - protein, 266 aa, Desulfomicrobium baculatum
MTNKDKHSKGISPFGFSYERGGAHLARTIMFEELQEVLRQPTEFTVSKDDFRKAIVDENCLNKRSGRTRLLTYRHLVDLYSLDTGTTLFRNLLYLWQRDPSARASLAFLCAYARDPLLRSATPFLFDHPIGSTVIRQNLEHYIDSLETDRFSAATLKSLAQNISSSWTQAGYLSGRVRKIRSQPPVTPGATAYALLLGYLNGLRGMSLFQSEYMNLLDCPLESALDAAAEASRRGWIVLKRIGTVVEVLFPNLLTDKEMELLREQS

SEQ ID NO: 4982 - protein, 197 aa, Desulfosporosinus meridiei
MEYSAGMVKCSFWFPEFRKVIQHLNAGKKLTEIKEKNKNENIFAAPTQARASQIFNAVARRAKSLDQSFYLLFEQSDVTMQKIITLIAIMATDRLFFDFIYEVYREKLILGSDELTDRDLRIFFKDKQLQSKKVAKWRDYTLKRLGTCYKTLLMEAGITDRSTGNRKLLKPILDKSLEDCLRANGMEIMIHALTGVR

SEQ ID NO: 4983 - protein, 223 aa, Desulfovibrio magneticus
MVLRSAEFRQPEKYYSQHHLQGTSVPEPRFNGEIVAGSLMVNESRKIADLLLQGLDEKAFYAALLMDNVLQKRSPATTRRQSKLIRNRLLPLHEDFWIMIRDGSHEQAVQTLLAAAIMHSRILGDFIRNVVNLQLKTFQSQVTYREWDAYFEECKQIDPTVVEWSDSTIKKIRQVVFRILAEAKIIDSTRNLKIIHFSLLPEVKNLLDNDALRYTRECLEAIQ

SEQ ID NO: 4984 - protein, 203 aa, Desulfovibrio vulgaris
MVRFRYIMSFTTGGLFLHESVKLATLYLDLGDWNSVRGKVIAENLLQTRTLNTLKRVFSEVLSRLRTFSPDELAFLVGGSHQEQAYLLWLAVCRRYRFIADFAVEVLRERYITLKTDLTNEDFDSFFNRKSEWHLELDEITPATRCKLRQVLFKILREADLLSPNNLIQAAMLSPRLLEAIHQGSRSELLYFPIFEPYVEGMA

SEQ ID NO: 4985 - protein, 263 aa, Desulfurivibrio alkaliphilus
MTRKKDNLASFGFAFPAGSPHVSRTMMLAELTLLLDYVQDPAASRADYIQAIVEDNCLNKRTERNRLISKRYLLELYALDHELLLFRALLFYWRRDPAGRPLLALLCAYARDSLLRASSRYILPLPAGAAVTRESTEEFLDSLAPGRYSPGKLASNAKNINSTWTQSGHLRGRTNKKRSHPTTTSGPLAYALLLAYLTGVRGSSLFHGEYVKLLDCSFDRAVALAQEASQRGWLVCKRVGDVIEVLFPNLINEQEMGWLREQG

SEQ ID NO: 4986 - protein, 199 aa, Enterobacter cloacae
MTAKEYLGDIIGGSLMLRESRVIAELLISSPNDDQWHNAIVNDNVLQKTSVHSVKRMASTLRKRIQPMGEVFWTELLKAPDDAARQMLLMATMCQSPVLTDFMATTLSDARQMFRESLRSEDWQEFILSRQRAIVGLDQYSESSIQKMGNNVFKILADSGYLESGRSKKLKNVFLLPQIREWANSLDCKKVYDVMESVR

SEQ ID NO: 4987 - protein, 173 aa, Erwinia sp.
MLADPDEQTWQKQIVGHNMLQASSVNTAKRYATTIKLRLNTLDKAAWMLIAEGSERERQQLLFVALILHSPVVKDFLSEVVNDLRRQFQEKLSRDSWDDFVTSHLRQQPVLTSYSESSIKKMGNNLIKALAEAGYLDTPRRRNLQSVFLLPETQATLQRLGQQELVSILEGQR

SEQ ID NO: 4988 - protein, 200 aa, Erwinia pyrifoliae
MNNDKTWIGDLLGGPLMSRESRIIAELMLADPDEQTWQEQIVGHNMLQASSVNTAKRYATTIKLRLNTLDKAAWMLIAEGSERERQQLLFVALILHSPVVKDFLSEVVNDLRRQFKEKLSRDSWDEFVTSHLRQQPVLTSYSESSIKKMGNNLIKALAEAGYLDTPRRRNLQSVFLLPETQATLQRLGQQELVSILEGQR

SEQ ID NO: 4989 - protein, 200 aa, Erwinia pyrifoliae; identical to SEQ ID NO: 4988

SEQ ID NO: 4990 - protein, 204 aa, Erythrobacter litoralis
MSASTKQDYKMSFSTGGLFHNESLEVARLHLDGEPWEDTILRAMEEGATSLPKSASNRRSLREISNRLLTLTSEERAFLLDEADRSEQQALLWIATCRAYRFIREFAVEVVRDRYLGYQLELPLESFDILLDAKAEWDDGLANLNQSTRLKLRQIMFRIMREAGIVSEDHRIQTAVISTRVRHMIEANNPGELAIFPSVPVEGA

SEQ ID NO: 4991 - protein, 251 aa, Escherichia coli
MTLAKTVYVLYITRSSLSQIAFSHGISPGPPLQSLFVFLRAAFQSSEGFSMIKNDKAWIGDLLGGPLMSRESRVIAELLLTDPDEQTWQEQIVGHNILQASSPNTAKRYAATIRLRLNTLDKSAWTLIAEGSERERQQLLFVALTLHSPVVKDFLAEVVNDLRRQFKEKLPGNSWNEFVNSQVRQHPVLASYSDSSIAKMGNNLVKALAEAGYVDTPRRRNLQAVYLLPETQAVLQRLGQQDLISILEGKR

SEQ ID NO: 4992 - protein, 251 aa, Escherichia coli; identical to SEQ ID NO: 4991

SEQ ID NO: 4993 - protein, 213 aa, Escherichia coli
MRAAFQSSEGFSMIKNDKAWIGDLLGGPLMSRESRVIAELLLTDPDEQTWQEQIVGHNILQASSPNTAKRYAATIRLRLNTLDKSAWTLIAEGSERERQQLLFVALMLHSPVVKDFLAEVVNDLRRQFKEKLPGNSWNEFVNSQVRLHPVLASYSDSSIAKMGNNLVKALAEAGYVDTPRRRNLQAVYLLPETQAVLQRLGQQDLISILEGKR

SEQ ID NO: 4994 - protein, 201 aa, Escherichia coli
MIKNDKAWIGDLLGGPLMSRESRVIAELLLTDPDEQTWQEQIVGHNILQASSPNTAKRYAATIRLRLNTLDKSAWTLIAEGSERERQQLLFVALTLHSPVVKDFLAEVVNDLRRQFKEKLPGNSWNEFVNNQVRQHPVLASYSDSSIAKMGNNLVKALAEAGYVDTPRRRNLQAVYLLPETQAVLQRLGQQDLISILEGKR

SEQ ID NO: 4995 - protein, 199 aa, Escherichia fergusonii
MNIKEYLGDLIGSSLLITESRIIAESLLKKLPEDEWKSLIVEQNVLQKKSGQTAIRYARTIRWRIEGLGDEFMTDLLAASERAYIQMLMMSLLIHSPVVADFMRHTLAEARRTYKPALTADAWSEFYDTRVRAYAELGGFSDSTIKKMGNNAIKALVDSGYLSDSRTKKIQPVYLMPEVKDWLVRLGREDLIEVMECTI

SEQ ID NO: 4996 - protein, 198 aa, Exiguobacterium sibiricum
MTIELEYSSSMNGASYLLFELKQVVKLKQEGFSIEEIRSKVVDENLFQFENKGRIKRTLPSVMKRAHVIDSALAILMLEGSIEMSKVINLYAIMKTDLLFFEFMDEVISEKLRNGDYLIEKKDINLFFEAKLEQSEKISSWSDINIEKLKRAFMQVLFESGFLKSRQSKELGHIIIDEQIKEYLNRIGDVRYVRAMGE

SEQ ID NO: 4997 - protein, 256 aa, Flavobacterium branchiophilum
MIYNTDINIIGSIPDYHLIYKALPMLLNDQTELEDILVNNNEFDFRTEKSRKRFLSALNSAFVNENNDINEFVGNLINYFKNDENSQSVLLFWLFSINNKLFYELNRDVFLKYYFQGRAELPKESIIAYIKDLISRNEELKGKWSEITIETIASKYLTILKKLNLVEGNQKKKFKLNRITDEQLTIFINLINNLKDIKINLLEEELMSFTFISNENLLDRLKRIGKKDWIKLNYNGAILQVEPVFTNNNIIDGIYR

SEQ ID NO: 4998 - protein, 197 aa, Gallionella capsiferriformans
MPRYNAEISAGSLMLAESRRIAALLLTHPSDAEWDHALRIENILQKNTPATAFRQAKLIRNRLVTLDEEGWKLIAEGDMEVSSQLLLAAAIKHSYLLGDFLRDVYARQLSRMELALNSHLWDAFWVECVHRDGDIEQWSASTRKKLFEVIVRILVEAKYLDSSRKKNMTPPSLHPTVISFLKRHGEFDVIAAMKVSR

SEQ ID NO: 4999 - protein, 261 aa, Gallionella capsiferriformans
MQQDKLSKAQTQLGFSAGGAISSRTVMQDEFSILLASESINASSDNYRHAILEHNVLEKSTASNRLKTFKYLRSLYALDPDVCLFREMRRLKQYAGTDKKLLMGLLSMARESILRECLTMVLAQPVGKSLGRPEFEEWIRAHVPGRYSESMYVSFSHNLYASFYQFGYLGESIGKARTRVRPVSGIASATYAAFLDWLEGRSGIALLQGTYSRALNISTDEHLALLQSAGRQGLLKVAYSGSVLDLAFPGFMKNSESRLAL

SEQ ID NO: 5000 - protein, 199 aa, Geobacillus sp.
MLKKYSGGFTAEHLYRNEMKIIVHLQLQGLSKEEIKKKVFEENLLHCRSEAAIKDLFPRVYRRAEVLDQQLKFFLIHGARSDQNALLLYAFLKRFSFPRDFVLEVIHYNMKKFKSTVTEGNIRTFFEEKEQQYEQVRNWTDKTKYKLKQVMLKIIVDAELLKKNGNEYEIKPIPLSRELRDYVERNPVYRDLLILTLNE

SEQ ID NO: 5001 - protein, 260 aa, Geobacter sulfurreducens
MMLTNDAIFTTRLQKGGALLDDMRQLVCQWTEAVAKPESQAGEILHKATRSRVADTYRRAFLPRFLKGSPQDAWKLARALEEAHPSIEIIRPFYYWITARAEPILYAYVTEELVEKAKTSDRAVRTEETASWINNTLRSCGRVWSPTVQLKVARGILAALRDFAILEGAVNKRLVHGHLPIETFCLIAFLLNLMGIGARELVEHSDWKLFLLAGPEVERLFFEAHQHGWLHYQAAGRVHRIEFPTNDFKDYIRVIFGTES

SEQ ID NO: 5002 - protein, 226 aa, Haliscomenobacter hydrossis
MMFLELAKVMDHSIDTSDFSGSLALNVTGKKSNSGAEKTAMYLKRLYSFDRQQPSFAALAFFWKTAETAEKPMLALLYAICVDDLLAESLAVLEASVPGEKLSVEFFENILQKNHPNHYSPNSCKSIAQNLASSWKQAGFIAGKVSISRTQPNISYRIACFAFLLAYIQGKRGDFIWSSLPVQALGLPESQLRNLAIECSKRDLMEYQHAGSVTTISFAALLNKIG

SEQ ID NO: 5003 - protein, 200 aa, Halobacillus halophilus
MHYSAGFTKEKWSEHEMYIVIELMKQNKTKNEILEEVTEKNLFQLRSPVSIKNRYNMVYRRAAVLGDELQQHFLSAVDYDRKALTLYSFLDVYRIPLEFYWERIVYKYELQESLYANDFHYFFEEKANTDDKVSNWRPETIKRLIRSLSLFFKEAKMIEKVDQTKYSINPIHMTQSLRTYAEKNDPLLYSFTVLEKVNEL

SEQ ID NO: 5004 - protein, 200 aa, Halobacteroides halobius
MKKYSTRIKSTDFMYIEFKKVARLKLENPNLTSKEIKTRAVEDNIFQVDTVNRRKTIAKAMIRRLKVVDEYLLEQLANGVLDTSKQITLYTILKNDRLFFEFMREVYREKYLIKDPYLTDKDFNIFFHKKSEQSEKVAGWKDYTYYKLKQTIVRILFEAGFINHQDERRIVKPIMNQELIEHLNELGDQEYAKVMLAKIR

SEQ ID NO: 5005 - protein, 202 aa, Klebsiella oxytoca
MTVKNDKAWIGDLLGGPLMSRESRIIAELMLTNPDEQTWQEQIVGHNILQASSANTAKRYATTIRLRLNTLDKAAWSLIAEGSERERQQLLFVALTLHSPVVKDFLAEVVNDLRRQFKEKLPMDSWDEFVTSHLRQQPVLTSYSDSSIKKMGNNLIKALAEAGYLDTPRRRNLQSVFLLPETQATLQRLGQQELVSILEGQR

SEQ ID NO: 5006 - protein, 201 aa, Lactobacillus amylovorus
MSRSYNGGIASYAIWLPELTKFIELYQSGYSINDIKQMSDEENIFQMPTKARAKRCSRNLAVRVKALPESVLNIFSQLDTSNQKIISLLSVMLTSRILDEFIYEVYRPKVQMREDILQDYEVEAFINQKRIESPTIAAWSLNTYKRIKGALKTYMRDGGLMEIDPQNKKQDKFLFPLLDCQLVLAMKVAKLDYELAALGGM

SEQ ID NO: 5007 - protein, 199 aa, Lactobacillus casei
MKKFSASFISRSFWFPEFSAVISMLNNGKDWDDITEAIIDDNIFKMSSKNRATDLKKEMFLRISSLPVSFIELFEQLPLNNQKIMNLIAIMNARPLVEDFVLDVVKKELLTGDLRLEPYEISAYLQDLPLQHPETANWTEQTLKRIQAKFHEILTQSGSTEDVGGAMQLKRALLEASLIAWLKQNGKSDYILALTGRAL

SEQ ID NO: 5008 - protein, 201 aa, Lactobacillus helveticus
MSRSYNGGIASYAIWLPELTKFIELYQSGYSINDIKQMSDEENIFQMPTKARAKRCSRNLAVRVKALPESVLNIFSQLDTSNQKIISLLSVMLTSRILDEFIYDVYRPKVQMREDILKSYEVEAFINQKRIESPTIAAWSLNTYKRIKGALKTYMRDGGLMEIDPQNKKQDKLLFPLLDSQLVLAMKVAKLDYELAALGGM

SEQ ID NO: 5009 - protein, 201 aa, Lactobacillus helveticus
MSRSYNGGIASYAIWLPELTKFIELYQSGYSINDIKQMSDEENIFQMPTKARAKRCSRNLAVRVKALPESVLNIFSQLDTSNQKIISLLSVMLTSRILDEFIYEVYRPKVQMREDILKSYEVEAFINQKRIESPTIAAWSLNTYKRIKGALKTYMRDGGLMEIDPQNKKQDKLLFPLLDSQLVLAMKVAKLDYELAALGGM

SEQ ID NO: 5010 - protein, 201 aa, Lactobacillus johnsonii
MSRSYNGGIASYAIWLPELTKFIELYQSGYSINDIKQMSDEENIFQMPTKARAKRCSRNLAVRVKALPESVLNIFSQLDTSNQKIISLLSVMLTSRILDEFIYEVYRPKVQMREDILQDYEVEAFINQKRIESPTIAAWSLNTYKRIKGALKTYMRDGGLMEIDPQNKKQDKLLFPLLDSQLVLAMKVAKLDYELAALGGM

SEQ ID NO: 5011 - protein, 199 aa, Lactobacillus reuteri
MIQNYNAGITSYALWFSEFKLCVSMYQEGNILDDIKQASDSNNVFEMPSRDRAKRASRNLTKRLKALPENIINQFEFLDVNNQKLVALLSMMLTNRLLNEFVYEVYRNEIILGDKVLEEREMIEFITRKQMESEQIAKWTDETSKRVRGSLKTILRDAGLLKREKNIDIVLQPFIDIHLAKLMKQDHLNKELTALGGQN

SEQ ID NO: 5012 - protein, 199 aa, Lactobacillus rhamnosus
MKKLSAGFISRSVWFTEFSAVISLLNEGKDWDDITKAIVEENSFQMSSRNRAQDLAREMKLRISTLPVGFVDIFDQLSLSNQKSVNLIALMLERPLVEDFVLTVVQKEFLKGDMRLEPYEISAYLQDLPLQHPETAKWTDETLKKIQTKFHEILTYSGLAEDVKGGMALKRALLDPSLIALLKQSGKANYIQALTGRKL

SEQ ID NO: 5013 - protein, 199 aa, Lactobacillus rhamnosus; identical to SEQ ID NO: 5012

SEQ ID NO: 5014 - protein, 199 aa, Leuconostoc kimchii
MKKKYSAGQVSQSFWQKEFGIGVNLFLAGKSPIEMREMSLNENIYLQASKGSRIRVAQAMNQRLSVIPDGLLNLYNDVDSQNQKLINLTAIMKLNQLIEDFIIEDFRNEIMLGDSKIEDYEWKAFMRRKEGESEIVDNWTNETKRRMLVLLKNFVRSSGLSVVDEQGVDIIQRHLLDSQVLIELEKENLGIYITAFTGV

SEQ ID NO: 5015 - protein, 197 aa, Methanobrevibacter smithii
MKYSAGIMSHSFWYLETKNTAEYLAEDISKKELMELSLTENIYQVDSERRARELTNVCYRRLNGFSNDLLIYLSTCDQNSGKLLVLISILRNDKLFFEFMHEVFREHIILGNYTIKDSDLDIFFMNKSNQSEVIENWKDTTLRKVKTNYKNFLIEADLLEKEEGNYKIILPFVDFKLKELLTQNNLTPFLNAISGGI

SEQ ID NO: 5016 - protein, 157 aa, Methanoculleus bourgensis
MLALQCALARDPILRTSAPCILSLQKGEEARKEPLMDLVEKEFPQRYSPKTVRAISENLLSSWTQSGHLEGKVRKVRRKAAAGPASLTYALFLGYLCGVRGNLLFHTVWADVLDATNTEIREYVDESMRKGWLIYKDAGGIVEVSFSSDFADGTRWL

SEQ ID NO: 5017 - protein, 230 aa, Methanospirillum hungatei
MLQEMELLFQNISPDAPFDTIKDAIINENILNKKSISGRNKTFSFLKRMYGLDDSIPLYRVFRYLFTHYEKEHPTLTLLYALARDKSLRISADYILSLDCGTQARKDDLIQTLTQNLDGSFTDKTLKSMAENLLSSWTQSGHLIGKGKKNRTKSTSGPASFTFALYLGTLIGFGGVMLMRSPFISILDLSDTERDELFHSASVMGLISYKSAGGVIEITISDLIRSLGGV

SEQ ID NO: 5018 - protein, 206 aa, Microlunatus phosphovorus
MSTSACGDRRYAMSFSTGTLLSRESVIAAPLYLDTQDWAVVRGLLNAENLLQARTASSRDRLAWEVVQRLATLTETELRLLIEASPSERSHLMWAAACRRYAFIGDFAEEVVRERFLLLTPALGYAEFDSFVRGKSLWHPELAELKPSTLQKLRSNLFRMLADAGLLANGEITQAMVSQRVLDVLNARVPSDLRFLPTRAGQEVTL

SEQ ID NO: 5019 - protein, 276 aa, Moorella thermoacetica
MQHDPILADIKQDADSRSYALWEQMGFRFGDKGTHTSRTIMLDELSLLLRECVENATRDDYITAIIDNNCLGKRTAATRRLTSQRMRELYALDPSLLIFRVLRYCWYADENGRPLLALLTALARDPLLRITSLPILRMQPGEELARQQMIDVLRESTGSRLNDSTLDKVVRNASSTWTQSGHLKGRVRKIRQKVDPTPVVTAYALLIGYLLGARGHGLFKTLWAKVLDTPSEELVSLAVDAKRLGFLDISYAGGMIEISVDRMLTGAERRLIREQN

SEQ ID NO: 5020 - protein, 205 aa, Parvularcula bermudensis
MKTDDQSPYKMSFAVGGLFINESVEVAKLRDPSERWAETISRAIQSGIISSPKIASRRRTLREIANRLCTLCPPEIELLSVTPDRNEQQALLWLATCRAYRFVEEFACEVIRDRYLSYRLELPLESFDVFFDAKAEWHEELTKISSSTRKKLRQVLFRIMRDAGIITVENRIQKALLSARLRSLIAQNKPREIELFPGLEQEASA

SEQ ID NO: 5021 - protein, 202 aa, Pectobacterium carotovorum
MTMKNDKAWIGDLLGGPLMSRESRIIAELMLTNPDEQTWQEQIVGHNILQASSANTAKRYATTIKLRLNTLDKAAWSLIAEGSERERQQLLFVALVLHSPVVKDFLAEVVNDLRRQFKEKLPMDSWDEFVTSHLRQQPVLTSYSDSSIKKMGNNLVKALAEAGYLDTPRRRNLQSVFLLPETQATLQRLGQQELVSILEGQR

SEQ ID NO: 5022 - protein, 204 aa, Pelobacter propionicus
MHLNVAQQLYNAEITAGSLLLKESRAIAQLLLQSADETAWRQAIAIDNILQKTSPASAKRMSSLIRKRLELMPRELWSMIADGTTEVAIQSLMAAAIKHSRLLGDFMLKVLQRHYREFNPKILSREWDSFLAECAHIDPAVASWSQSTRKKVGQVAYRILSEAGYLDNTRSLKLQPVLIAPEVSKFLNSHDEKYILKCMEIAHE

SEQ ID NO: 5023 - protein, 258 aa, Pelodictyon phaeoclathratiforme
MEVYNADINVIGSIPDFRLIEVALAEFAKGKGRVDLRELLVTNNAFDFRTESTRKRFLAAVERTILVFASERHRQLMVALFNAPGLETLKRWAIFLQLLAGNDLFRILTKEVYLKVYFSGRTTIAGDEIFAYLKDRQSHSLPLKKFSDSTLEKIGSKYLTILKKLGMVEGAVKKRLLNIRLSEDELLFFLYVILSVDDAATDILKSPYREFLFLEREQLILSLKNISFMPFINIASTGEALTVQLKLSPQELVDAISH

SEQ ID NO: 5024 - protein, 234 aa, Photorhabdus asymbiotica
MDDIDLIKASTTTFSNFTKYITKAGYFLTLVTNDMKYDKTWIGDLLGGSLMSRESCLIAEVMLQSPSKEQWQRHLVTENILQTSSERTAIRYARTLRLRLSMLDSQGLELVVHGGERERQQCLMVALMLQSPVVAAFISSVVNDAKRQFRESLPANVWAVFVEDQRRVHPELASFSESSLRKMGNNAIKALSEARYLDAPCRRHLQTVFLLPEVHDLLVRLERSDLIPLMEGKQ

SEQ ID NO: 5025 - protein, 175 aa, Polaromonas sp.
MLLLASPDEAAWRHAIEVDNILQKNTPASARRQATLIRKRLTTLDPQAWTMLAEREHEVVIQLLLAATVKHSRLLGDFIRNVYTNRQRRLEPTLAPGDWHEFLVECAHQDPQVAGWSDSTRAKLLQVIVRILVEAKYLESARSMKLTPKSLHPDVRRYLSVRHETYVLDCLERAK

SEQ ID NO: 5026 - protein, 260 aa, Pseudomonas brassicacearum
MSQRYYTTQLQAGLGLLEETRQLLQVYQFGMSASQLYEAALASGRFPLVTARRLRNIVAECFGPRYMRDPCVAARLKSLVDRFTTAELNQLLFIYTARANLVLADFVREVYWARYSAGRNDLQLEDARTFVANSVREGKTQKPWSETTIKRVSSYLMGCCADYGLLITTGRNQRSIAAYRILPKVAAYLAYDLKFSGLGDNQIVSSSDWDLFGLERTDVRDQLKRLSLQGLLIFQAASDVVHIGWTYKNMEELIDVIAQS

SEQ ID NO: 5027 - protein, 204 aa, Pseudomonas stutzeri
MSNDRYSMSFTTGSLFHRESVKLAALYLDLGDWNSVRDKVIAENLLQTRTLNTLKRVCREVVSRLRALTQGELEFLVEASHQEQAYLLWLAVCRRYRFIADFAVEVLRERYITLKSDLTHEDFDSFFNRKSEWHLELDEITPATRSKLRQVLFKILREADLLTANNMIHAAMPSPRLLDLIHQGSRRDVLYFPAFESDVKGMKR

SEQ ID NO: 5028 - protein, 199 aa, Psychrobacter cryohalolentis
MNSQKYNMSFTAGALLQPESVTIAKLYLELGDWDLVKDKVIAENLLQSRALSTLKRLSHEIIARLRTLNIDELTLLIESERQEQAYILWIAICRYYHFIADFATEVLRERFITFKPDLQHSDFDTFLNRKCDWHSELDSLSISTRKKLRQVLFKMLRDANFLDRKNNIQATMLSSRLIETIKRNGSRDIKYFTISENAI

SEQ ID NO: 5029 - protein, 209 aa, Rhodococcus erythropolis
MSEKSAPTTRYALSFTSGALLGREAVIVAPLYVRERDWSMVRAIIERDNLLQARTSASSRRFAREIVQRLGMLTDAEIELLVNATATERGHLLWAAACRRYELIGEFAEEVVRERFLLLASMLTYEDFDSFLRGKSLWHPELAELKDSTLHRLRSNVFRMLNEAGLLSDGGQLLPVVLSQQVASALSDRCPSDLRFFPTHDDATRGFER

SEQ ID NO: 5030 - protein, 256 aa, Rhodopseudomonas palustris
MKVHPEWSQRLLRKGVLVQETYELFAAWDDGLSVADNLKSTLSGRHRTAGWEREVTSTLKRRLRGVEPARPLIALAKGGMPLADWRDCLRLWVGASEEPFHDFATGWLFDEHEKGRYQIRSEDVRPVLAKAIASRGPEAKPLSEYGLLRGARDLLRMAVDLAMLSGDGPTKTFASIAMSDDVTMFYVHMISDLESNTKKMLTSRLWRLAYMAPKDVHVALLRLHQYKRLNYEVAGNIAQVGLPFGSALECAERIAA

SEQ ID NO: 5031 - protein, 238 aa, Saccharophagus degradans
MMLPELTQLFEFLPEATATKAAYFEAIVDDNCLSKRSARTRLLTARHLADLYGLDNAFLLFRALKFFWYRAEAARPQLALLLAYARDPILRMSAKHILSASPGVQIQRQGIEDIISNQFPDRFSEATLKSTAQNINATWTQAGYLTGKAKKMRCTSEASEAAVCFALLMAYLRGTRGEELFTSEYVQLLDCRPDKAIDLIEASARKGWAVFKRVGSVVEVAFPSLINQKEMEWVREQA

SEQ ID NO: 5032 - protein, 200 aa, Salmonella enterica
MKNDKAWIGDLLGGPLMSRESRIIAELMLTAPNEQTWQEQIVGHNILQASSANTAKRYATTIKLRLNTLDKVAWSLIAEGSERERQQLLFVALILHSPVVKDFLAEVVNDLCRQFKEKLPMDSWDEFVANHLRQQPVLTSYSDSSIKKMGNNLIKALAEAGYLDTPRRRNLQSVFLLPETQATLQRLGQQELVSILEGQR

SEQ ID NO: 5033 - protein, 202 aa, Salmonella enterica
MTMKNDKAWIGDLLGGPLMSRESRIIAELMLTAPNEQTWQEQIVGHNILQASSANTAKRYATTIKLRLNTLDKVAWSLIAEGSERERQQLLFVALILHSPVVKDFLAEVVNDLCRQFKEKLPMDSWDEFVANHLRQQPVLTSYSDSSIKKMGNNLIKALAEAGYLDTPRRRNLQSVFLLPETQATLQRLGQQELVSILEGQR

SEQ ID NO: 5034 - protein, 200 aa, Salmonella enterica; identical to SEQ ID NO: 5032

SEQ ID NO: 5035 - protein, 200 aa, Salmonella enterica; identical to SEQ ID NO: 5032

SEQ ID NO: 5036 - protein, 202 aa, Salmonella enterica; identical to SEQ ID NO: 5033

SEQ ID NO: 5037 - protein, 202 aa, Salmonella enterica; identical to SEQ ID NO: 5033

SEQ ID NO: 5038 - protein, 200 aa, Salmonella enterica; identical to SEQ ID NO: 5032

SEQ ID NO: 5039 - protein, 200 aa, Salmonella enterica; identical to SEQ ID NO: 5032

SEQ ID NO: 5040 - protein, 209 aa, Selenomonas sputigena
MPQEIDGKRKASSPYSAVMTREQFLFHETRITAKLLDEGLEKDEIIKKVFSENLFQYPTEKSIRRMVLTCLRRLEALSDQTLITAIAVESGDVAKQICLYAMMRQYRLVWDFMLTVIGEKYRNLDHSFSKMDLHGFFLRLQEQDDGVAAWSDQTIAKLRQVLTKILVENGYLDSIKAERLNPVLLSPILERAIRESGQEAALPAFNCLG

SEQ ID NO: 5041 - protein, 255 aa, Shewanella sp.
MEQLPHLTQIGFKFGKNGAHAARSMMIQELTQLLMSLPEQASLDEYRANIIDANLLHKSSENARKLTFRHMVDLYGLSPQVPLFKIFRQLWDLSEESQPLLALQLAVARDPLLRGSAEVILSLEPGEMLHRETMESHLAKDDPDRFSPASLKSFSQNLNGTWTQAGYLTGKAKKYRSEPKVTYVNLVFALVLAHYHQLSGIRLFNSFWCKLLLKSHADLYELAHRATLRGLIHFKQASEVIEVSFAPLKLPEFKD

SEQ ID NO: 5042 - protein, 255 aa, Shewanella sp.
MEQLPHLTQIGFKFGKNGAHAARSMMIQELTQLLMSLPEQASLDEYRANIIDANLLHKSSENARKLTFRHMVDLYGLSPQVPLFKIFRQLWDLSEESQPLLALQLAVARDPLLRGSAEVILSLEPGEMLHRETMEAHLAKDDPDRFSPASLKSFSQNLNGTWTQAGYLTGKAKKYRSEPKVTYVNLVFALVLAHYHELSGIRLFNSFWCKLLLKSHADLYELAHRATLRGLIHFKQASEVIEVSFAPLKLPEFKD

SEQ ID NO: 5043 - protein, 196 aa, Slackia heliotrinireducens
MSSNYSLSMSGSKVRMQESMLAVEIYNETKDWSEVRRRIIDENLFQLNAVSSRKRVTGEIVKRLRTLTDAELEFLQGSYGDDRCAMFWVAVCRTYQFVRDLSEQMIAGRYNRTIPDFTMEAYDAFFEEQAEIHPELTALSDEGRKKMRNQVFLMLAECKLLSEDARITPLYPTPMFKNALDPSRKDDLRLFPGRLI

SEQ ID NO: 5044 - protein, 211 aa, Spirosoma linguale
MLLPTIHYSASFTTGALLQEETRALLTLMEQVPMDQVYDRAKKDSDYLKINSEVARRKIAGEVLKRYKAVDQGVWQFFQSRVRTNEQSILLFYVCLKTYTLLFDFVQGVVVRRWQQRLLSLDKSDFERFLDTLIPTHPELQKLTEATRRKLAQITMLMLKQAGLLERGQLVTPSLGAEVWQFFIDQDDDWMLDAGMLTRADRERLGLLLHE

SEQ ID NO: 5045 - protein, 205 aa, Sulfuricurvum kujiense
MDYQLSMTAATLRYHEAKIVAELFIETRNWSVVENRVLGDNLLQKSTSATAKREFGELKHRLSTLSDATLRAFGTDDLNELKYLAFLSCVKYYRLLNDFMIEVVRNKIQTFDYQILESDWVNFIESKKAHVPKIGQSSETTLKKIRQVIFKMLSDAGIIDDIKHRIIQPPLLSREFQSIVCRESPQLLAAFLLSDTDITKACEEV

SEQ ID NO: 5046 - protein, 265 aa, Synechococcus sp.
MTFNHQYQPKAQYSSRIIKAGALVADTKKLLCSWNLSVSTAENIKQFHRENIFGKSSRSRVADILAIFRQRYLSNESVTKALILFARSKFSTSSLIPLLYFHSSLADRLLFDVATNIIFPMYKRGLVDINRREFQYSLTKMVKEGKMASLWSENTFNRLSSGLLSTLRDFGVLQGCVNKKISPAYLPIESFAYIIFYLKQSQASGVKLLELADWRLFLLFQDDVERLLFECHQRKMLEYHVAGSVTRLTFPAKTLEEYADVLAQR

SEQ ID NO: 5047 - protein, 246 aa, Syntrophomonas wolfei
MNINSDINVLGSLSDFSLISALLVEGKNNTNYQAYSNIKTNRSYKRFASAITNTLIKFTDPNMEYLIRDVFEHEGLSAHCLLLIFWNACVNNELLDYLNQKVYFPALYSGRAALKKDEVVACLQELKQSETAMQKWTDSTIETTASKYLTFLKKFNLMEGRVNKTIAPPVMSDKELILFIYWLLSVEPKTNLLESGWLPYCFLEKELFIQQIMQKRYMKFYNLQYSVNNLKIEPTFSYKELYHELG

SEQ ID NO: 5048 - protein, 199 aa, Syntrophomonas wolfei
MTEIKYSAALTGEPFLFYESRQVARLKLSGRNQQQIREEIKSQNLFQYATEKSLAKRINAVQKRVDTLDETLLRFLAEKPSATAKIINLYAIMQTNKLMLDFIIEIIGDKFEQGNLVLEKRDLNEFFVAKREQQENIARWSDETIAKLKRVLPRIIFEAGILADRNTGTLQRLTLDKDVEKYFREHGEIEFLKAVGTIV

SEQ ID NO: 5049 - protein, 269 aa, Syntrophus aciditrophicus
MKTIQPIDWLQPKTEAEEIRFRSTGFRWGNKGTHTSRTIMLDELRALLNYSRPDATRDDYVSVIIEDNCLGKRTASTRKLSLQRLSELYALDPKVLLFQLMRYFWYADRSGQAILPLLLALARDPLLRATAASVLCMHPGEEFARQPMTDALNQAAGGRFNEGTLNKIVRNAASSWTQTGHLKGRSHKVRQSIAPTAITTAYALLLGYLTGTRGAKLFETPWAQALDTPPSTLMHLAMDARRLGFLDMSQSGGIVELGFSRLLPLDERR

SEQ ID NO: 5050 - protein, 109 aa, Tepidanaerobacter acetatoxydans
MKTDRLFFEFMNEVYKDKIILGDRFILDKDFNIFFDRKKEQSAKVASWADYTFYKLKQVISRILTESGLVKNKGKKIEIVRPIIEHSVVDHLKEIGDTVYLDILLGKLD

SEQ ID NO: 5051 - protein, 202 aa, Tepidanaerobacter acetatoxydans
MENKWKYRTTIKSQSFLYVEIKKAAKLVLQGQDEYQIRNKSLYDNIFQVNTDARKAEIASAVITRLNALDRFFIEKLVNSDIQTSKLIAIYSIMKTDRLFFEFMNEVYKDKIILGDRFILDKDFNIFFDRKKEQSAKVASWADYTFYKLKQVISRILTESGLVKNKGKKIEIVRPIIEHSVVDHLKEIGDTVYLDILLGKLD

SEQ ID NO: 5052 - protein, 199 aa, Thauera sp.
MSAAIYNAEISAGSLMLPESRRVARFMLTQPDRATWFDTLRTENILQKKSPATARRQARLIRNRLETLDEQAWQLVAEGDQELALQILLAASVKHSRLLGDFMRDVVAGHVRRFEEHLVPSDWDAFLADCIQRDPAVAGWSDTTKAKLLQVILRILAEARYLESTRSLRLTPPLLHPEVQHYLKSRSEAAVLATMELTH

SEQ ID NO: 5053 - protein, 308 aa, Thermacetogenium phaeum
MARDFIIIQLASTTRIRYDNFAGIFAGKRLVLKHMKNDPILADIKQDANSLPYFLWEEMGFRFGDKGTHTSRTIMLEELSLLLHECSEDASRDDYIKAIVDYNCLGKRTAATRRLSCQRMRELYGLDPSLLIFRVLRYCWYADEKGRPLLALLTAMARDPLLRITSLTILRMKPGDELARQVMTDELRQSIGNRLNDRTLDKVVRNASASWTKSGHLKGRVRKFRQKVVPTPVVTAYALLLGYLLGVRGPGLFKTLWTKVLDTSPEELISLAIDAKRLGLLDVCYSGGMVEVLVDRMLTENERMLLRE

SEQ ID NO: 5054 - protein, 201 aa, Thermoanaerobacterium thermosaccharolyticum
MADELEYKSTIKSRPFLFRETKKAAELINKGLKEFEIKNKAKNDNIFQVNTETRRSEIASTVMRRLKALDDFLIDKLANGEIDTSKQIVVYAIMKTDRLFFEFMYEVFREKILLRDFTLQDKDFNIFFDRKKEQSERVASWDDYTFYKLKQVYIRILFEAGFIKNQKNDREITRPIVEEDVAYHLKEIGDTKYLNALTGEM

SEQ ID NO: 5055 - protein, 261 aa, Thiocystis violascens
MPGLAEATQSHARLLKCTLAIEDSRAYWSRTDGTGSVTSRQAFDEYWFGARSLGRIEVLLASLRARFDVFPPALDVLHRWSRMGPETRRIICHWHLQLADPLYRAFTGGDLVARRADPRPEVTRDGVIRWLALQGTAHWTLSTRIEYAGKLLSTALAAGLVASNRDPRQLLTPRIEDEALEYLLYLLRGIQITGTLLDNPYLASVGFAGSALEERVRRLPGIRFRRQGDLIDFGWLYPSLDAWADANLGADLPLRAAGGIG

SEQ ID NO: 5056 - protein, 265 aa, Thioflavicoccus mobilis
MSQDAARPYSTELRKGRGAVAETLTLLGAWVPGMPSTELQALAVEQGIFGSSSAKRTQDLVSVVFARRYLADGGKPASYLKYLVERGADRAVLRQLMLVYTARRNPVLRDFISEVFWTAFAAGAAALRIGEAEDFLKRAAVDGRIARPWSEVMRKRIAGDLLSTLADFGLLEDLKRPTKPIRSYRLLPDTVLFLAHEIHFKRFSDNSILESPDWRLFGLAKEDVVQQLDKVSRAGHYILQYSGDLLRISWRYQTMEECLDAIAGR

SEQ ID NO: 5057 - protein, 199 aa, Vibrio cholerae
MNIKEYLGDLIGGSLLITESRIIAESLLKKLPEDEWKSLIVEQNVLQKKSGQTAIRYARTIRWRIEGLGDEFMTDLLAASERAYVQMLMMSLLIHSPVVADFMRLTLAEARRTYKPSLTADAWSEFYDTRVRAYAELGGFSDSTVKKMGNNAIKALVDSGYLSDSRTKKIQPVYLMPEVKDWLVRLGREDLIDVMECTI

SEQ ID NO: 5058 - protein, 266 aa, Vibrio cholerae
MKDLIEKMSVQDYNTAIKDIAGLKDYTLVFNIISAYFCEPNLTDSKITDENEFDIRTSKTRNKVSWAINKAILKFINQDHELLIKKIYLSDAPLIDKKFCFLWHLCLNNRLFREVTTQVFSKVYFTGRAQISQDDIIAFLKDKMSSEGPDFPQWSEDTLYRVATKYLSLMTKFDFVTVGRGKSFNHIRPTPEALVLFVYFSNLFSPEIKSIFEHELLPASFIAKEDIQDRFKKLSMKGFFDMSFNGVALNVELTHTYKDICDALYS

SEQ ID NO: 5059 - protein, 200 aa, Zymomonas mobilis
MMSAVPKYRMSFGVGGLMLNESLAIVQSYQPGESWASARERLLAQGASSLPKLASQTRTLREVYDRIGHLSDAERQYLSAEADRAEQQAMVWLAVCRTYRFIYEFAVEVISERYQSWRLDLGHEVFDRFLAEKAESDPGLAELSASTCAKLRQVLFRILREAGLRSVEGRIQPIWLSGRMKRLIEGSNPADLRVFPGNGG

SEQ ID NO: 5060 - protein, 199 aa, Magnetospirillum magneticum
MAEPRYKADIGGGSLKLPESRIIAGLLLEGVTEDQWRHAIEVENVLQRRSPGTAKRQSSLMRNRLETMGPELWQMVRDGSTQVAIQAVFAAAIKHSTLLGDFLDLVVRDQFRMFRPDLPRKMWDQYLEQCRNRDPLMPVWQDSTANKLADCVYRILVEVGYITDSKTYRLKSVRISGEVMSYLRENNEQYVIRCIQVSI

SEQ ID NO: 5061 - protein, 204 aa, Marinobacter aquaeolei
MTQGRYRISFTSGSLYHRESVKLAELYLSLHDWEEVRVQALRDNLLQTRTESTAKRTCREVIVRLKTLTESELTFLAEANHQDQAHLLWVSVCRLYRFIADFAVEVLHERFVAMKLDLSFEDFDAFYNRKSEWHDELDNASASTRDKLRQVLFRMLREAGLLAKDKTINAVLLSPRLIELLRKNNPDEFFYFPVYESDIRGMSA

SEQ ID NO: 5062 - protein, 200 aa, Nostoc punctiforme
MTETAYAARTNHAFVLTETLRVAELMYQGATQEDIRQRVLVDDLFQLRSQVSRERALQTVLKRLQQVPEEYIQLIATSNPDTRRFTILFLILQEHRLLRELIAEVLLDKIKGFDYVVTTADLRTFFEGKRDQNSTVAAWSNSTYKKAASNTLLVLVNAGLLQPTSPRGNYQIRSVPVPSALRQQLLADGLAHYLTLMLDF

SEQ ID NO: 5063 - protein, 206 aa, Rhodobacter sphaeroides
MTVTEHQPYKMSFATGGLLLNESVEVARMHVPSEAWDTTLRRALEDGVTSLPKAASRRRTLREIVNRISTLDDEELDFLVEGADRQDQQALLWLATCRAYRFVREFATEVIHERFLSFQLDLPLESFDILFSAKAEWDEGLAGISPMTRAKLRQVLFRIMRQASVISDDNRILSAYVSPRLKAILAEKNPRDLSVFPGLSRDGGIL

SEQ ID NO: 5064 - protein, 205 aa, Runella slithyformis
MKKYTFSFTGASALIAETLVIAEEFERLQDWKEVQKSLMESNLLNKVKEVTFKREFSEIKKRLSLLTAPQLALMVHGSLDDAKAMILLSLVKAYPLIKDFITEVLLSKHLVFDRSLTESDYIRFFNAKSFSHDELNKITESTAKKVKQVVYKLLEQVGLITNAKNGTIIRPILSTNALDVIITDNPSFLTAFLFSNEEIKAYYMK

SEQ ID NO: 5065 - protein, 280 aa, Halopiger xanaduensis
MTLRTDGKGTSLPSLDSTFSHEEVSMALTRCGLLVERAETLARLYAQHRDWTVVEEQWVEERFDERSTRGSSKGIYRALSSRFKTAGSELPSIVQLPTVFDQCETKRDKAQVLYFYLVEDDPLVKYIVHRYANRLQESGVDGLDFEQDTVERLLNEFHYDDGSEFDYAESTTRRWGEGLRSVMREIDVLDTQQALEGQIPNIGTTPLLVASGYSWETHSDDWLSQPTGWLYLFQPEQYWDSLAERISDHPNWEASGIHGELRLQPVADTYDWAEPWEGEV

SEQ ID NO: 5066 - protein, 255 aa, Halobacterium salinarum
MALTRCGLLVDRAETLARLYARHRDWTVVEEKWIEERFDERSTRGSSKGIYRALSSRFKTVGSELPSIVQLPSVLDQCETVRDKAQVLYFYLLEDDPLVKYTVHRYVDRLQESGVDRLDFEQETIERLLNEFHYDDGSEFDYAESTRRRWGEGLRSVMREIGVLDTQQALYGQIPNLGTTPLLVASGYSWETHGDDWLSQPTGWLYHFQPEQYWDSLAERVSDDPNWEASGIHGELRLQPVDGTYDWAESWEGEV

SEQ ID NO: 5067 - protein, 254 aa, Halorubrum lacusprofundi
MDLTMCGLLVERAEELARLYAEHGNWNDVKERWFDERLSNRSTRGSSQKIYRVLTSRFKNAPTDLPNPSVLPTIFDECQTTRDKAQILYLYLVADDSLVRYVVHEYMARLTDGNTDSLDFSNETLVDILTHLEYSDGGSFDYADSTTERWCEGFRSVMRKIGVLDGQQSVVGTSPSVGDTPLLVAMDYSYGSDDEDWLTSPRGLLYLFQPANRWGELFDRVASTDAWEYLELHGDLDVRPSDEPYSWVHDGGEN

SEQ ID NO: 5068 - protein, 280 aa, Haloarcula hispanica
MTLRTDGRGVSLPSLDSTFSDDEVTMVLTRCGLLVDRAETLARLYAHHRDWTVVEEKWIEERFDERSTRGSSKGIYRALSSRFKTAGSELPSIVQLPSVLDRCETVRDKAQVLYFYLLEDDPLVRYTVHRYVDRLQESGVDGLGFEQETIERLLSEFHYEDGSEFDYAESTTRRWGEGLRSVLRDIGVLDTQQTLQGQIPNLGSTPLLVASGYSWEIHGDDWLSQPTGWLYLFQPDQYWDALAERVSDDPNWEASGIHGELRLQPVDDTYGWAEPWEGEV

SEQ ID NO: 5069 - protein, 279 aa, halophilic archaeon
MTLVADGSGPPLPSLSRQLSPGDVNMDLTMCGLLVERAEELARLYAEHGNWNDVKERWFDERLSNRSTRGSSQKIYRVLTSRFKNAPTDLPNPSVLPTIFDECQTTRDKAQILYLYLVADDSLVRYVVHEYMARLTDGNTDSLDFSNETLVDILTHLEYSDGGSFDYADSTTERWCEGFRSVMRKIGVLDGQQSVVGTSPSVGDTPLLVAMDYSYGSDDEDWLTSPRGLLYLFQPANRWGELFDRVASTDAWEYLELHGDLDVRPSDEPYSWVHDGGEN

SEQ ID NO: 5070 - protein, 277 aa, Natrinema pellirubrum
MNTLPDGDNGPPSLSRTFSPEEVNMDLTMCGLLPDRAEEIARLYREHGNWNQVKEIWFEERRANRSTKGSSQKIHRVLSSRFKNAPATLPNPSDLPAVLDTCSSSRDKAQVLYLYLVADDALVRYAVHEYARRLAEDFPEPLDFSNETLTSVLNQFEYTDETPFDYADSTTERWCEGLRSVMREIGVLENQQTVVGNPPSLGETPLLVAMGYSYEEGDEEWFESPTGLQYLFQPSARWEELYNRAAETEAWEFVDLHGSLQLRPTDEPYSSITSGGI

SEQ ID NO: 5071 - protein, 260 aa, Planctomyces limnophilus
MPRPSETTAFHTRLLKCSLEVEHCRAYWHRVAEAADDTITQIAFKEYWFGARSLPRVTRLINDFRHRFDQFPPAMSILHRWGTMDSSTRRLICHWHLQLADRLYREFTGGFLVDRYSAGRTEMTRDVVVRWIDHSAPQRWTTATRIQFARKLLFSAGEAGILKGTRDPREWQAPRVTDEALSYILYLLREIQFQGTLIDNPYLASVGVTGPELERRSRTFPDCPLRRQGELFEFSWRYKDLAEWAEARILHGESQLRETA

SEQ ID NO: 5072 - protein, 264 aa, Anaeromyxobacter dehalogenans
MIELGEVREPVASSATAPSEETEVHTRILRLALGIEEARAYWAHMDPAVPPGARALQAFDQRWFGAKTLERVKTLLPYLAARYDAFPEALDVLRRWRHMDPAARQVICHWHVQLSDPIYRRFTGEFLVERRTLLDPKVHRPGVARWVRQAFPGRWTESTIVQFASKLLSAASEAGLVSPKRDPRSLLFPKVPDDAIVYLLHLLRGIRHEGSLTENPYVASVGLADGFLDQRLRTIPAVTLRRMGALVELDWAHPTLTAWAEASL

SEQ ID NO: 5073 - protein, 262 aa, Haliangium ochraceum
MTRPGEATHIHTRMMKCALEVEESRAYWQHTDGSDRAAPQQAFDAFWFGARSMPRIKVLLINLRARFDAFPPALAVLHRWPDMSPDTRKLICHWHTQLADPLYRALTGDFLAERRLGPRPEITRDLVTRWVGEQGAERWTLPTRIQLASKLLSAARAAGLVASNRDPRPLTAPRVPDDALEYALYLLRGIETAGPLLDSAYFASLGLTGGILEDRLRALPGLRFRRQGDLVDFGWRYPDLAAWADAKLGAAPVAQRAQEAAP

SEQ ID NO: 5074 - protein, 262 aa, Haliangium ochraceum; identical to SEQ ID NO: 5073

SEQ ID NO: 5075 - protein, 236 aa, Acetohalobium arabaticum
MKGFDRPLKPEWVYEMIQRLEVGDKLSEHKEELDEVLKELTGKTGKRKVRTVIGRYFLKDLDKPRQRSVQDSLIFRLIKEQQLDEVKPVMLFNLLVKAPILQYFSEQLFNLYERQQEINAAFLRKKAYQRIGERDIARRSLRNFLSTLTDFGILQQQDRKIFIWNKRLIVNEENFINFLKLYSKFYLKSPQISLNDLPEYLLFYFDLPNVREIAQKYNNVHWDYTRRLQAAIVTLY

SEQ ID NO: 5076 - protein, 260 aa, Acidothermus cellulolyticus
MMKHPVQIGFSQRVRLEWYESTANLVLAGNDEVSIYHILDEMLKETLSVVGNARRGTREKVITILMKIWVRPPRHLEDMKREGLQFLQRLSRRDRITVHWGMTMAVYPFWGTVATYVGRLLRLQGTATAGQVQRRVREQFGERSTVTRATQRVLRSFIDWGVLQETSERGSYAAGSVLDVTQRDVIAWLVEAALHAHQVRAAPLGTVLESTSLFPFRFSYLPPMRLVAESDRLDLLRYDLNQELITSRSNAPSVARSGGI

SEQ ID NO: 5077 - protein, 259 aa, Anaerobaculum mobile
MPHNGQLTSQKRFSQIGFSRLIRLEWLERTANLALAGNDESSIYDALQRLLDNKLYGGKNVKGGSREKTIAILRKVWVRPPIHLICLRDDGLEILSHIPREEHVIIHWGMTMAAYPFWSAVAMHIGRQLRLQGTTSVGQVQRRISEQYGERGAVSLAVQKIFLSLADWGLLSRTANRGIYVPGLSFAINDIRVIAWLVEAFLHVHQGGPLMLDTILNSPSLFPFLINPVSAGQLVKASGRLDAFSVGIGQDFLVIGKAN

SEQ ID NO: 5078 - protein, 204 aa, Bacteroides vulgatus
MGKTVGINQRISINVIEMAMKAALEGCYSSEFAADLASGEYEGSNRINKARSIIGRLSIRNPLFPFIEEHKNEYYVAMKHKSDRAIIFTSLINAAYSFGYDAMVVLGKFFHVQDEVSTQLILNKMSSIYASNRSLPNALYCIMPMYIEAGLINRPKTGIYTKVYYEGVSTFARKLYIKSFLVHNNLIQEEDIDSLEHPYFEFIL

SEQ ID NO: 5079 - protein, 237 aa, Caldicellulosiruptor kristjanssonii
MKTIGFLKPVRVEWLNITVEELIKGKEKNEIRDVLKRIVSNYYKSEDTIRKILTILMNTWVNAAEKNMCLRDRGVDLFKIANPDEKIALHFGMLMVTYPIFNDVVFIIGKAFYLENKFKLEYLKKRIFEKWGERETLRFSIDRIIKTLKDWGLIVSKNSGVYEPRTKVTITNKDIKAFLIACYLKANERSYIDINEIENLYSFFPFNISVNLNELMNVDGLNVNKIDSVITVAVNRL

SEQ ID NO: 5080 - protein, 260 aa, Chloroflexus aggregans
MNRRLNQIGFSQRVRLEWLERTANLVLAGNDEAAMYHDLQELLKDKLSVGGNAKRGNREKVITILMKIWVRPPHELLPLHREGLNLLARLPREEHIAIHWGMAMAVYPFWGNVAAQVGRLLRLQGSVTAGQVQRRVREQYGERDTVSRAAQRVLRSFVDWGVLKETSAAKGIYTAGLTRTIDQVEVIAWLAEAFLHAHPGGSVALRSLLDATSLFPFHLRYVPAAHLVAVCDRIDVLRHGLDQDLVMLRPERLLVAQRGE

SEQ ID NO: 5081 - protein, 251 aa, Desulfovibrio aespoeensis
MGKRHEAIGIKQAIRFEWMQKAANLLLAGLDAKTIRQELHEFLADRKGNGSEGERSDQTRTFVVNNLMKIWVSPDPELIPFRDASLAFLRETPSMALAIHWGMISAVYPFWFNVARQTGRLLALQDQVTQTQIINRLKEQYGDRQTVSRYARFVIRSFVAWGALKDSEAKGCYEKAAPVSIAEPNLAILMFESALLATPEAKGALGLLLNNPAFFPFQLPVMTGDFVSQRSARIDVVRYGLDDELLKLKGN

SEQ ID NO: 5082 - protein, 251 aa, Dichelobacter nodosus
MGKRHEAIGIKQAIRFEWMQKAANLLLAGLDAKTIRQELHEFLADRKGNGSEGERSDQTRTFVVNNLMKIWVSPDPELIPFRDASLAFLRENPSMALAVHWGMISAVYPFWFNVARQTGRLLALQDQVTQTQIINRLKEQYGDRQTVSRYARFVIRSFVAWGALKDSEAKGCYEKAAPVSIAEPNLAILMFESALLATPEAKGALGLLLNNPAFFPFQLPVMTGDFVSQRSDRIDVVRYGLDDELLKLKGN

SEQ ID NO: 5083 - protein, 237 aa, Methanocaldococcus sp.
MPIKARWVYDLLNILEPGDKNDEINRKIDQILFEIAGKESRRKIKTILLRYFVETKKIDARTIEVQSSPLLYYSKNYDFQIMKPLYLEVLLIRSNSIRIILNSILKKYENINFKRKDVMEIVSTKFGQRRSTEKFVDNFLKVMVEFDIFSKIDTGVYAIKPKIKLNEKQKVLFILLYSYYTKTSTIELQTFDLIQEFNVFDLDFDEILQKYNGKLWQLSYRAGGYLVYITQKFDIII

SEQ ID NO: 5084 - protein, 249 aa, Methanosalsum zhilinae
MSKRYDSIGIKQVIRYEWMEKTASMLLAGMDEKSIRSEFNEYLMHYRCGGSEDQRSKNTCKFVVANLMKTWVSPEPELLGLRDSALEQLRKYPSESLAIHWAMICAAYPFWYNVSLQVGRLLNLQDQITLHQITNRLKEQYGDRQTISRYARYVIRSLVEWGILKDSECKGCYVKANQLNVHDDEIVVLLVESVLYAIPENKGCFKMITSSPALFPFQLSMISVDYISNKSNRINVITYGLDEIFLQLK

SEQ ID NO: 5085 - protein, 264 aa, Methylacidiphilum infernorum
MSARPNRRYNQIGLDRLVRLKWLERTAYLFLAGNEAPAVKTALQEDLQKMFRSNNTKIRGSLDKTITILMKIWVRPPHDLHPLHREGLKLLSHLPRKDHIAVHWGMAMAVYPFWGNIAAHVGRLLRLQGTAVASQVQRRVREQYGERDTVSRAAQRVLRSFIDWEVLKETSKKGIYTAGLSLAIAQVEVIAWLAEAFLHAHPNGSVALRTVLDSTSLFPFRLSPISADHLVAVSGRLDVLRHGLDQDLIMLRTKSQPAAKGSGS

SEQ ID NO: 5086 - protein, 246 aa, Moorella thermoacetica
MSRNIIIGFDRPLRPHWIYESLLLARPAQRLAELYAPFEQIVRELTGREGKRKVRTVLFRCFLRDEQNKARVRPNLVLKDLSLQYGLDFMTPIYLFYLVARTEVLRRISDHIFRLYDYGSEIKLGFLKAKMVESFGERDVVLRSARAFIQTLEHFGVVARLDGRLILYRKLPVSEEQAIIMLQLFAADILHSPQISLHHLPAAVFNFFDLPDLRTVAQKYNGELWDYQYRMVDAYLVLHSGDFPER

SEQ ID NO: 5087 - protein, 255 aa, Nitrosococcus oceani
MDKRHEAIGIKQAIRYEWMQKAAYLLLAGLDAKAIRQELHDYLSDRMGSGVRAERSTEARSFAVTILMNIWVTPDPVLETLRNDALPYLAQGRSAELAVHWSMIGAAYPFWFNVARQTGRLLALQDQVTMKQVSRRLIEVYGERQTVSRNAQFVVRSFAFWGVLKDTAQQGCYQKIVSAPISDLNLVSLMLEAALHAIPEGKGTLDLLLNNPAFFPFQLPLMTGDFIGQRREHIEIIRYGLDDELLMLKKKQGER

SEQ ID NO: 5088 - protein, 255 aa, Nitrosococcus watsonii
MGKRHEVIGIKQAIRYEWMQKAAHLLLAGLDAKTIRQELHDYLSDRMGSGVRAERSTEARSFAVTILMNIWVTPDPVLDTLRNDALLYLAQGRSAELAVHWSMISAAYPFWFNVARQTGRLLALQNQVTMKQVSRRLIEVYGERQTVSRNAQFVVRSFAFWGVLKDIAQQGCYQKIVSTPISDLNLVSLMLEAALHAIPKGKGTLDLLLNNPAFFPFQLPLMTGDFIGQRREHIEIIRYGLDDELLMLKKKQGER

SEQ ID NO: 5089 - protein, 240 aa, Parvibaculum lavamentivorans
MMTLAPRIGFDRFIALEWATTALKVRAGTAKLEDLESLLDAAGLGAAARTKTRTVLKRLWLDPRVELVDFADRGAAIFKAHPDVPVTAMHWGMAVATYPFFGKVAELIGRLSALQGDCASAEIHRRMSEAYGEREGTYRMTNMVIQSQAGWGAVERIEKGKRVLRLAPAVVENDELTVWLIEAAVRNAGRPLAIPSLQSLPVLFPFSLTRPLAYLVSNNDYMAVRSDGPNSQYVALPDRI

SEQ ID NO: 5090 - protein, 240 aa, Parvibaculum lavamentivorans; identical to SEQ ID NO: 5089

SEQ ID NO: 5091 - protein, 270 aa, Planctomyces brasiliensis
MTAVVGFDRKLKLEWLDDLADQVAKGEDVSTLRTFLHERLEEDHPGETARGKSITVLMRIWVFVPDEHHEIREQAFELLKRINAKDRIWLHWGMCILAYPLFRDTATAIGRLLKLQDEFTLAQLQRRLIDSWGERSTVVRAFQRVVRSMVEWHTLEDADTPGHFRAPTKVTTKSKSLQIWFLRACHAATGKEMVEVDQLLSLPSSFPFKITVAKSDLRNSKDFSIHRQGLDMDMVTTTASNSKPKPVKKKTAKKKVNKSQRSLFDDDQSE

SEQ ID NO: 5092 - protein, 240 aa, Syntrophothermus lipocalidus
MALNIGFDRRVKLEWLDAAAWKAATETDIAEVRKYLDDFLQSECRSREARRKTITVLTRIWVRLPQKHRSLQERALRILTEDDPDTRLWLHWGMTLLAYPFFRDIADIIGRLLTLQNEVSLEQIYRRLAERWGERSTVRRASQRVVRSMVDWGVLQDTALKGVYIPTAKKGPASASVQLWFLEALLCSEATQAVILQQLPQLPTAFPFHLDISVANIRQSKRFEIQRQGLDLDMVTIVHR

SEQ ID NO: 5093 - protein, 235 aa, Tepidanaerobacter acetatoxydans
MRIVGLDRFLKGEWLDKTMEIASNESDISLIRETLEEYLKQEIPGDITRRKARDKLMAIWVNIPEELECIKSEAIILSNKVFNQERLLLHWTMMFAVYPIFRDISTIIGAITDFQDDVTLSLVEKRIYEIWGERSTVKYAVQKIMSSMVDWQVLERRGNGKFKKKTPIKIENTSLKLLYLKAYLSVNNKDYIEFFKANNIKSVFPFEIQYKMEDFALSDEFALVKMGSDVAISLA

SEQ ID NO: 5094 - protein, 235 aa, Tepidanaerobacter acetatoxydans; identical to SEQ ID NO: 5093

SEQ ID NO: 5095 - protein, 250 aa, Thermanaerovibrio acidaminovorans
MNSRLTQIGFSQRVRLEWLERTANLVLAGNDEASIYNALQELLEDKLSVGGNAKRGNREKVITILMKIWVRPPRDLHPLQREGLKLLSHLPREDHIAVHWGMAMAVYPFWGAVAAHVGRLLRLQGTAAASQVQRRVREQYGERGTVSRAARRVLRSFVDWEVLKETSEKGIYTAGLSLAIAQVEVIAWLAEAFLHAHPNASVALRTVLDSTSLFPFRLSPVSAAHLVAVSGRLDVLRHGLDQDLIMLRSR

SEQ ID NO: 5096 - protein, 235 aa, Thermoanaerobacter brockii
MKKVGFARRIKLEWLDKVVEFYKNEKDVKKIKDELDAFLVDQVKSKVNRGKSIDVLISSWVDVPEEFKYLRDKAVVLFDKVSEGEKKFIHWFMLISAFPLFSDISTVIGKLLSIQEEFKLDTVRQRIFEIWGERSTVKFSTDKIISSMVEWGVLSKAQKPGIYKKANTIEIKNKELKLLFLEVYLKSNKKSFISYAEIDKLYVIFPFELSFELGDFYDSPVLNVNKMGDNTVIVI

SEQ ID NO: 5097 - protein, 235 aa, Thermoanaerobacter italicus
MKKVGFARRIKLEWLDKVVEFYKNEKDVKKIKDELDAFLVDQVKSKVNRGKSIDVLISSWVDVPEEFKYLRDKAVVLFDKVSEGEKKFIHWFMLISAFPLFSDISSVIGKLLSIQEEFKLDTVRQRIFEIWGERSTVKFSTDKIISSMVEWGVLSKAQKPGIYKKANTIEIKNKELKLLFLEVYLKSNKKSFISYAEIDKLYVIFPFELSFELGDFYDSPVLNVNKMGDNIVIIR

SEQ ID NO: 5098 - protein, 235 aa, Thermoanaerobacter pseudethanolicus; identical to SEQ ID NO: 5096

SEQ ID NO: 5099 - protein, 235 aa, Thermoanaerobacterium saccharolyticum
MQKVGFDRMIEIEWLNKTVEIYSKESDIKIIKQELNDYLKDKVISDDNRRKCVNILTSTWVSMPDEFSNLRDKAIKLYNDANENERLLINWSMMMLAFPIFCDIIDTIGKLLYLQDDFAIKTVLNRIYDKWGERSTVKYAVPRIIYSMVQWKALEKKNPGICQKANIIAIDNVDIELFFLECYMRSFKKDYLNFYEVNKLNPSFPFRLSIGTMDIHNSDSLNLYKVNNNLLITFA

SEQ ID NO: 5100 - protein, 235 aa, Thermoanaerobacterium thermosaccharolyticum
MQKVGFDRMIEIEWLNKTVEIYNKESDIKIIKQELNDYLKDKVISDDNRKKCVNILTSTWVSMPDEFSNLRDKAIKLYNDANENERLLINWSMMMLAFPIFCDIIDTIGKLLYLQDDFAIKTVLNRIYDKWGERSTVKYAVPRIIYSMVQWKAIEKKKPGICQKANLIAIDNIDIELFFIECYMRSFKKDYINFYEVNKLNPSFPFRLSIRTIDILNSDSLNLYKANNNLLITFA

SEQ ID NO: 5101 - protein, 235 aa, Thermoanaerobacterium xylanolyticum
MQKVGFDRMIEIEWLNKTVEIYNKEFDIKIIKQELNDYLKDKVISDDNRKKCVNILTSTWVSMPDEFSNLRDKAIKLYNDANENERLLINWSMMMLAFPIFCDIIDTIGKLLYLQDDFAIKTVLNRIYDKWGERSTVKYAVPRIIYSMVQWKVLEKKKPGICQKANMIAIDNVDIELFFIECYMRSFKKDYVNFYEVNKLNPSFPFRLSIETIDIHNSDSLNLYKVNNNLLITFA

SEQ ID NO: 5102 - protein, 206 aa, Actinomyces sp.
MSDRRLASTITVGGATNAGTFEAAELMAAGMSAREASDVLFEQNLVVAGSESTRRRLASATTKHLSFLEDDALRFVASREYGWELVMWLALVTESYVFAACAREVAWIRLVVDEAPLTASDIDNFVERQRGVDPAMSTLTVKSGQKVRSVFLRCMRDVGFINEIGVALPVLVPVGVARLVNAAPQPWGWPMRESFPVAQFQFDVLG

SEQ ID NO: 5103 - protein, 199 aa, Vibrio cholerae
MNRKEYLGDLIGGSLLITESRIIAESLLKKLPEDEWKSLIVEQNVLQKKSGQTAIRYARTIRWRIEGLGDEFMTDLLAASERAYVQMLMMSLLIHSPVVADFMRLTLAEARRTYKPSLTADAWSEFYDTRVRAYAELGGFSDSTVKKMGNNAIKALVDSGYLSDSRTKKIQPVYLMPEVKDWLVRLSREDLIDVMECTI

SEQ ID NO: 5104 - protein, 198 aa, Vibrio harveyi
MSKHKRYLGDLIGGSLMLRESQIIADLLLTEPTLEDWNKAIVEENILQKPSAASAKRNAATIKKRLESLNNEYLQKLAYSGTEEATQLMFAATLINAPILADFMRIVVTDAKRMYREALSVDDWQHFWQERGRLYPGLLEMSEASTYKISQVAFKVLADAGYIDSTKHKKLMNIFISPDVRILLSEMDRDDIVRAMEP

SEQ ID NO: 5105 - protein, 201 aa, Lachnospiraceae bacterium
MDHSYPYIASLTREPFLFYEMRSTAKLMSEGISDDTIVKEIVEQNLFQYPTEKSITRMAKACIKRLHALEDDSLVSAIASQPTDVAKQVCLYALMKQSRLVWEFMLTVIGEKYRLRDTSFGKIDLNTFFMRLQEQNDTVASWSDSTITKLKQIIARVLVETEYLDNLKADHLNPVWLHPVLENAIRSNGDTAILPAFNCFV

SEQ ID NO: 5106 - protein, 201 aa, Escherichia coli; identical to SEQ ID NO: 4994

SEQ ID NO: 5107 - protein, 201 aa, Coprobacillus sp.
MDHSYPYIASLTREPFLFYEMRSTAKLMNEGLSDEAIVTEIVEQNLFQYPTEKSITRMAKACIKRLHALEDESLISAIASQPTEVAKQICLYAMMKQSRLIWEFMLTVIGEKYRLRDTSFGKIDLNTFFMRLQEQNDAVASWSDATITKLKQIIARVLVETEYLDSIKADHLNPVWLHPILENAIRSNGDAAVLPAFNCFS

SEQ ID NO: 5108 - protein, 266 aa, Vibrio cholerae; identical to SEQ ID NO: 5058

SEQ ID NO: 5109 - protein, 201 aa, Escherichia coli
MIKNDKAWIGDLLGGPLMSRESRVIAELLLTDPDEQTWQEQIVGHNILQASSTNTAKRYAATIRLRLNTLDKSAWTLIAEGSERERQQLLFVALMLHSPVVKDFLAEVVNDLRRQFKEKLPGNSWNEFVNSQVRLHPVLASYSDSSIAKMGNNLVKALAEAGYVDTPRRRNLQAVYLLPETQAVLQRLGQQDLISILEGKR

SEQ ID NO: 5110 - protein, 200 aa, Lachnospiraceae oral
MERKVYSAGAVKMSFWFMEFRKVIGLMAEGKTLKEIKEINKKENIFGAPTILRSEQIFNTVSGRIKMLNKSFISVFQDSDVTTQKLFALIAALSYDTLFFDFVYEVIREKLIIGSNTFTESDIRIFFKDKQLQSEKVAKWTDPTIIRLGRSYKTMLFEAGLIDKGKTERKIIKPILDPAMEYWLKDHSMEAYIMALTGVG

SEQ ID NO: 5111 - protein, 202 aa, Salmonella enterica
MTMKNDKAWIGDLLGGPLMSRESRIIAELMLTNPDEQTWQEQIVGHNILQASSANTAKRYATTIKLRLNTLDKVAWSLIAEGSERERQQLLFVALVLHSPVVKDFLAEVVNDLRRQFKEKLPMDSWDEFVTSHLRQQPVLTSYSDSSIKKMGNNLIKALAEAGYLDTPRRRNLQSVFLLPETQATLQRLGQQELFSILEGQR

SEQ ID NO: 5112 - protein, 205 aa, Pectobacterium wasabiae
MTNAMIKNDKRWIGDLLGGSLMVRESRTIAELLLSEPDETTWQQQIINENILQASSTSTANRYARTLRLRLMTLDRECWQLIAGGSESERLQMLLVALMIQSPVVAEFVAGAVNPARQQFKEKLGINCWGEFVNENLRLHPELAAFSDSSIQKMGNNLIKALAEAGYLDTPRRRNLQNVFLLPDVATALHRLNKAELLPILEGNA

SEQ ID NO: 5113 - protein, 201 aa, Escherichia coli
MIKNDKAWIGDLLGGPLMSRESRVIAELLLTDPDEQTWQEQIVGHNILQASSPNTAKRYAATIRLRLNTLDKSAWTLIAEGSERERQQLLFVALTLHSPVVKDFLAEVVNDLRRQFKEKLPGNSWNEFVNSQVRQHPVLASYSDSSIAKMGNNLVKALAEAGYVDTPRRRNLQAVYLLPETQAVLQRLGQQDLISILEGKR

SEQ ID NO: 5114 - protein, 201 aa, Ruminococcaceae bacterium
MDQTHPYNGSLTAEQFLFYEIRIAAKYYVSGLKIDEAIERIKKNNLFQYPTERQVSRLARACYKRLDALGNDQLVHELASAPNEIAKQINLYAVMRYNRLVWEFMIQVIGEKYRNQDMNFSRKDMNAFFSRLQAQDDSVAAWSDATITKIKSVLVRMLIETGYLDGLKDTTLNPVFLCEELERGIEANNDYDALPAFNYFR

SEQ ID NO: 5115 - protein, 220 aa, Holophaga foetida
MAHALSGLASARLGHIPLPFWGCAVRYSANLTAGALKPAESRVIADLLLRGVSGADWKAAIEQENCLQAKSIATGKRLARLIRDRLAPFDPPFWELIRDSASPVVQQALLAAAVKHSPLLGDFLDLVVREQYRRFAPNLPFTLWEDYLLDCRGRDSEMPWWNDSTRRRLRSSVYLCLAQAGFLENTRSLKLQPVFLATPVLRYLESRDERLVLRCLQVSP

SEQ ID NO: 5116 - protein, 201 aa, Escherichia coli; identical to SEQ ID NO: 4994

SEQ ID NO: 5117 - protein, 200 aa, Oribacterium sp.
MNRKDYSAGAVKHAFWFMEFRKVVSLRLEGKTWEEIKQLNENENIFGAPTKLRATQIFNTVSARVKSLDDSFYPIFDACDLASQKLFALVAAMTYDVLFGDLVYELVREKMIIGSNELADSDLRIFFKDKQQQDDKVAKWTEATIKKLMVTYKSMLFEAGVTNKAKDIREIYKPLPDPAMEGWMKEQGMMYQLKAIMGVR

SEQ ID NO: 5118 - protein, 201 aa, Escherichia coli; identical to SEQ ID NO: 5113

SEQ ID NO: 5119 - protein, 212 aa, Acinetobacter johnsonii
MIRPHRRLAMLEQFHYDSDLIGGSLMVRESRLIADLLLREATPEQWHQAIQIDNILQKRTPASAQRNATAIRKRLERLEPDFWKALRDGDDELATQVAFCGALERNLLLLEFMETVMRDAYISQAQYLDSYIWSDFLDERSQRDPDICEWKESSKKKMGQVVFRMLAEAGYLKSTRKLELQRVIVRAELRSLLEEHYKQRIKRSMEVSVWTR

SEQ ID NO: 5120 - protein, 209 aa, Selenomonas sputigena; identical to SEQ ID NO: 5040

SEQ ID NO: 5121 - protein, 212 aa, Acinetobacter junii
MIRPHRRLAMLEQFHYDSDLIGGSLMVRESRLIADLLLREATPEQWHQAIQIDNILQKRTPASAQRNATAIRKRLERLEPDFWKALRDGDDELATQVAFCGALERNLLLLEFMETVMRDAYISQAQHLDSYIWSDFLDERSQRDPDICDWKESSKKKMGQVVFRMLAEASYLKSTRKLELQRVIVRAELRSLLEEHYKQRIKRSMEVSLWTR

SEQ ID NO: 5122 - protein, 200 aa, Shewanella baltica
MINVKQYLGDLIGGSLLITESRIIAESLLKKLPEDEWKLLIVEQNVLQKKSGQTAIRYARTIRWRIEGLGDEFMTDLLVASERAYVQMLMMSLLIHSPVVADFMRLTLAEARRTYKPSLTADAWSDFYDTRVRAYAELGGFSDSTIKKMGNNAVKALVDSGYLSDSRTKKIQPVYLMPEVNDWLVRLGREDLIDVMECTI

SEQ ID NO: 5123 - protein, 266 aa, Vibrio cholerae; identical to SEQ ID NO: 5058

SEQ ID NO: 5124 - protein, 201 aa, Escherichia coli; identical to SEQ ID NO: 4994

SEQ ID NO: 5125 - protein, 184 aa, Halomonas sp.
MVRESRAVAALLLDEVDEAHWHQAIIVENRLQKNRPATAKRAAQAIRKRLEKLEPSFWKALHDGDDQLASQVSFCAAMARNLLMVEFLESVVADAFLTRSEKLQSYQWDEFLAERANRDAAIATWAESSRRKMGQVVFRMLTEVGILDSSRSRRLQSFLPRPELKMLLETHRHTRLQNCLQKLR

SEQ ID NO: 5126 - protein, 231 aa, Bifidobacterium angulatum
MAGSYGAEATQGERYRLSFTVGGLLASQGRALAEMYLNHLNHLNHAGGGDAECSSQTEVGKSIAAIRQQAIEENVLAIRTDSANRRVVAETARRLSALTVGELAYLAGPDSSTSDREALMWIAICRYYAIVGEFAGEVLKKHYLVGNLHLDFEDYARFIADKATWHPELETISEGTAKKLRSNLFKAMVEAHLFDKNSDTVVSFLPSPSLADILMKRPDSFGFFPMRESSL

SEQ ID NO: 5127 - protein, 266 aa, Vibrio cholerae; identical to SEQ ID NO: 5058

SEQ ID NO: 5128 - protein, 204 aa, Alcanivorax pacificus
MTQGRYRISFTSGSLYHRESVKLAELYVSLRDWEKVRAQALRDNLLQARTESTAMRTCREAIARLKRLNDDELAFLAEANYHDQAHLLWVAVCRLYRFIADFAMEVVRERFVAMKLDLSFEDFDAFYNRKSEWHDELDNASASTRDKLRQVLFRMLREAGLLAKDKTINAALLSPSLIELLRQKNPEAFLYFPVYESDIKGMSK

SEQ ID NO: 5129 - protein, 266 aa, Vibrio cholerae; identical to SEQ ID NO: 5058

SEQ ID NO: 5130 - protein, 266 aa, Vibrio cholerae; identical to SEQ ID NO: 5058

SEQ ID NO: 5131 - protein, 160 aa, gamma proteobacterium
MREEVIKENLLQTRTARSSEVLYGEMQKRLSLLNSEQIELIADDYEGDVRQLVWMSICKQYPFVGDFVLEIVAPAIASGRQSIDYDDYGYFFNAKAEWHQELEKVSEKTRSNARGAVFQMMRQCGLLTESNDLVPQMISAALQNCSSESDLALIPGAIRL

SEQ ID NO: 5132 - protein, 200 aa, Enterococcus faecalis
MSKKIYSAGLVSQRFWFYETKEYIEMLNEGKTHQEIKKLSEEINIFGAASSSRSNETYNAAKRRINVLGKEMQELFPNLNIDNQKIVVLISVLLLNDLILEFMLEVYQAQIQKGILKLTTTDYKQFFSEKQRTNEIVASWQPYTYSRLGSAYRNYLLESGLIREDKGIEIITPKMVDSRVLSWLKAINRLDIAKAITGGI

SEQ ID NO: 5133 - protein, 204 aa, Pseudomonas syringae
MIMQTFSYDSDLIGGSLQVRECRVIADLLLQQASPEQWAEEIQQHNRLQKRSPASARRVAQALRKRLERLDQPFWRALRDGDDELATQVAFCAALERNLLLVEFIETVLRDAYLTKAEHLEPWHWHDFLEERSHRDPAIETWTESSRKKMGQVVYRMLAEAKLLKSTRSMQLQTLLVRPEVRTLLDDSYRHRIKACLEVSSSTL

SEQ ID NO: 5134 - protein, 201 aa, Escherichia coli; identical to SEQ ID NO: 4994

SEQ ID NO: 5135 - protein, 263 aa, Pseudanabaena biceps
MENFWLSTNDICKKLRIRRNTVYRWISKHGMPAHRIGRFWKFQKDELDLWIELNRPLSLQQGKQTAKKKTYSLSFTAGDLLFRESLVVASLFLDIRDWNLVREKVVANNLLQAKTLSTTKRICGEVCSRLKMLSQNELELLTETTIQEQGYLLWLAICRRYKFVAEFAVEVLRERYLSLKNSLNYEDFNFFFSKKIECHQELAKVSQRTIDKSRQVLFRMMRQAGLLTTENEINVALLSPRLLNELAENSHPDIFVFPYFEVG

SEQ ID NO: 5136 - protein, 266 aa, Vibrio cholerae; identical to SEQ ID NO: 5058

SEQ ID NO: 5137 - protein, 266 aa, Vibrio cholerae; identical to SEQ ID NO: 5058

SEQ ID NO: 5138 - protein, 201 aa, Escherichia coli; identical to SEQ ID NO: 4994

SEQ ID NO: 5139 - protein, 222 aa, Actinomyces sp.
MTPTMLPAYSSAQTVGGLVNPGTVEAAGLLAGGMSVRAVNDRLVADNLTRTQSSQNRRRLATTTTRHLSHLGPDALAHVAQARPGFELLLWLAIVSEARLFADCARDAVWEALVLAERPFRVADFDEFWRLKALTEPSLAALSAANRKRQRSVFLRCLREAGFIDGAGAPLPLLVPPSVARLVNGAPEPWGWPLREAFPVPQAQFDVLDGEALEQYRMRRSG

SEQ ID NO: 5140 - protein, 143 aa, Fusobacterium necrophorum
MKYRAITGENFYVQELKNACQFLLQHPELENKRQAFQERDILNCVSESNFNKKFQTIQKRLQVFTPKLMELFLKVDYTTTKFINLYAILSQERFFAEFMDEVIKEKYFLLDFELTNYDFYEFMERKKSSQKLFNNGPMPGVIK

SEQ ID NO: 5141 - protein, 203 aa, Acinetobacter radioresistens
MLEQFHYDSDLIGGSLMVRESRLIADLLLREATPEQWHQAIQIDNILQKRTPASAQRNATAIRKRLERLEPDFWKALRDGDDELATQVAFCSALERNLLLLEFMETVMRDAYISQAQYLDSYIWSDFLDERSQRDPDICDWKESSKKKMGQVVFRMLAEAGYLKSTRKLELQRVIVRAELRSLLEEHYKQRIKRSMEVSVWAR

SEQ ID NO: 5142 - protein, 266 aa, Vibrio cholerae; identical to SEQ ID NO: 5058

SEQ ID NO: 5143 - protein, 245 aa, Bifidobacterium bifidum
MAGSYGAETTQGERYRLSFTVGGLLAPQGRALAEMYLNRMGDGSTERSSQAKVSEKISEKANEKSDKNAGEEVGESIAAIRQQAIEENVLAIRTDSANRRVVAETTRRLSALTVGELAYLAGPYSSISDREALMWIAMCRYYAIVGEFAGEVLKKHYLTGNTHLDFEDYDRFITDKATWHPELENISEGTAKKLRSNVFKAMREAHLFDKNSDTVLSFLPSPSLADILRKRADSFGYLPMRESSL

SEQ ID NO: 5144 - protein, 208 aa, Bacteroides ovatus
MNKKDSPYTAAITGGGFLFEETNILLPLLRATNSEELLHDEKVNNRLLHINAESSRKKAILEIKRRYESMPSSFWDDFLGMNDTDKIVAIFYVILRTYKICFDFHVNVAIKKWNSISKSIDKNDIMMEFNEIASKDEFVDSWSDNTKDKVASAYLTILRKVGMLDNSNHLNAISCSNFTYYLGKGQPWFLEACLLQPYEIENIKKTMI

SEQ ID NO: 5145 - protein, 266 aa, Vibrio cholerae; identical to SEQ ID NO: 5058

SEQ ID NO: 5146 - protein, 208 aa, Parabacteroides sp.
MNKKNSPYTAAITGGGFLFEETNILLPLLRATNSEELLHDEKVNNRLLHINAESSRKKAILEIKRRYESMPSSFWDDFLEMSDTDKIVAIFYVILRTYKICFDFHVNVAIKKWNSISKSIDKNDIMMEFNEIASKDEFVDSWSDNTKDKVASAYLTILRKVGMLDNSNHLNAISCSNFSYYLGKGQPWFLEACLLQPYEIENIKKTMI

SEQ ID NO: 5147 - protein, 205 aa, Escherichia coli
MINTMTKNDKRWIGDLLGGSLMVRESRTIAELLLSEPDETTWQQQIINENILQASSTSTANRYARTLRLRLMTLDRECWQLIADGSESERLQMLLVALMIQSPVVATFIAEVVNPARQQFKEKLGINCWSEFVDENLRLHPELAAFSDSSIQKMGNNLIKALAEAGYLDSPRRRNLQNVFLLPVVAAALHRLNKAELLPILEGNA

SEQ ID NO: 5148 - protein, 201 aa, Lachnospiraceae bacterium; identical to SEQ ID NO: 5105

SEQ ID NO: 5149 - protein, 266 aa, Vibrio cholerae; identical to SEQ ID NO: 5058

SEQ ID NO: 5150 - protein, 209 aa, Bacteroides ovatus
MAMKINSPYTAAITGGGFLLNETLALLPLLQSEDREELLKDERLNNRVLMINAETSRKKAILEISRRYDTMSPAFWQDFLVMTAAEQPIALFFVMLKTYKILFDFHVNVTIRRWNSVAKSVKREDILMEFNEISARDAFVDSWSEATKDKVISAYLSILRKIGILDRTNQLQVLDCTNYPYYLQIGESWFLEACLLQPYQIEKIKNSLA

SEQ ID NO: 5151 - protein, 199 aa, Enterococcus faecium
MNKKYSAGLVSKRFWFSEFKLYIQLRLEGYTDIEIKEKNEHENIFFAVSSNRQKEIYQNVKRRVSQLDEAGLQLFNQLNIDNQKLVNLISILMIDDLFNEFMTEVYAENLRKGNLQLTPVDYRSFFTEKRRSSEDISKWKDYTIKRLIAAYQTNLIETGLVRGEKEYGRMTPILLDKRLIQWLVDKNRKDIVLALGGIL

SEQ ID NO: 5152 - protein, 257 aa, Yersinia ruckeri
MLYSLEPYRNMPWKFTPQMMHVTNYADHSHSFSRACRLQSLLDFCEQHSGFLMTNTMIKNDKRWIGDLLGGPLMVRESRTIAELLLSEPDEMTWQQQIIDENILQASSISTANRYARTIKLRLMTLDRECWQLIVNGSESERLQMLLVALMIQSPIVAEFVADVVNPARQQFKEKLGVNCWNEFVDENLRLHPELTTFSDSSIKKMGNNLIKALAEAGYLDTPRRRNLQTIFLLPDVAAALHRLNKAELLPILEGNA

SEQ ID NO: 5153 - protein, 201 aa, Pantoea sp.
MIHNDKSWIGDLLGGSLMSRESRVIAELLLNEPDEAMWQAQIIDENILQASSAKTASRYARTLKLRLMTLDKQALELIANGSESERLQLLLTALMLQSPVVTDFIATVLNPARQEFKDRLPGNCWDTFVEENQRQHPELTHFSDSSIQKMGSNLIKSLAEAGYLDTPRRRHLQTIFLLPEVAATLHRLKKADLIPVLEGRA

SEQ ID NO: 5154 - protein, 201 aa, Escherichia coli
MIKNDKAWIGDLLGGPLMSRESRVIAELLLTDPDEQTWQEQIVGHNILQASSPNTAKRYAATIRLRLNTLDKSAWTLIAEGSERERQQLLFVALMLHSPVVKDFLAEVVNDLRRQFKEKLPGNSWNEFVNSQVRLHPVLASYSDSSIAKMGNNLVKALAEAGYVDTPRRRNLQAVYLLPETQAVLQRLGQQDLISILEGKR

SEQ ID NO: 5155 - protein, 266 aa, Vibrio cholerae; identical to SEQ ID NO: 5058

SEQ ID NO: 5156 - protein, 201 aa, Escherichia coli; identical to SEQ ID NO: 5113

SEQ ID NO: 5157 - protein, 215 aa, Collinsella intestinalis
MHERGPSMSAPTTYRGSITREQWLVDETRTVARLRLEDRAFLDTRALAAHILENNLFQYPTEREVGSIARACARRLDALSSDPDRRDRLTGLIAHGTTEQLRQANLYALMRDNRLVWDFMTCVVESKFSLLDMHLGKTEIATFLEGLRAQDERVATWSPATLNKIRQVLAQCLEQCGMYERKTEQLSTLLLDYDLENLIRENGDAGILPAFGLAL

SEQ ID NO: 5158 - protein, 202 aa, Salmonella enterica; identical to SEQ ID NO: 5033

SEQ ID NO: 5159 - protein, 201 aa, Escherichia coli; identical to SEQ ID NO: 5154

SEQ ID NO: 5160 - protein, 200 aa, Nitratireductor indicus
MMVAAAKYRMSFSVGGLMLNESIVIAQAYQPGENWASARERLLAQGASSLPKLASQTRALREVYDRIGHLSDAERHYLSVEADRAEQQAMMWLAVCRTYPFVHEFAVEVIGERYQSWRLDLGHEVFDRFLADKAESDPSLAELSSSTCAKLRQVLFRILREAGLRNTEGRIQPIWLSGRMKRLIEENNPADLRVFPGNGG

SEQ ID NO: 5161 - protein, 201 aa, Escherichia coli; identical to SEQ ID NO: 5154

SEQ ID NO: 5162 - protein, 203 aa, Acinetobacter baumannii
MLEQFHYDSDLIGGSLMVRESRLIADLLLREATPEQWHQAIQVDNILQKRTPASAQRNATAIRKRLERLEPDFWKALRDGDDELATQVAFCGALERNLLLLEFMETVMREAYISQAQYLDSYIWSDFLDERSQRDLDICDWKESSKKKMGQVVFRMLAEAGYLKSTRKLELQRVIVRAELRSLLEEHYKQRIKRSMEVSLWTR

SEQ ID NO: 5163 - protein, 201 aa, Escherichia coli; identical to SEQ ID NO: 5154

SEQ ID NO: 5164 - protein, 199 aa, Enterococcus faecium; identical to SEQ ID NO: 5151

SEQ ID NO: 5165 - protein, 194 aa, Alcanivorax sp.
MLANFTKASLIVPETQAIARLLLEHPDVERWRQAIEAENVLQAKTVNTAKSYATIARMRLETMDETLWEIVANAERPTATQAILACALKFSPLLAEFMRTALSDEYRRMSPGLEDRIWRSFFADMTLVHANLAEVSEGTQAKLRQNAYRILTEAGYLAKNKTKSLQYVRVLPEVRHYLATHGHNDILSAMDCAH

SEQ ID NO: 5166 - protein, 266 aa, Vibrio cholerae; identical to SEQ ID NO: 5058

SEQ ID NO: 5167 - protein, 259 aa, Vibrio cholerae
MSVQDYNTAIKDIAGLKDYTLVFNIISAYFCEPNLTDSKITDENEFDIRTSKTRNKVSWAINKAILKFINQDHELLIKKIYLSDAPLIDKKFCFLWHLCLNNRLFREVTTQVFSKVYFTGRAQISQDDIIAFLKDKMSSEGPDFPQWSEDTLYRVATKYLSLMTKFDFVTVGRGKSFNHIRPTPEALVLFVYFSNLFSPEIKSIFEHELLPASFIAKEDIQDRFKKLSMKGFFDMSFNGVALNVELTHTYKDICDALYS

SEQ ID NO: 5168 - protein, 199 aa, Escherichia coli
MNIKEYLGDLIGGSLLITESRIIAESLLKKLPEDEWKSLIVEQNVLQKKSGQTAIRYARTIRWRIEGLGDEFMTDLLAASERAYVQMLMMSLLIHSPVVAYFMRLTLAEARRTYKPSLTADAWSEFYDTRVRAYAELGGFSDSTVKKMGNNAIKALVDSGYLSDSRTKKIQPVYLMPEVKDWLVRLGREDLIEVMECTI

SEQ ID NO: 5169 - protein, 245 aa, Bifidobacterium bifidum
MAGSYGAETTQGERYRLSFTVGGLLAPQGRALAEMYLNRMGDGSTERSSQAKVSEKISEKANEKSDKNAGEEVGESIAAIRQQAIEENVLAIRTDSANRRVVAETTRRLSALTVGELAYLAGPYSSISDREALMWIAMCRYYAIVGEFAGEVLKKHYLTGNTHLDFEDYDRFITDKATWHPELENISEGTAKKLRSNLFKAMREAHLFDNNSDTVLSFLPSPSLADILRKRADSFGYLPMRESSL

SEQ ID NO: 5170 - protein, 202 aa, Salmonella enterica; identical to SEQ ID NO: 5033

SEQ ID NO: 5171 - protein, 199 aa, Vibrio cholerae; identical to SEQ ID NO: 5057

SEQ ID NO: 5172 - protein, 204 aa, gamma proteobacterium
MTENFRYDSDLTGGSLMVRESRVIADLLLSQAEPETWDHAIRVENRLQKPTAASAKRNAQAIRKRLERLEPEFWRAIRDGDEELATQASYCASLERNLLLVEFVESVVKDAYVTRADKLAFYLWEEFLDHQANRAPEILDWKASTRKKMGQVAFRILAEAHYLKNTRDTALQHVLVRPEIRIMLEDSYRHRILQCLDVSARRAQ

SEQ ID NO: 5173 - protein, 261 aa, Pseudomonas psychrotolerans
MSAVRFYTTQLQAGLGLIDETRLLLGLYEQGMSTSELSDKALASGLFPLVSARRLHNIVSECFAPRFLRTAGTAGALKRLAVSLTRQEFSQLLFLHTARANLILEDFVREQYWQHYSAGRDSLTLDEAREFVLTGVRKGKAQKSWSDTTIKRISSYLMGCCADYQLLSSNSRGPRRILPFRILPRVAAYLAYDLKFQSLGDNQIVGHSDWQLFGLEREDVREELKRLSLQGFLIMQSAADVTHISWTHKYMDEVIDVLSQG

SEQ ID NO: 5174 - protein, 198 aa, Acetivibrio cellulolyticus
MDNKTYSANLTGAWFLFYEIKQIAKLIEAGLPVEDIKKKVFEENLFQHKTKSSIIRAYPSVLRRAKLLSTGLRKLLIESSVEDGKLINLYAISEDDLLFNEFLLEILKDKYESNHLLLEKRDVNMYFTHKAEQNEKVAAFTDATVNKLRQVYLRILTEVGILANPKSGELNRIFVEAGIRDAIVKNGGSSFVKIFESK

SEQ ID NO: 5175 - protein, 198 aa, Fusobacterium sp.
MLMKYRAITGENFYVQELKNACQFLLQHPEVENRKQAFQELDILNCISESNFNKKFQAIQKRLQVFTPKLMELFLKVDYSTVKFINLYAILSKERFFAEFMDEVLKEKYSLLDFELTNYDFYEFMERKREQSEIIQQWSNAGCNKMIHKLKNFLIEANFLEKSLSGELYLIKRPLVDMAVIEEIEKHGNVKILRLMLY

SEQ ID NO: 5176 - protein, 266 aa, Vibrio cholerae; identical to SEQ ID NO: 5058

SEQ ID NO: 5177 - protein, 202 aa, Salmonella enterica; identical to SEQ ID NO: 5033

SEQ ID NO: 5178 - protein, 266 aa, Vibrio cholerae; identical to SEQ ID NO: 5058

SEQ ID NO: 5179 - protein, 194 aa, Fusobacterium nucleatum
MEYRAITAENFYLIEMRNTCKFILENKVEEDLKKMLKVNNILETVSESNFSKKFNTINKRLKFLTDNLKKQIVNTDLTSARFINLYSILCNERFILEFLEEVVKEKYDNYDYSIKESDFLSYLATKSEQSEIINNWTAEGKRKMLVKIKNFLTEGGFLEKNKDSYKIIKPIVDLAVIDEIKENGNKKILKIMFY

SEQ ID NO: 5180 - protein, 194 aa, Fusobacterium sp.
MEYRAITAENFYLIEMRNTCKFILENKVEEDLKKMLKANNILEAVSESNFSKKFNTINKRLKSLTDNLKKQIVDTDLTSAKFINLYSILCNERFILEFLEEVVKEKYDNFDYSIKESDFSNYMETKSEQSKVIQNWTAEGKRRMLIKVKNFLTEGGYLEKDKDGYKIIKPIVDLAVIDEIKENGNKKILKIMFY

SEQ ID NO: 5181 - protein, 212 aa, Acinetobacter lwoffii
MIRPHRRLAMLEQFHYDSDLIGGSLMVRESRLIADLLLREAIPEQWHQAIQIDNILQKRTPASAQRNATAIRKRLERLEPDFWKALRDGDDELATQVAFCGALERNLLLLEFMETVMRDAYISQAQHLDSYIWSDFLDERSQRDPDICDWKESSKKKMGQVVFRMLAEAGYLKSTRKLELQRVIVRAELRSLLEEHYKQRIKRSMEVSVWTR

SEQ ID NO: 5182 - protein, 199 aa, Lactobacillus casei
MKKFSATFISRTFWFPEFSAVISMLNNGKDWDDIAEAIIDDNIFKMSSTNRSTELKRELMFRISALPASFSELFEQLPLNNQKLMNLIAIMNAHPLVEDFVLEVVKKEFLTGDLKLEPYEISAYLQDLPLQHPETAHWTQQTLKKIQTRFHEILTQSGLAEDAGGAMQLKRALLEASLVAWLEQNGKSDYILALTGRAL

SEQ ID NO: 5183 - protein, 201 aa, Escherichia coli; identical to SEQ ID NO: 5154

SEQ ID NO: 5184 - protein, 203 aa, Acinetobacter sp.
MLEQFYYDSDLIGGSLMVRESRLIADLLLREATPEQWHQAIQIDNILQKRTPASAQRNATAIRKRLERLEPDFWKALRDGDDELATQVAFCGALERNLLLLEFMETVMREAYISQAQYLDSYIWSDFLDERSQRDLDICDWKESSKKKMGQVVFRILAEAGYLKNTRKLELQRVIVRAELRSLLEEHYKQRIKRSMEVSLWTR

SEQ ID NO: 5185 - protein, 266 aa, Vibrio cholerae; identical to SEQ ID NO: 5058

SEQ ID NO: 5186 - protein, 209 aa, Holdemania filiformis
MTQKSKAALQSASPYNAAITREQYLFYEVRTTAKLLTEGLSADEVAERIVSENLFQYPTEKSVRKMALACLRRLDALQDETLVQAIATQSSDVAKQICLYAMMKQYRLVWDFMVTVIGEKYRLKDTSFGKIDLNVFFMRLQEQDDYVATWSDSTVTKLKQVLQKTLVDNEYIDSTKAEHLNPVLISPVLENAIRSNNDDAALVAFNCFM

SEQ ID NO: 5187 - protein, 199 aa, Enterococcus faecium
MNKKYSAGLVSKRFWFSEFKLYIQLRLEGYTDIEIKEKNEHENIFLAVSSNRQKEIYQNVKRRVSQLDEAGLQLFNQLNIDNQKLVNLISILMIDDLFSEFMTEVYAENLRKGNLQLTPVDYRSFFTEKRRSSEDISKWKDYTIKRLIAAYQTNLIETGLVRGEKEYGRMTPILLDKRLIQWLVDKNRKDIVLALGGIL

SEQ ID NO: 5188 - protein, 194 aa, Fusobacterium sp.
MEYRAITAENFYLIEMRNTCKFILENKTEEDLKNLLKANNILETVSESNFSKKFNTINKRLKSLTDNLKKQIVDTDLASVRFINLYSILCNERFILEFLEEVVKEKYDNYDYYIKESDFSNYMETKSEQSKVIESWTVEGKKKMLVKVKNFLTEGGYLEKNKAGYKIIKPIIDLAVIDEIKENGNKKILKIMFY

SEQ ID NO: 5189 - protein, 198 aa, Clostridium butyricum
MEYKSTIKSRPYLYKETKKASSLINKGLDVDCIKEKSLEDNIFQLESEARKKEVASIIVARLKDLDKNIIDKIENSNVETSKVLVLYAIVKTDRLFFEFINEVYKEKILLKDLYIRDKDFGVFFQNKREQSEKVASWTEYTFKKLKQVYIRILFESGLISNQKGDKEIKVPIIDNDVKEYLYKIGDRIYINAILGIVE

SEQ ID NO: 5190 - protein, 203 aa, Acinetobacter baumannii
MLEQFHYDSDLIGGSLMVRESRLIADLLLREATTEQWHQAIQVDNILQKRTAASAQRNATAIRKRLERLEPDFWKAVRDGDDELATQVAFCGALERNLLLLEFMETVMREAYISQAQYLDSYIWSDFLEERTQRDLDICEWKESSKKKMGQVVFRMLTEAGYLKSTRKLELQRVIVRAELRSLLEKHYKQRIKRSMEVSVWTR

SEQ ID NO: 5191 - protein, 202 aa, Cellvibrio sp.
MADFSYNSDLNGGSLMVRESRVVADLLLNNATASEWHQAIQIDNLLQKRSPATAKRNAQAIRKRLELIAPEFWRALRDGDDQLATQVAFYAALERNLLLVEFIESVVRDAYITQANQLASYQWLEFLEDRTHKDESISTWQDATKKKMGQVVFRMLIEAGYMQNNRNLQLQKVLLRPEMKVMLEDSYKQRIIDCMEVSLRTG

SEQ ID NO: 5192 - protein, 185 aa, Faecalibacterium prausnitzii
MEFRKTVQLLSEGKSFADIKKLNEETNIYGAPTKLRAQQIYSTVTARIKTLDESFYPIFLSSDLATQKLFVLTAALLHDTLFFDFVYEVVREKMILGSDELTDADIRIFFKNKQEQSEKVASLQDYTLRRLGSCYKTQLYEAGLLESNRANSTRKILKPILDIAFEHWLYDHDLGIMVKTLTGVR

SEQ ID NO: 5193 - protein, 209 aa, Fulvimarina pelagi
MINSRIRMAGSVNAPIYKADIAGGALMLPESRRIARLLIDGIDGDEWRRKIERENILQKRSPSTAKRQANLIRSRLDLVDPGVWNIIADSPASIASQAVFAAAIQHSALFADFLPIVRDRFRVLQGDLPRRAWIDYVDRCHDIDPRMPHWKVSTVDKLGDAAFRMLHEVGFLTGGRLNILRPVEIDAAVIRALKAGRHHLALDRIQVSL

SEQ ID NO: 5194 - protein, 201 aa, Escherichia coli; identical to SEQ ID NO: 4994

SEQ ID NO: 5195 - protein, 258 aa, delta proteobacterium
MMYKSNQLYNTRIQKGGALLEDMRMIVRSWEEFEGIGATSDIRRLLGKKTLARSRDTLVRTFVPRFIHGDPPNAWKIVRLLENRSVALEILRPVYYWITARSDRLLYEFVTEELIHVARSGDGSVRIEETATWISSHIKKAGQEWTPTVTLKVGRGMLAALRDFGILEGGSKKRIAPVHLPMEAFCYIAFWLERLGYGGGSLINHSDWGLFLLNPPLVERLMLEAHQLSLVGFHSAGRIYRVDFPTDDPGDYANVLFG

SEQ ID NO: 5196 - protein, 199 aa, Lactobacillus johnsonii
MPRTYNGGIASYAIWLPEFAQFIELYQSGKSIDEIKHLSDKENIFKMSSKSRARRCSRNLSVRIDALPKTIIDIFPSLNPTNQKIVSLISMMLTSKILNEFVYDVYRPKVIMREDTLQDYEIESFLNQKRIESPEVAKWSLNTFKRLKGALKTFLRDGGLLENVKSNEDKLLFPLIDSQLITIMKEEKLDYELAALGEI

SEQ ID NO: 5197 - protein, 200 aa, Thiothrix nivea
MINAKEYMGDLIGGGLLMAESRIVAETLLKDLPEEDWKCLFEVENILQKPSRHSSIRYARAIRRRLTPLGKEFIQALLKAPEAEYVQMLLLAVLIHSPVLADFMRLVVAEHKRLYKLVLPTGSWDFFIAERIQLMPDLDSFSVSTLNKIGTNAVRVLVESGYLNSNRQREFQPVYLLPEVRQWLLILNHPELEDAMECTT

SEQ ID NO: 5198 - protein, 201 aa, Escherichia coli; identical to SEQ ID NO: 5113

SEQ ID NO: 5199 - protein, 206 aa, Brevibacterium mcbrellneri
MSIRSQGHDRYALSFTSGALLAREAVIVAPLFLEVRDWGLVRDQLRSENLLQARTASSGFRLAREVAQRLAVLTDPELELLRDASPSERGHLMWVAACRRYALIGDFAEEVVRERFLLLTPTLGYDDFDSFVRGKALWHPELAEVKDSTLQKLRSTVFRMLTEAGLLAGGEIVNAALSERVREALDAQLPSDLRYLPARDSKEASL

SEQ ID NO: 5200 - protein, 201 aa, Escherichia coli; identical to SEQ ID NO: 4994

SEQ ID NO: 5201 - protein, 197 aa, Geobacillus thermoglucosidans
MLNYSAGFTSEGWFQNEMFIVLQMKLDGLTRKEIIEKIIENNLFQMRSEAGIRKRFQMVYRRSEAFDTSLAKYYVEGNRLDQKALLLYSYLKTYRFPYDFFMEVIVYNYQKNKPIIQTVEIDYFMERKESESEKVANWRPETKKRLRSSIIMFFREGGLLREMEQDTYEITPLHMSTTLKEYAKQHDKLLSLLSNLK

SEQ ID NO: 5202 - protein, 266 aa, Vibrio cholerae; identical to SEQ ID NO: 5058

SEQ ID NO: 5203 - protein, 199 aa, Enterococcus faecium; identical to SEQ ID NO: 5151

SEQ ID NO: 5204 - protein, 199 aa, Enterococcus faecium; identical to SEQ ID NO: 5151

SEQ ID NO: 5205 - protein, 199 aa, Vibrio cholerae; identical to SEQ ID NO: 5057

SEQ ID NO: 5206 - protein, 198 aa, Sporosarcina newyorkensis
MTIDLEYSSSLNGASYLLFELKQVIKLKRMGLTSSEIRAKVIEENLFQFENKGRINRALPSVMRRAEVIDKSLADLLLEGSIEMAKVINLYAIMKTDLLFFEFMNEVIGEKLHNNDLLIEKKDINVFFTTKAEQSEKVASWSAVNTEKLKRAFMQVLFESGLLKKRRGEELSRLIVDEQIKDHLIRIGDAKYVQAMGE

SEQ ID NO: 5207 - protein, 266 aa, Vibrio cholerae; identical to SEQ ID NO: 5058

SEQ ID NO: 5208 - protein, 259 aa, Vibrio cholerae; identical to SEQ ID NO: 5167

SEQ ID NO: 5209 - protein, 259 aa, Vibrio cholerae; identical to SEQ ID NO: 5167

SEQ ID NO: 5210 - protein, 266 aa, Vibrio cholerae; identical to SEQ ID NO: 5058

SEQ ID NO: 5211 - protein, 208 aa, Desulfotomaculum gibsoniae
MENIGEGDMTRKEYSAGAVKRSFWFAEFRKVVNLLNSGKTLNEIKTLNLEENIFSAPTQARAIQIFNAVSSRVKNIDKSFYQLFERCDIANQKIIVLTAVMQSDSLFFDFIYEVYREKLIIGDNELTDRDFSIFFKNKQLQSEKVASWTDYTLKRLSTCYKTMLMEAGIINRAIGNRKILKPILDKSLENCLLANRMEITLHALTGVR

SEQ ID NO: 5212 - protein, 266 aa, Vibrio cholerae; identical to SEQ ID NO: 5058

SEQ ID NO: 5213 - protein, 198 aa, Vibrio shilonii
MSEHKRYLGDLIGGSLMLRESQIIADLLLTEPTLEDWNKAIVEENILQKPSAASAKRNAATIKKRLESLNNEYLQKLAYSGTEEATQLMFAATLINAPILADFMRIVVTDAKRMYREALNVDDWQHFWQERGRLYPGLLEMSEASTYKISQVAFKVLADAGYIDSTKHKKLMNIFVSPDVRSLLSEMDRDDIVRAMEP

SEQ ID NO: 5214 - protein, 202 aa, Brachybacterium paraconglomeratum
MNSDSAVAPRYALSFTTGGLLERESAVLAPVYIEHRDWRKVRDIAVEENLLQTRTRSTGVRRVRETVKRMSALFDLEIEIFSDITATERGHLMWVAACRRYELIGEFAEEVLRERFLTLAGTVSYADYDSFYRAKAMWHDELGAVSDLSYKKLRQMLFKMMVEAGLLTAQGAIEPVLLSARVADCLNQRTPSDIRFFPTRVV

SEQ ID NO: 5215 - protein, 202 aa, Salmonella enterica; identical to SEQ ID NO: 5033

SEQ ID NO: 5216 - protein, 196 aa, Eubacterium cellulosolvens
MEYNASATKHLFWFVETRETARLLGNHSMDEVRQIVIDVNLYQQKSNSRLIDEFGCIRKRLEALPEELQRMMVTADINTGKLIAFVGCMAADKLLFDLMYDVYRRKLYFGELTLTDADLTVFFKDKQDQNEQVAAITDTSVKKLKQVYSKYMFEAGLLTGKISDKQLSKPYIDPDLRFALQRNSMDKYLAALTGEK

SEQ ID NO: 5217 - protein, 211 aa, Pseudoalteromonas luteoviolacea
MTSTNNPLNKHAIKTHKDYLGDLIGGSLMIKESQIVAELLLKKPSQEEWLDAIVNRNILQKRSDASAKRNAATIKKRIEDLPDEYLEQVAFGSTELSTQLMFAATLINSTLLADFMRNVVLDAKRMFRESLDVGDWESYWEDRCRLFPELANMSDASTYKISQVAFKVIADGGYIETTRSKKLQNVYLLPEVRQLLLSIDREDIIAAMELI

SEQ ID NO: 5218 - protein, 197 aa, Clostridium perfringens
MEYKSTIKSRPYLYKETKKAVSLINKGLDVDGIKGKSLEDNIFQLESEARKKEVASIITSRIKGLDPYILDKIENSNIETSKILVLYAIAKTDRLFFEFLNEVYKEKIVLKDFYIRDKDFSVFFQSKKEQSEKVDSWSEYTFKKLKQVYIRILFESGLIGNQKGDREIVVPIIDSDVKEYLYEIGSKPYADAILGID

SEQ ID NO: 5219 - protein, 199 aa, Vibrio cholerae; identical to SEQ ID NO: 5057

SEQ ID NO: 5220 - protein, 201 aa, Escherichia coli; identical to SEQ ID NO: 4994

SEQ ID NO: 5221 - protein, 266 aa, Vibrio cholerae; identical to SEQ ID NO: 5058

SEQ ID NO: 5222 - protein, 97 aa, Vibrio cholerae
MTKFDFVTVGRGKSFNHIRPTPEALVLFVYFSNLFSPEIKSIFEHELLPASFIAKEDIQDRFKKLSMKGFFDMSFNGVALNVELTHTYKDICDALYS

SEQ ID NO: 5223 - protein, 195 aa, Fusobacterium ulcerans
MEYRAITGENFYFTEMKNAGKFLVENQITENLKEIFKERDILDCISKNNFNRKFQTVNKRLNSLTSILKYYLVNSDTNTTKFIIFYSILCNERIVAEFMDEVIREKYNNYDYYLKDSEFIKFLENKAEQSEIIENWSDPTKKKIILKLKNFLTESGFIKKEKEKLYKILKPLIISEVIDEIKENGSKSILKIMLY

SEQ ID NO: 5224 - protein, 213 aa, Roseobacter sp.
MTMAARQAEFGVKQPYKMSFTSGGLFLNECIDLAASYLETRDWDVTISQLQADGLTSSPKQKSKRRILRELVNRIETLTEDELRFLVERADRQDQALLIWLSFCRAYRLVREFTLEIVQDRYLAYQLDLSTDSFDLFFEHKAEWDDTLASTSASTRVRLRQVVFKTMREVGIISEENRIQSSYLSPQLRALIEATNPADLAVFPGVVIEGGLS

SEQ ID NO: 5225 - protein, 201 aa, Escherichia coli; identical to SEQ ID NO: 4994

SEQ ID NO: 5226 - protein, 199 aa, Paenibacillus elgii
MSQELEYSANLTGASFLLYEFKQVVSLKEQGLEDSDIKVRVLTENLFQYQVKASLKRSLPTVLRRVKVLDDTLRKMVLEESLDTCKIINLYAIMKTDRLFFEFMNEVIREKLETDNYMFEKKDLNVFIASKAEQDAGVASWMEQTVNKLKQVFVKVLYESGLLKDKKTGELSRLLMDEQLEQHLIQIGDIAYLRAMGEV

SEQ ID NO: 5227 - protein, 201 aa, Escherichia coli; identical to SEQ ID NO: 4994

SEQ ID NO: 5228 - protein, 203 aa, Pseudomonas mandelii
MAEHYRLSFTTGGLFLREAPLVVERYLTLRDWKQTREQVRGENLLQVRTAAAATRISKELIARLELLDPEELEFLVDGSLREQGYLLWAATCRRYAFIHDFAREVLREHYLLMRRQLTTSDYDAFCNAKALWHAELDELAASTQSKLRQNLFRMLRDADLISAQHQIQPVLITPALAHLLARHDNEQLLIFPATDHELKRWLQ

SEQ ID NO: 5229 - protein, 199 aa, Vibrio cholerae; identical to SEQ ID NO: 5103

SEQ ID NO: 5230 - protein, 266 aa, Vibrio cholerae; identical to SEQ ID NO: 5058

SEQ ID NO: 5231 - protein, 266 aa, Vibrio cholerae; identical to SEQ ID NO: 5058

SEQ ID NO: 5232 - protein, 198 aa, Geobacillus sp.
MLDYSAGFTSEGWFQNEMYIVLQLKKSGLSRKEILNDIIEKNSFQMRSESGIRKRFQMVYRRSETFNDELIQFYLMGSRHDQKALLLYSYLRCYRIPYEFYLEVIKYNYLNNKPLIQTVEIDYFIERKETESESVANWRPDTKKRLRSSILLFFRESGMLQKKDSVTYEISPIHMSTKLKEYAKEYDKLLYSFSELSR

SEQ ID NO: 5233 - protein, 205 aa, Escherichia coli
MTNTMTKNDKRWIGDLLGGSLMVRESRTIAELLLSEPDETTWQQQIINENILQASSTSTANRYARTLRLRLMTLDRECWQLIADGSESERLQMLLVALMIQSPVVATFIAEVVNPARQQFKEKLGINCWSEFVDENLRLHPELAAFSDSSIQKMGNNLIKALAEAGYLDSPRRRNLQNVFLLPVVAAALHRLNKAELLPILEGNA

SEQ ID NO: 5234 - protein, 202 aa, Salmonella enterica; identical to SEQ ID NO: 5033

SEQ ID NO: 5235 - protein, 215 aa, Collinsella stercoris
MHERGPPMSAPITYRGSITREQWLVDETRTVARLRLEDPALLDTRVLAAHILENNLFQYPTEREVGSIARACARRLDALSSDPDRRDRLTHLIARGTTEQLRQANLYALMCDNRLVWDFMTCAVAGKFSMLDMRLGKAEIAAFLEGLRAQDERVATWSPATLNKIRQVLAQCLEQCGMYDRKTEQLSTLLLDYDLENLIRENGDAGILPAFGLTR

SEQ ID NO: 5236 - protein, 181 aa, Glaciecola punicea
MIHENLIIAEEYNKFKDWTLVRDEVLGNNLLQARTESTLKTFYGEVSKRLKNLTDDELALMTESDADVKHLVWLAICRQYLFTYQFAVEILSEYFDKSRFQLYSEDYDAFLNAKAEWHKNLDSITTNSRYKSQQTMFKTLVECGLITKSKEILHQHLSPKLQGLIMQTNADDLRIFPRVFS

SEQ ID NO: 5237 - protein, 200 aa, Enterococcus faecalis; identical to SEQ ID NO: 5132

SEQ ID NO: 5238 - protein, 193 aa, Pseudoalteromonas flavipulchra
MSDKLSLTLRPAMIHENLIIAEEYNKFKDWTQVRDEVISGNLLQSRTDSTLKTIYGEVSKRLKNLTDEELALMIESDADVKHLVWLAICRQYLFTYQFAVEVLSEYYDRSRYQLYSEDYDAFLNAKAEWHSNLDNITQKSRYKSQQIMFKMLVECGLITKEKEILNQQLSPKLRELISKKNIDDLRLFPGEYV

SEQ ID NO: 5239 - protein, 201 aa, Escherichia coli
MIKNDKAWIGDLLGGPLMSRESRVIAELLLTDPDEQTWQEQIVGHNILQASSPNTAKRYAATIRLRLNTLDKSAWTLIAEGSERERQQLLFVALTLHSPVVKDFLAEVVNDLRRQFKEKLPGNSWNEFVNSQVRQRPVLASYSDSSIAKMGNNLVKALAEAGYVDTPRRRNLQAVYLLPETQAVLQRLGQQDLISILEGKR

SEQ ID NO: 5240 - protein, 222 aa, Johnsonella ignava
MVESKAANTLKQNPEMERTKMKRKPYSAGAVKFLFWFMEFRKTVQLLSESKSFADIKKLNEETNIYGAPTKLRARQIYSTVTARIKTLDESFYPIFLSSDLATQKLFVLTAALLHDTLFFDFVYEVVREKMILGSDELTDADIRIFFKNKQEQSEKVASFQDYTLRRLGSCYKTQLYEAGLLESNRTNGTRKILKPILDIAFEHWLYDHDLGIMVKTLTGVR

SEQ ID NO: 5241 - protein, 259 aa, Vibrio cholerae; identical to SEQ ID NO: 5167

SEQ ID NO: 5242 - protein, 266 aa, Vibrio cholerae; identical to SEQ ID NO: 5058

SEQ ID NO: 5243 - protein, 202 aa, Enterobacter sp.
MTVKNDKAWIGDLLGGPLMSRESRIIAELMLTAPDEQTWQEQIVGHNILQASSANTAKRYATTIKLRLNTLDKAAWSLIAEGSERERQQLLFVALVLHSPVVKDFLAEVVNDLRRQFKEKLPIDSWDEFVTSHLRQQPVLTSYSDSSIKKMGNNLIKALAEAGYLDTPRRRNLQSVFLLPETQATLQRLGQQELGPILEGQR

SEQ ID NO: 5244 - protein, 199 aa, Enterococcus faecium; identical to SEQ ID NO: 5151

SEQ ID NO: 5245 - protein, 259 aa, Vibrio cholerae; identical to SEQ ID NO: 5167

SEQ ID NO: 5246 - protein, 200 aa, Bacillus cereus
MVKEQDYKSTIKSRPLLFLETKKVSSLLYQGLKEFEVKEKAIVENIFQVNTESRKKEIASSVLARLKILDEYLIRGIGHGDIESSKAIVLYAIMKTDRLFFEFMNEVFKEKFVFREAFLTDADFNIFFEHKQQQSEKVASWNDYTLYKLKQVYIRILFEAGYLKNQKGNREIERPLLNVDVVEHIRALGDNIYMDILVGE

SEQ ID NO: 5247 - protein, 202 aa, Salmonella enterica; identical to SEQ ID NO: 5033

SEQ ID NO: 5248 - protein, 266 aa, Vibrio cholerae; identical to SEQ ID NO: 5058

SEQ ID NO: 5249 - protein, 266 aa, Vibrio cholerae; identical to SEQ ID NO: 5058

SEQ ID NO: 5250 - protein, 201 aa, Escherichia coli; identical to SEQ ID NO: 5113

SEQ ID NO: 5251 - protein, 200 aa, Salmonella enterica; identical to SEQ ID NO: 5032

SEQ ID NO: 5252 - protein, 200 aa, Bacillus cereus
MEMKVYSGGFTAEHLYRNEMKIVADLQLKGMSKQAIKDKIFEENLFHCRSEAAMKDIFPRVYRRAEKLNDILRKMLVNGSRSDNNAILLYAFLKHFKFPRDFVLEVIHYNLKRFKNTVTEGNVMTYFEEKGQQYEEVRKWTDQTKHKLKQVILKILVDGELLVKKENEYEIKSIPLSKELREYVEHNPEYSDLLILTLND

SEQ ID NO: 5253 - protein, 199 aa, Lactobacillus rhamnosus
MKKLSAGFISRSVWFTEFSAVISLLNEGKDWDDITKAIVEENSFQMSSRNRAQDLAREMKLRISTLPVGFVDIFDQLSLSNQKLVNLIALMLERPLVEDFVLTVVQKEFLTGDMRLEPYEISAYLQDLPLQHPETAKWTDETLKKIQTKFHEILTYSGLAEDVKGGMALKRALLDPSLIALLKQSGKANYIQALTGRKL

SEQ ID NO: 5254 - protein, 270 aa, Haloarcula japonica
MSNEHLEPEDEDNDDQATSLDPKIAHHSTYIDETKRILQAYTESESYDELERMVVEDNILNKNTDEYRTNILREVTRRHIPSKEDYTETPLMRVLSADVRSDVADWCLYYEFAQDPFIRLITIEFLYPEFQRGTLSIQAEDIVTFIKSIKDDYADLRDRSDSTINEAATKYLTSLRNFGLLEGRQRKEFAVTYIPDETIAYVVYRLFDEEATSASDVIEHDDWKLFLMDESEVQRRIRDISPQYINYEKRGSTERLRMKHETVDKLIDAF

SEQ ID NO: 5255 - protein, 209 aa, Lactobacillus rhamnosus
MLKKTRKEINLKKLSAGFISRSVWFTEFSAVISLLNEGKDWDDITKAIVEENSFQMSSRNRAQDLAREMKLRISTLPVGFVDIFDQLSLSNQKLVNLIALMLERPLVEDFVLTVVQKEFLTGDMRLEPYEISAYLQDLPLQHPETAKWTDETLKKIQTKFHEILTYSGLAEDVKGGMALKRALLDPSLIALLKQSGKANYIQALTGRKL

SEQ ID NO: 5256 - protein, 202 aa, Salmonella enterica; identical to SEQ ID NO: 5033

SEQ ID NO: 5257 - protein, 203 aa, Vibrio tubiashii
MIKQFHYDSDMAGGSLMVRESRIVAGLLMDGVTPEQWDEAIRVENVLQKRTPASAKRNATAIRKRLERLEPEFWRALRDGDDELATQVAFCGALERNLLLVEFMETVLRDAYMSRAEHLDAFVWADFLEDRSHRDPAIGDWKESTKKKMGQVVFRMLAEVGYLKSTRKLELQHVVVRPEVKTMLEEHYKQRIKKCMEVSAWTR

SEQ ID NO: 5258 - protein, 266 aa, Vibrio cholerae; identical to SEQ ID NO: 5058

SEQ ID NO: 5259 - protein, 266 aa, Vibrio cholerae; identical to SEQ ID NO: 5058

SEQ ID NO: 5260 - protein, 200 aa, Salmonella enterica; identical to SEQ ID NO: 5032

SEQ ID NO: 5261 - protein, 201 aa, Escherichia coli; identical to SEQ ID NO: 4994

SEQ ID NO: 5262 - protein, 266 aa, Vibrio cholerae; identical to SEQ ID NO: 5058

SEQ ID NO: 5263 - protein, 266 aa, Vibrio cholerae; identical to SEQ ID NO: 5058

SEQ ID NO: 5264 - protein, 201 aa, Escherichia coli; identical to SEQ ID NO: 5113

SEQ ID NO: 5265 - protein, 199 aa, Enterococcus faecium; identical to SEQ ID NO: 5151

SEQ ID NO: 5266 - protein, 259 aa, Vibrio cholerae; identical to SEQ ID NO: 5167

SEQ ID NO: 5267 - protein, 201 aa, Escherichia coli; identical to SEQ ID NO: 4994

SEQ ID NO: 5268 - protein, 196 aa, Sphingobium indicum
MSFGTGGLFLNESVAIARLYQELGDWTAVKKAAGAKGVIPFRKQSSVTRSVREIANRLEVLKAEEIDLLCHGDYADQLSVLWLALCRGYRFIGEFAVELLSERFLSFRTHITYDDFDAFYAAKAEWEPELEAISTSTREKLRQILFRLMREAGILNQDDHICRALLSPSFMALITQSNPHELRYFPGAELGRQRGA

SEQ ID NO: 5269 - protein, 266 aa, Vibrio cholerae; identical to SEQ ID NO: 5058

SEQ ID NO: 5270 - protein, 266 aa, Vibrio cholerae; identical to SEQ ID NO: 5058

SEQ ID NO: 5271 - protein, 201 aa, Escherichia coli; identical to SEQ ID NO: 5113

SEQ ID NO: 5272 - protein, 266 aa, Vibrio cholerae; identical to SEQ ID NO: 5058

SEQ ID NO: 5273 - protein, 208 aa, Streptomyces sp.
MERTAPASRYALSFTSGALLMCEASIAAPLYLRERDWSKVCAVIEQDNLLQARTVASGRRLAREVTQRLAALTDGEIELLVDATATERGHLLWAAACRRYDLIGEFAEEVVRERFLLLTSTLTYEDFDSFVRGKALWHTELIEVKDSTLRKLRSNVFLMLSEAGLLSDRGHLVQAVLSERVASVLSTRTPSDLRFFPASDHDTGRAER

SEQ ID NO: 5274 - protein, 202 aa, Salmonella enterica; identical to SEQ ID NO: 5033

SEQ ID NO: 5275 - protein, 201 aa, Escherichia coli; identical to SEQ ID NO: 4994

SEQ ID NO: 5276 - protein, 254 aa, Bacteroides xylanisolvens
MRETTYNSNLAKGCGMIEETLTLLSLYDEGMTKATLVDYVHQNNSLSKCTEKRSKDIVNLVFYPRFMKCDSRIPSWLKAIRNRGVMLPQFKQLLMLYCARDNAIMYDYIVSQLNVLRASGNNHIKREDIRQYIDSVVAEGKASWGESICHKQTSYIKAVLMDFDLVDKRNNILPYEIANTTVLYLMHELHFRGFSDMAIWHHEDWVLFGLDKYQVQEKIMNLNLKGGYIAQCSGELLTISWNYQTMEEFINGAI

SEQ ID NO: 5277 - protein, 179 aa, Escherichia coli
MIKNDKAWIGDLLGGPLMSRESRVIAELLLTDPDEQTWQEQIVGHNILQASSPNTAKRYAATIRLRLNTLDKSAWTLIAEGSERERQQLLFVALTLHSPVVKDFLAEVVNDLRRQFKEKLPGNSWNEFVNSQVRQHPVLASYSDSSIAKMGNNLVKALADVNAKIIGRFSPFLMSAIGH

SEQ ID NO: 5278 - protein, 239 aa, Bacteroides sp.
MIEETLTLLSLYDEGMTKATLVDYVHQNNSLSKCTEKRSKDIVNLVFYPRFMKCDSRIPSWLKAIRNRGVMLPQFKQLLMLYCARDNAIMYDYIVSQLNVLRASGNNHIKREDIRQYIDSVVAEGKASWGESICHKQTSYIKAVLMDFDLVDKRNNILPYEIANTTVLYLMHELHFRGFSDMAIWHHEDWVLFGLDKYQVQEKIMNLNLKGGYIAQCSGELLTISWNYQTMEEFINGAI

SEQ ID NO: 5279 - protein, 224 aa, Opitutaceae bacterium
MLMRYSSNFRRSAIRSAVLNENILARSSSSARVKLYQELKGRYILDEETPLFSAFLEEWHSFPDERDRLFLSYILFALNDLTVMVTSIGWLFPFLRQAPSELKTGDLVAYFEHLAQTSYPEIKAWSPSTLCRMARHYLASVRDFGLASGGTRKVTVRPALQPAALRLLLKALLMVKVPSDEIIRHQAFKILGIAPSEIVETLAELNRQRVLRFRMQADVIELFL

SEQ ID NO: 5280 - protein, 266 aa, Glaciecola polaris
MKDLIEKMSVQDYNTAIKDIAGLKDYTLVFNIISAYFCEPNLTDSKITDENEFDIRTSKTRNKVSWAINKAILKFINQDHELLIKKIYLSDAPLIDKKFCFLWHLCLNNRLFREVTTQVFSKVYFTGRAQISQDDIIAFLKDKMSSEGPDFPQWSEDTLYRVATKYLSLMTKFDFVTVGRVKSFNHIRPTPEALVLFVYFSNLFSPEIKSIFEHELLPASFIAKEDIQDRFKKLSMKGFFDMSFNGVALNVELTHTYKDICDALYS

SEQ ID NO: 5281 - protein, 254 aa, Bacteroides coprophilus
MRNPKYTTQLTHGTGMINETLSLLSIYQEGMSKDALIKCVKENDCLSCKTENRLVHIIYDVFFQRFMKVNPNVPLWLKLIRERGLSLKHFTQLLMVYCARENAVFFDAVTQILNSCKNENQHIVERDAFTKYVENLVKEGKAQWSESVQKRNASYVRSCFIDYEMINRKSEILPYEVNDFTILYFMHEQHFAGLSDMAIWEMEEWHLFNLTRHQVLDRIMSLSLKGAYMAQTSGELLTISWNYKSMEEFINATL

SEQ ID NO: 5282 - protein, 212 aa, Bacteroides sp.
MNNKYNSPYSASVTGCGYMLDEMNNILPLLMSSEQDALLKKEIIENKYLMINTENTRKRAVAEFKLRYNSVSPAFWAQYQSFSREAQNVGMFYVMLKSYKLFFDFQLNVILSKWNSIQREVSKNDIIIAINEISANDDFVDSWSDQTKNKVAVTFLSMLKKIGMLDEKTSELHPLQIKDTDWNYYLLQKEQWFLEACLLQPYEIERIKQSIL

SEQ ID NO: 5283 - protein, 201 aa, Escherichia coli; identical to SEQ ID NO: 5113

SEQ ID NO: 5284 - protein, 201 aa, Escherichia coli; identical to SEQ ID NO: 5113

SEQ ID NO: 5285 - protein, 201 aa, Escherichia coli; identical to SEQ ID NO: 5113

SEQ ID NO: 5286 - protein, 266 aa, Thiorhodovibrio sp.
MPGEPVFYTTQLQAGLGMVEETKLLLGLYQPGMNSAQLCEAALRSGQFPLVSARRLRNIVVECFGPRYLKHEVAMYLKPLAEVLPTHQLVPLLLVFTAQANRILADFIRDIYWPSYSAGRSDLNKADATDFVQNAVRDGKTRTPWSESTIRRVSGYLLGCCADFGLLSAGRSATRSIQPVRIQSTTVLFFAYHLRFAGLSDNAVLNHQLWGLFGLEPGDVRDELKRLASNGWWIIQSAAGTTRITWLLPNMEDVTRVIAAPVINQG

SEQ ID NO: 5287 - protein, 266 aa, Vibrio cholerae; identical to SEQ ID NO: 5058

SEQ ID NO: 5288 - protein, 266 aa, Vibrio cholerae; identical to SEQ ID NO: 5058

SEQ ID NO: 5289 - protein, 235 aa, Enterobacter hormaechei
MNGVTIVMASTLHADYNHYLIFCEQHSGFLMTTTMIKNDKRWIGDLLGGALMVRESRIIAKLLLSEPDETTWQQQIIDENILQASSTSTANRYARTVKLRLMTLDRECWQLIADGSESERLQMLLVALMIQSPIVADFMADVVNPARQQFKEKLGINCWSEFVDENLRLHPELGAFSDSSIQKMGNNLIKALAEAGYLDTPRRRNLQTVFLLPDVAAALHRLNKAELLPILEGNA

SEQ ID NO: 5290 - protein, 205 aa, Marinobacter sp.
MASNNRYRISFTSGSLYHRESVLLAGLFHELGDWESVRVEGVKRNLLQTRTESTAKRVCRETVARLKTLSEEELDFLTEGSPHDQAHILWLAVCRLYQFVADFAMEVIRERFLSMKIDLTYEDFDAFFNKKSEWHDELDQASPSTRDKLRQVTFRMLREAELVTKGKTINRVILSPRLVGLIRQNHPDEFLYFPVFESDIKGMSL

SEQ ID NO: 5291 - protein, 201 aa, Escherichia coli; identical to SEQ ID NO: 4994

SEQ ID NO: 5292 - protein, 200 aa, Salmonella enterica
MKNDKAWVGDLLGGPLMSRESRIIAELMLTDPDEQTWQEQIVGHNILQASSANTAKRYATTIRLRLNALDKAAWSLIAQGSERERQQLLFVALVLHSPVVKDFLAEVVNDLRRQFKEKLPMDSWDEFVASHLRQQPVLTSYSDSSIKKMGNNLIKALAEAGYLDTPRRRNLQSVFLLPETQATLQRLGQQELVSILEGQR

SEQ ID NO: 5293 - protein, 199 aa, Lactobacillus casei
MKRISAGAVKFQFWFTEFVQAMGMANDNDDFTVLRQQILAENTFHASSHARLITTTSVVLRRVGSLTPAMRALFDQLDPVNQRIMNLIAIMNTEQLMYAFMYDVFRPELILGDRQIEAYEMAAFFKKLPLTHKEAAHWTEETLRRLQSTVAQYLRRAQIVKDYKDTLVIENYLLDERLADRLREENHLDYLAILTGRTS

SEQ ID NO: 5294 - protein, 199 aa, Enterococcus faecium; identical to SEQ ID NO: 5151

SEQ ID NO: 5295 - protein, 266 aa, Glaciecola lipolytica; identical to SEQ ID NO: 5280

SEQ ID NO: 5296 - protein, 200 aa, Oribacterium sp.
MERKSYSAGAVKMSFWFMEFRKVVSLLAEGKSLDEIKELNKEQNIFGAPTTLRSEQIYSTVAGRVRTLDESFCSVFLESDVASQKLFALVAAMAYDTLFFDFVYEVVREKMIIGSNSFADSDIRIFFKDKQLQDEKVAKWTDATLNRLGRCYKTMLFEAGLTDKGKDERKILKPILDPVMQRWLEDHDMEACVSALIGVR

SEQ ID NO: 5297 - protein, 266 aa, Vibrio cholerae; identical to SEQ ID NO: 5058

SEQ ID NO: 5298 - protein, 201 aa, Escherichia coli; identical to SEQ ID NO: 4994

SEQ ID NO: 5299 - protein, 201 aa, Escherichia coli; identical to SEQ ID NO: 5113

SEQ ID NO: 5300 - protein, 266 aa, Vibrio cholerae
MKDLIEKMSVQDYNTAIKDIAGLKDYTLVFNIISAYFCEPNLTDSKITDENEFDIRTSKTRNKVSWAINKAILKFINQDHELLIKQIYLSDAPLIDKKFCFLWHLCLNNRLFREVTTQVFSKVYFTGRAQISQDDIIAFLKDKMSSEGPDFPQWSEDTLYRVATKYLSLMTKFDFVTVGRVKSFNHIRPTPEALVLFVYFSNLFSPEIKSIFEHELLPASFIAKEDIQDRFKKLSMKGFFDMSFNGVALNVELTHTYKDICDALYS

SEQ ID NO: 5301 - protein, 273 aa, Methanoplanus limicola
MKFINIICYKDNRSIVEQSDFFVKQDYPENFGFYSKSSHTGRTVMLSEFITVMDNAPGFNDKEILKKIFVEDNLLKKESISGRKISFYYLKHLYGLDSENKNFQGLLKYWKEKSPDNKIMALLCALSRDEALRLSSGYILSVKAGDSADKSGLKEIVDNYYQNIYSEKVRESMVRNLMSSWTQAGYLEGRSNKIRIIPEISVYSFAYACYLAYLSGFRGKRIFHSPWVLVLCLSNLEIKEFIKESNRKGLMSVKKAGSVVEITFPEDLIGGTQ

SEQ ID NO: 5302 - protein, 266 aa, Vibrio cholerae; identical to SEQ ID NO: 5058

SEQ ID NO: 5303 - protein, 201 aa, Escherichia coli; identical to SEQ ID NO: 4994

SEQ ID NO: 5304 - protein, 266 aa, Vibrio cholera; identical to SEQ ID NO: 5058

SEQ ID NO: 5305 - protein, 266 aa, Vibrio cholerae; identical to SEQ ID NO: 5058

SEQ ID NO: 5306 - protein, 200 aa, Bacillus cereus
MVKEQVYKSTIKSRPLLFLEMKKVSILLNKGFKEFEVKEKAISENIFQVNTESRKKEIASSVLARLKILDDYLIREIGHGDIESSKAIVLYSIMKTDRLFFEFMNEVFKEKFVFGETFLTDADFNIFFENKQQQSEKVASWNDYTFYKLKQVYIRILFEAGYLKNQKGNREIERPLLNIDVVEHIRALGDGIYMDILVGE

SEQ ID NO: 5307 - protein, 102 aa, Salmonella enterica
MLTDFMATTLSDARQMFRESLRSEDWQEFILSRQRAIVGLDQYSESSIQKMGNNVFKILADSGYLESGRSKKLKNVFLLPQIREWANSLDCQKVYDVMESVR

SEQ ID NO: 5308 - protein, 266 aa, Vibrio cholerae; identical to SEQ ID NO: 5300

SEQ ID NO: 5309 - protein, 205 aa, Collinsella aerofaciens
MRIVAALRMQGASDEQVIVRVKSENLFQYPTERMVANRATVCLRRLDAMVPTDAVCAARGIDPKTAVEAASSLTRLMASGTPTQTDQAIFYSMICRYDIVRELVLVEVGERLQNFDYAFTAVDLNAFMTRFTTEYPDAARWTEATVKCIKGSLRQTLRHAGLIGEGQGPESERLSPLFLDFDVERVLVQLGEQSLIAALTGRAVM

SEQ ID NO: 5310 - protein, 199 aa, Enterococcus faecium; identical to SEQ ID NO: 5151

SEQ ID NO: 5311 - protein, 266 aa, Vibrio cholerae; identical to SEQ ID NO: 5058

SEQ ID NO: 5312 - protein, 208 aa, Bacteroides sp.; identical to SEQ ID NO: 5146

SEQ ID NO: 5313 - protein, 199 aa, Vibrio cholerae
MNIKEYLGDLIGGSLLITESRIIAESLLKKLPEDEWKSLIVEQNVLQKKSGQTAIRYARTIRWRVEGLGDEFMTDLLAASERAYVQMLMMSLLIHSPVVADFMRLTLAEARRTYKPSLTADAWSEFYDTRVRAYAELGGFSDSTVKKMGNNAIKALVDSGYLSDSRTKKIQPVYLMPEVKDWLVRLGREDLIEVMECTI

SEQ ID NO: 5314 - protein, 199 aa, Vibrio cholerae; identical to SEQ ID NO: 5103

SEQ ID NO: 5315 - protein, 259 aa, Vibrio cholerae; identical to SEQ ID NO: 5167

SEQ ID NO: 5316 - protein, 199 aa, Enterococcus faecium; identical to SEQ ID NO: 5151

SEQ ID NO: 5317 - protein, 194 aa, Fusobacterium sp.
MQYRGITSENFYLTEIRNTCRFILENGIQENLKELLKKNNILETFSESNFSKKYNTINKRLKSLTDNLKKQIVDTDLASAKFINLYSILCNERFILEFLEEVVKEKYDNYDYNIKESDFLIYLATKSEQSEIINNWTEAGKRKMLVKIKNFLTEGGFLEKNKDGYNIIKPVVESAVIDEIKENGNRKILKIMFY

SEQ ID NO: 5318 - protein, 266 aa, Vibrio cholerae; identical to SEQ ID NO: 5300

SEQ ID NO: 5319 - protein, 209 aa, Aurantimonas manganoxydans
MHNRPIWIDDSVEAPLYKADIAGGALMLPESRRVARLLIDGVGKEEWRRKIEQENILQKRSPSTAIRQANLIRSRLQSTNSELWQLIVEGPSTVATQALFAAAIEHSPLLADFLPVVRARFRVLHSDLPRRIWIDYVERCHDVDPRMPRWEISTIDKLGDTAFRILHEVGFLTGGRRNLLRPVGIDPSIIKNLKAWHHDRALERIRVSA

SEQ ID NO: 5320 - protein, 206 aa, Sinorhizobium meliloti
MPDLRDQPYLMSFGTGGLYINESAAVAELHDDVGDWDATLGAALERGVFPVRKASSARRSVREIVNRLRCLKPAELTLLIEGQRNEQCALLWLATCRAYRFIREFAIEVLSDRFLTLRTKLTYDDFDTFLSVKEEWSPKLATLSASTRAKLRAVLFRLMRESEILSQDDRILGAMLSPRVLAIIQTENPNELRYFPGAERQGGGKR

SEQ ID NO: 5321 - protein, 200 aa, Sphingobium yanoikuyae
MMVAAAKYRMSFGVGGLMLNESIVIAQAYQPGENWASARERLLAQGASSLPKLASQTRALREVYDRIGHLSDAERHYLSVEADRAEQQAMMWLAVCRTYRFVYEFAVEVISERYQSWRLDLGHEVFDRFLAEKAESDPGLAGLSASTCAKLRQVLFRILREVGLISVEGRIQPIWLSERMKRLIEESNPADLQVFPGNGG

SEQ ID NO: 5322 - protein, 203 aa, Pseudomonas fragi
MHSFHYDSDLIGGSLQVRESRIVADLLLQDASPEQWHEVIQKQNRLQKRAPASAKRVAQAIRKRLERLDAPFWRAIRDGDDELATQVVFCSALERNLLLVEFIETVLKDAFVTRAGVLEPYHWNEFLDERSHRDSTITTWTESSRKKMAQVVYRMLAEVGLLKNTRNMKLQNLMIRSEVRVLLDDSYRYRIKACLEVSNATGQ

SEQ ID NO: 5323 - protein, 201 aa, Lactobacillus helveticus
MSRSYNGGIASYAIWLPELTKFIELYQSGYSINDIKQMSDEENIFQMPTKARAKRCSRNLAVRVKALPESVLNIFSQLDTSNQKIISLLSVMLTSRILDEFIYDVYRPKVQMREDILKSYEVEAFINQKRIESPTIASWSLNTYKRIKGALKTYMRDGGLMKIDPQNKKQDKLLFPLLDSQLVLAMKVAKLDYELAALGGM

SEQ ID NO: 5324 - protein, 266 aa, Vibrio cholerae; identical to SEQ ID NO: 5058

SEQ ID NO: 5325 - protein, 206 aa, Faecalibacterium prausnitzii
MQNTNRAQESGYKASLTREQFLFHEMRIVAKQMVQGEDLASMIQIIAANNLFQYPTERMTAGMVRACYRRLNLLNSEQLLRNIAEHSVEEAKQICLYAIMKDNRLVWDFMVTVIGEKYRNQDFSYGKLDMTSFFIRLQEQNDAIADWSESTVKKLKSVLNRILRENDYLDSIKAGHLNPVWLYPELENVILTNGDQAVLPAFNRFE

SEQ ID NO: 5326 - protein, 203 aa, Acinetobacter sp.
MLEQFHYDSDLIGGSLMVRESRLIADLLLREATPEQWHQAIQIDNILQKRTPASAQRNATAIRKRLERLEPDFWKALRDGDDELATQVAFCGALERNLLLLEFMETVMRDAYISQAQYLDSYIWSDFLDERSQRDPDICEWKESSKKKMGQVVFRMLAEAGYLKSTRKLELQRVIVRAELRSLLEEHYKQRIKRSMEVSLWTR

SEQ ID NO: 5327 - protein, 207 aa, Bacteroides sp.
MKINSPYTAAITGGGFLLNETLALLPLLQSEDREELLKDERLNNRVLMINAETSRKKAILEISRRYDTMSPAFWQDFLVMTAAEQPIALFFVMLKTYKILFDFHVNVTIRRWNSVAKSVKREDILMEFNEISARDAFVDSWSEATKDKVISAYLSILRKIGILDRTNQLQVLDCTNYPYYLQIGESWFLEACLLQPYQIEKIKNSLA

SEQ ID NO: 5328 - protein, 199 aa, Proteus mirabilis
MNIKEYLGDLIGSSLLITESRIIAESLLKKLPEDEWKSLIVEQNVLQKKSGQTAIRYARTIRWRIEGLGDEFMTDLLTASERAYVQMLMMSLLIHSPVVADFMRHTLAEARRTYKPALTADAWSEFYDTRVRAYAELGGFSDSTVKKMGNNAIKALVDSGYLSDSRTKKIQPVYLMPEVKDWLVRLGREDLIEVMECTI

SEQ ID NO: 5329 - protein, 247 aa, Bacteroides sp.
MAINDKQVKYDSGINVLGSIPDYVVMLEFICENIGKKSEPEQVFSFRTHKTFNRFLAAIKASILQFANDNQKKMFLTAISSEDFSVREKLLVLFWQLVYGNALFAKVTKEVFMRAVYQGRTSLSVIDVLSLLHHIKETEEGELNWSEDTLKITASKYLTMLKKLNLAEGKTAKEICYPIITGQLFVYFIRWIIVTYPENRTLENPFVIFGFMDKRSIIERLKKVEYLTLWQISQMGEDVTIDLIDHE

SEQ ID NO: 5330 - protein, 202 aa, Salmonella enterica; identical to SEQ ID NO: 5033

SEQ ID NO: 5331 - protein, 205 aa, Pseudomonas fuscovaginae
MSVKAFSYDSDLIGGSLQVRESRIVADLLLQNVSTEQWYEVIQQENRLQKRTSASAKRVAQALRKRLERMDEAFWRAIRDGDNELATQVVFCSALERNLLLVEFIETVVRDAFVTRTGVLEPYHWSEFLDERTHRDPAITSWTESSRKKMGQVVYRMLAEVGLLESTRSMRLQNLRIRPETRALLDDSYRQRIKACLEVSSAAAQ

SEQ ID NO: 5332 - protein, 200 aa, Lachnospiraceae bacterium
MEKKPYSAGAVKMSFWFMEFRKVVELLAAGKTLEEIKEMNKNENIFGAPTAARANQIFVTVSGRIKTLDKSFVEVFQRSDVAMQKIFVLVSSLAYDSLFFEFVYEVIREKLILGADTLTDSDIRIFFKDKSLQDERVAKWTAATLKRLGAYYKTMLCEAGLLDKGKADRKIIRPVLSPTVEEWLNTHDMEVCVKALNGVR

SEQ ID NO: 5333 - protein, 266 aa, Vibrio cholerae; identical to SEQ ID NO: 5058

SEQ ID NO: 5334 - protein, 202 aa, Roseburia inulinivorans
MERKPYSAGAVKFSFWFMEFRKTVQLLSEGKSFADIKKLNEETNIYGAPTKLRAQQIYSTVTARIKTLDESFYPIFLSSDLATQKLFVLTAALLHDTLFFDFVYEVVREKMILGSDELTDADIRIFFKNKQEQSEKVASLQDYTLRRLGSCYKTQLYEAGLLESNRANSTRKILKPILDIAFEHWLYDHDLGIMVKTLTGVR

SEQ ID NO: 5335 - protein, 202 aa, Salmonella enterica; identical to SEQ ID NO: 5033

SEQ ID NO: 5336 - protein, 184 aa, Acidovorax sp.
MPLESRRIAVLLLTQPDEAAWRHAIEIENILQKNTPATARRQATLIRKRLMTLDAQGWEMIANNGSEVQIQLLLAAAVKHSPLLGDFMRNVYAMRQRKLEPTVDPHDWSDFLAECTLHYPAIANWTDATRAKLFQVIVRVLVEAKYLDNARSLRLTPKSLNPDVRRYLADRHETYALDCLERAQ

SEQ ID NO: 5337 - protein, 200 aa, Oribacterium sp.; identical to SEQ ID NO: 5117

SEQ ID NO: 5338 - protein, 199 aa, Magnetospirillum sp.
MAGPRYKADIGGGSLKIPESRIIAGLLLDGVSDEQWRHAIEVENVLQRRSPGTAKRQSSLIRARLQSMGADLWRLVRDGSTQVATQAVFAAAIKHSALLGDFLDLVVRDQFRMFRTDLPRKMWDQYLEQCRNRDPLMPVWQDSTANKLADCVYRILAEVGYVTDSKTYRLKPVRISGEVMSYLRENDEQYVIRCIQVSI

SEQ ID NO: 5339 - protein, 201 aa, Escherichia coli; identical to SEQ ID NO: 4994

SEQ ID NO: 5340 - protein, 266 aa, Vibrio cholerae; identical to SEQ ID NO: 5058

SEQ ID NO: 5341 - protein, 203 aa, Acinetobacter baumannii
MLEQFHYDSDLIGGSLMVRESRLIADLLLREATTEQWHQAIQVDNILQKRTAASAQRNATAIRKRLERLEPDFWKALRDGDDELATQVAFCGALERNLLLLEFMETVMREAYISQAQYLDSYIWSDFLEERTQRDLDICEWKESSKKKMGQVVFRMLTEAGYLKSTRKLELQRVIVRAELRSLLEEHYKQRIKRSMEVSLWMR

SEQ ID NO: 5342 - protein, 203 aa, Acinetobacter baumannii; identical to SEQ ID NO: 5184

SEQ ID NO: 5343 - protein, 207 aa, Magnetospirillum sp.
MRFDGGAAMADPRYKADIGGGSLKLPESRIIAGLLLDGVTEDQWRHAIEVENVLQRRSPGTAKRQSSLMRNRLETMGPELWQMVRDGSTQVAIQAVFAAAIKHSTLLGDFLDLVVRDQFRMFRPDLPRKMWDQYLEQCRNRDPLMPVWQDSTANKLADCVYRILVEVGYITDSKTYRLKSVRISGEVMSYLRENNEQYVIRCIQVSI

SEQ ID NO: 5344 - protein, 201 aa, Escherichia coli; identical to SEQ ID NO: 4994

SEQ ID NO: 5345 - protein, 266 aa, Vibrio cholerae; identical to SEQ ID NO: 5058

SEQ ID NO: 5346 - protein, 254 aa, Bacteroides sp.; identical to SEQ ID NO: 5276

SEQ ID NO: 5347 - protein, 201 aa, Escherichia coli; identical to SEQ ID NO: 4994

SEQ ID NO: 5348 - protein, 266 aa, Vibrio cholerae; identical to SEQ ID NO: 5300

SEQ ID NO: 5349 - protein, 189 aa, Methylophaga aminisulfidivorans
MAFIGGSLLRQESLDVANLYLQLQDWDLVKEKVIADNILQSKRVSSAKRFTTEIISRLSVLDSEQLEFFVGASIQEQAHTLWLAICRRYDFIAEFAVELLHEHYVYLRGEVSQEDFEAFINKKSEWHPEIDKLTDSSRNKVRQIIFRILKQAEILDKNNQIISVILSGSMREALSINESELLFFPVIGE

SEQ ID NO: 5350 - protein, 201 aa, Escherichia coli; identical to SEQ ID NO: 4994

SEQ ID NO: 5351 - protein, 266 aa, Vibrio cholerae; identical to SEQ ID NO: 5058

SEQ ID NO: 5352 - protein, 196 aa, Photobacterium sp.
MSNSKYKLSLTLRPALIHESRVVAEQYTQLKDWQLVRDEVLTNNLLQARTESTSKTIYGEVSKRLKNLTDDELLLMTTSDLDAKHLVWLAICREYLFTYQFAVEVLCEHFNKSRLHLYPEDYVAFFNAKAEWHSNLDSITQQSRYKAQQTMFKMLAECGLVNEDKEILHQHVSAQLQELIKQTNADFLRIYPGDYS

SEQ ID NO: 5353 - protein, 266 aa, Vibrio cholerae; identical to SEQ ID NO: 5058

SEQ ID NO: 5354 - protein, 194 aa, Fusobacterium sp.; identical to SEQ ID NO: 5188

SEQ ID NO: 5355 - protein, 197 aa, Clostridium perfringens
MEYKSTIKSRPYLYKETKKAISLINKGLDVDGIKGKSLEDNIFQLESEARKKEVASIITSRIKVLDSYILNKIENSNIETSKILVLYAIAKTDRLFFEFLNEVYKEKIVLKDFYIRDKDFSVFFQSKREQSEKVDSWSEYTFKKLKQVYIRILFESGLIGNQKGDREIVVPIIDSDVKEYLYEIGSKPYADAILGID

SEQ ID NO: 5356 - protein, 212 aa, Actinomyces neuii
MSDSGYELGFTSGTLMLAGYREAAELFLEGLPQTQVSKRLFAENLVRIEGGNHRRAMASLTASRLAPLGRPAWQYLASGLQGAEFLMWLSLCLRSRLTADFAREVLRDHALIQASATTDQDFLEFWKQKALWHPHLQGRSDKSINKVRQFVFTQARKAGFLDRHNVPQEVFIPTQVAQIIVAAKSRWGWPMREAFPVPPQQFELLPDDQVGA

SEQ ID NO: 5357 - protein, 199 aa, Enterococcus faecium; identical to SEQ ID NO: 5151

SEQ ID NO: 5358 - protein, 201 aa, Escherichia coli; identical to SEQ ID NO: 5154

SEQ ID NO: 5359 - protein, 266 aa, Vibrio cholerae; identical to SEQ ID NO: 5058

SEQ ID NO: 5360 - protein, 259 aa, Vibrio cholerae; identical to SEQ ID NO: 5167

SEQ ID NO: 5361 - protein, 196 aa, Fusobacterium necrophorum
MKYRAITGENFYVQELKNACQFLLQHPELENKRQAFQERDILNCVSESNFNKKFQTIQKRLQVFTPKLMELFLKVDYTTTKFINLYAILSQERFFAEFMDEVIKEKYFLLDFELTNYDFYEFMERKKEQSEIIQQWSDAGCHKMIHKLKNFLVEANFLEKSPSGELYLIKRPLVDMAVIEEIEKHGNAKILKLMLY

SEQ ID NO: 5362 - protein, 259 aa, Vibrio cholerae; identical to SEQ ID NO: 5167

SEQ ID NO: 5363 - protein, 199 aa, Lactobacillus zeae
MKKLSASIVSQGFWFREFVATASMLNSGKSWNDVDQAIIEDNVFQLSSKNRQNDVRLAMHRRYHELPDDFTKNLDQFTLSNQKLINLVAIMKMSALVEDFVLTVVKTEFVMGDLKLEPYEIGTYMRNLPLMHPEASHWRSVTVKKLKNKLREYLVASGLAEHKEENLVLQRAVLDPQVERLLKQHDMTQYIEALTGRQV

SEQ ID NO: 5364 - protein, 254 aa, Bacteroides ovatus; identical to SEQ ID NO: 5276

SEQ ID NO: 5365 - protein, 165 aa, Escherichia coli
MLGGADNPNGELLSYIIGADKRYAATIRLRLNTLDKSAWTLIAEGSERERQQLLFVALTLHSPVVKDFLAEVVNDLRRQFKEKLPGNSWNEFVNSQVRQHPVLASYSDSSIAKMGNNLVKALAEAGYVDTPRRRNLQAVYLLPETQAVLQRLGQQDLISILEGKR

SEQ ID NO: 5366 - protein, 201 aa, Escherichia coli; identical to SEQ ID NO: 5113

SEQ ID NO: 5367 - protein, 121 aa, Coprobacillus sp.
MNINEPYKATFTREQFLFHEMRTVAQLMVEGKNDNEINEIVFNDNLFQYPTEKSIKRMVRNCLKRLHLLEDMRLVGIIANGSSDSAKQVCLYAMMNQYRVINEFMNSVIGEKYRLKDFFFF

SEQ ID NO: 5368 - protein, 251 aa, Natronorubrum tibetense
MTHCGLQAERTHDIASLYADELDWTSVKEIWYDERVANRSSRNSAEKPLIAIRARLQSAGEGLPSVPVLPTIIDQCRNERDQAQVLFLYLVNHDGLARYVVHEYLRRLMKQGPSALNFETDTVLNILDDFRDKAGEPLEYSESTQKRWVQGLRSALRDIGVLEGKTETMGQPPKVGDVPLQVAAYYSWAQNGDGWLTKPIGWLYLFQSEEYWEPQSKRLAGYEGWTHHEARSRVWFEPIDDFYTMLAEGSA

SEQ ID NO: 5369 - protein, 255 aa, Haloarcula argentinensis
MVLTKCGLLVDRAETLARLYAHHRDWTVVEEKWIEERFDERSTRGSSKGIYRALSSRFKTAGSKLPSIVQLPSILDQCETVRDKAQVLYFYLLEDDPLVKYTVHRYVDRLQESGVDGLGFEQETLERLLSEFHYEDGSEFDYAESTTRRWGEGLRSVLRDIGVLDTQQTLQGQIPNLGSTPLLVASGYSWESQGDDWLSQPTGWLYLFQSDQYWDSLAERVSDDPNWEASGIHGELRLQPVDDTYGWAEPWEGEV

SEQ ID NO: 5370 - protein, 253 aa, Rhodopirellula sp.
MMKCTLEIEPSRSYWHLCASAGGSVSKEKAFEESVFGSKTFLRVERLIADMRHRYDAYPFALEVLGKWRPMELSDRALICHWHTQLADPIYRKFTGDYLVERYYGPAGNVDNDMTSRWIELTVPDRWQIPTRNKIASKMLTSALSAGIIASNRNPRPIHFPRVSDLALCYLMYLLREIQYEGTAISNPYLTSVGLDQDEAVRRIRGIRELGFSKQGDLLQFDWQHDSMMEWARSAGILSEVDNETNNVQRAAT

SEQ ID NO: 5371 - protein, 294 aa, Pseudanabaena biceps
MVSLSKNMDLSMDLSMDLSANYGAEVRSLHTRLMRVPLAIEESYSYWQNCHPNVLNLEVDRDRITNKTDKINQLAEIAFEKRWFGSKSMARTQLLLKEFSQRYDAYPVALLVLQQWQPRDLLTRRNLCHWHLQLVDPLYRAFTDHYLGQRRILSTDITDSNIDRDIVGRWVSQNMGRDHWSPATIARMATGLIAAAASVGLCSDKMGKRNLLYPQVSDRAVEYWLYFLRALTFEGTLLDNPYWRSVGLTGSLLETRLQRLPNLDFRRMGELIDFGWQCADLKDWALRLDRENLE

SEQ ID NO: 5372 - protein, 251 aa, planctomycete KSU-1
MKREVGFSQRIRLEWLEKTAELLAEGKSKKEIESVLYNILSDQLHSDGNTKRGSREKALTILLKIWVSSPESVQPLKEDAITYFRKLPFSDHIILHWGLSIAIYPFFGIMADTVGRLLKLQGSFTPVQVLRRIKEQFGERETVTRAARRVLRCFVDWGVLKDATKKGIYLPVTSHLITDKKLIAWLVEAILISRNSHSGLISVITQSPILFPFTLDQFSQQDLTNNKRLEIFHQGANEVVVVIKTMEVKVN

SEQ ID NO: 5373 - protein, 238 aa, Bacillus cereus
MTKPVGFDQKVLLHHLDFTANHTKKYSRKDMYEVLDGYLRNDITGAKSRKNAVTMLMKIWYLVDKDLIEIRDRVLEVLPVLTKEERVFVHWGMTLAAYPFFKDTVHELGKLFQLQDTVPSTVIGKRMKEEYGDRRRVEVATSAVLMSIKAWGIIIPTKNRLYQLSDKIFISNPLLQVFIVKIMLHVLEHTALQIDILKNHPILFPFDHEIDLFELRQNEGLTLHHQEIDTLIVECKKS

SEQ ID NO: 5374 - protein, 87 aa, Clostridium thermocellum
MKQIGAIENEKVGVYRIKKYPVTDVKTIQVLLLAILHLRERAYYEIAELSSVPQVFPFEFNVSYEWLHDSDLFTLSNFGGKVVLTLD

SEQ ID NO: 5375 - protein, 147 aa, Clostridium thermocellum
MAKMIGLSRSIRLEWLNKTAELVLEGKDYTQIKDELNEYLSFEIKSPTNIRKTREILTNIWVKIPDALSTLKRQALEAYKDDKSNKLALHWSMMLVAYPVFCDVCALIGKLTSIQDTFTHPGLKKSCLKYGGNVLLCSIPSIRYYKP

SEQ ID NO: 5376 - protein, 235 aa, Lachnospiraceae bacterium
MAKMVGLSRNLKLSWLNQTVELVSSNLVENEIKEKLNEYLSFEIGSPTNIRKTREILMYIWHYENEYTEKLRPTALELIKKYPDYALEIHWCMMLAAYPVFMDMCKLIGKMSEFQDEITLAQLKQKLFDEWGERTTLYHSIDKLISTLKEFGVLACDKPGKYHINRHKVAKDEINSFMVYTIINVDGSGYYLFQEVNASSYLFPFECTVSKEMLLQDERFTMNNFGGSLSVALKN

SEQ ID NO: 5377 - protein, 235 aa, Caloramator australicus
MKLVGFLKPVKLEWLNLTVEELKKGNDSENIRQFLKDYISNFYQSKDTIRKAAAILMNAWVDVEYKNIRDFALDLYDNVKEEEKIALHYGLMMIAFPIFNDIVSLIGKALYLDERFKLENIKNKIYEKWGERQTLKYSIDRIIMSLKEWGLIENEKIGIYKSGKKIIIENAQVKAFLIACYLIAQNRDYIDIVEAENLYSFFPFLYNLNLTELNNIDILSKNNIGSNIVIGVKDL

SEQ ID NO: 5378 - protein, 235 aa, Pseudoalteromonas marina
MKVSIGFNRHLESNWLAQTASWVANGIEGKELKDKIDTLLTPDFTSQVAKDKTRNLLFGIWSKLPKHIPNDFQRDAANLLMEYSELNLVFHWGMMLAKYPFFKSVVEQIGRLTKLNDSFLYSQLEQRITENYGDTSTIKRSMQFVVRTLMNLELLANPKQGIYQLRKPIQVNNPSIKAWLIEASVYSEQVTSRSLTAINDENVWFPFELYFDENDLSQNDRLEAHHQAADVIVFV

SEQ ID NO: 5379 - protein, 236 aa, Pseudoalteromonas marina
MSKRVNYSRHIEAHWLDQTALWVAEGLNKQELHDKINSMLSPLINCKVNLGKTRNQLTSLWFDKNENVSSEFSAFAVDYVKESHDIPLVIHWGLLIAKKKFFADVARFIGRNSKFNDSFTYAQVQKRMVELYGDTETVKRGLRSVLKTMVDFGVLLRSNSRSYQVNQNNLAVPKKLMNWLLCALLFSEDVISRTLSDIIDDAIWFPFEISIEPEDIDKQWFEVHQQGYELMLFRKK

SEQ ID NO: 5380 - protein, 242 aa, Desulfotomaculum nigrificans
MVKPVGFDQKIKIHHLDYIAREFNNTERKVMYEKLDEYLSGDIRGAKARKNAITILMKIWFLVPDAIKNLRQRALELWPTLDHRERRVLHYGMTLLAYPFFKDVAAEMGNLFGLQNEVPSVQIGRKMKGLYGDRRRVEVATKAVLMSLKAWGLIELGKGNVYTLLEKQEVTNTALKLWLAEVVLRVSGYHYLPLEMIPAAQVVFPFRFSLNIREVETGNFVINRQGLDMQLVGLVGGVREYA

SEQ ID NO: 5381 - protein, 251 aa, Dethiosulfovibrio peptidovorans
MSKRHDKLGIKQTIQKHWMDYVVKMMLAGLKEKEIRVELDEFLATQKQSGGTGQRGKKTYGMAISILASWFAPDKDLITFRDHALALIRNENPRNWLPYHWAVISASYPFWFNVSKQTGRLFNLQDQITQAQVLCRLKEQYGDRETVARNARYTVRSFVAWGMLKDSNVKGCYEQCKTTAISEPNLTILLYEAALCADKEGKAVLGLLKSNPAFFPFQLPVLTGDYISQQSNTIDIVRYGLDDDLLKLKYL

SEQ ID NO: 5382 - protein, 240 aa, Kingella denitrificans
MNSSAPKIGFDRFIQLDWAAAALNVRAGVAGLDDLNALLDAAELGLEAKKKTRTVLNRLWLEPRAELVDYADRGAAIHKTQPDIPVAALCWGMSVATYPFFGKVAELVGRLSAIQGDCASAEVHRRMSETYGEREGTRRMTNMVIQSQASWGAVERVEKGKRVIRLAPTTIDNDGLTAWLIEAAVRYAGKPVSVPSLQSLPVLFPFTLTRPLAYVVSNSANLILRSEGPSNQFVALRSTI

SEQ ID NO: 5383 - protein, 241 aa, Alcanivorax hongdengensis
MKPSAPKIGFDRFIPLEWAAAALDVRAESNTLDDLNALLDQAELGAAARKKTRTVLNRLWLEPRPELAAFADRGIAIHKADPNTPVAALTWGMAIATYPFFGRVSELVGRLSSLQGDCASAEIHRRMSETYGEREGTYRMTNMVLQSQASWGAIERIEKGKRLVRMQPIVVSNEQAVSWLIEAALMYSGKALPVSSLSSLAVLYPFILDQPLSYLVSRGASLGVRTEGTGNQFVYLDRRQL

SEQ ID NO: 5384 - protein, 243 aa, Bacillus cereus
MKAVGFDQKIQLAHLDITANLLRQHSAKDMYNLLDTELMTSIKGDKSRKNAITMLMKTWSLIDPIIKDLRDQLVLEYPYLTASEKRLANYCLTCIAYPFFREQMYYIGKQLKMSDEVHSKLIVSEMKNRYGDRRRVEVAAGAVFSSAKDWQLLTMRKPGVYQANKSEIDIQNPILKALIIEVLMMHYEAFTVSTDIVNSSAIFFSFDYHIRIGDLDQQRFTIIKNIRDTIIERNPKIPYSHPE

SEQ ID NO: 5385 - protein, 237 aa, Nitrosococcus oceani
MQKAAYLLLAGLDAKAIRQELHDYLSDRMGSGVRAERSTEARSFAVTILMNIWVTPDPVLETLRNDALPYLAQGRSAELAVHWSMIGAAYPFWFNVARQTGRLLALQDQVTMKQVSRRLIEVYGERQTVSRNAQFVVRSFAFWGVLKDTAQQGCYQKIVSAPISDLNLVSLMLEAALHAIPEGKGTLDLLLNNPAFFPFQLPLMTGDFIGQRREHIEIIRYGLDDELLMLKKKQGER

SEQ ID NO: 5386 - protein, 240 aa, Methyloversatilis universalis
MNSSAPKIGFDRFIQLDWAAAALNIRAGVAGLDDLNALLDAAELGVEAKKKTRTVLNRLWLEPRAELVDYADRGVAIHKTPPDIPVAALCWGMSVATYPFFGKVAELVGRLSAIQGDCASAEVHRRMSETYGEREGTRRMTNMVIQSQASWGAVERVEKGKRVIRLAPTAIDNDELTAWLIEAAVRYAGKPVSVPSLQSLPVLFPFTLTRPLAYVVSNSANLILRSEGPSNQFVALRSTI

SEQ ID NO: 5387 - protein, 250 aa, Thermoplasmatales archaeon
MTGFDRPLKPTWIYNFVKIVEIGDTITDHKTEFNKILWELDGEEGKRKVRTVLSRYFMKTQKNPKSKTVEYTPIIEICKTYPLEKIRPLMLFYLLSRSEVLRNLSKIINEVYGNKKDIDYHFLRKKIIEKYGERDISSRSLRNFLTTLEYFDILKKQNHIYKWTKKLQPDEMNICYMLKFYSDEYKRSPQIFIDDIEQYIMQYFEIQDLGSIGRKYNKKLWEFSQNLNQKQIVFHKSYKWENKLIKQLFS

SEQ ID NO: 5388 - protein, 240 aa, Pseudomonas sp.
MTTSLPHIGFDRYIKLEWAATALKVRAGLTSIDELNALLASENLGKEALGKTQTKLNGLWLAPRSVLLDFADRGAAILKASPATSAVALTWGMALASYPFFAKLAEQVGRLTALQDDCSTAEVHRRMNEVYGEREITRRAGQAVLQTHENWGVIERIEKGRRLRRRPAIRVDDPQLVTWLIEAALRCLGKPLALSSVQTLPVLFPFSLEGSLAFLASGSAHIELRSEGPHNQFIALREGA

SEQ ID NO: 5389 - protein, 238 aa, Bacillus cereus
MTKHVGFDQKVLLHHLDFTANYTKKYSRKDMYEVLDGYLRNDITGAKSRKNAVTMLMKIWYLVDKDLVEIRDRVLEVLPVLTKEERLFVHWGMTLAAYPFFRDAVHELGKLFQLQDTVPSTVIGKRMKEEYGDRRRVEVATSAVLMSIKAWGVIIPTKNRSYQLPDKVLISNPILQVFIVQIILHVLENTALQLDILKNHPMLFPFEHEFDLFELRQCEGITLHHQGVGTLIVECKKS

SEQ ID NO: 5390 - protein, 237 aa, Bacillus methanolicus
MVKPVGFDQKIMLHHLDFTENEARKLSRKEMYEALDYFLRSDIQGAKSRKNAITMLMKIWYLVDEETIPLRDKALEMFPHLTKEERLLVHWGMTILAYPFFKDLVQELGKLFRLQDEVPSAVIGRKMKELYGDRRRVEVATSAVLTSIKTWGIVDLLKSRSYKLRPKMSITSTDLNQFITEVILRATNVTAMPIDLLHNHVLFFPFSFDISVTELRNNNQFRLNRQGIDIVIVELSS

SEQ ID NO: 5391 - protein, 235 aa, Vibrio scophthalmi
MKVSIGFNRHLEPDWLAQTASWVANGIEGQALKGRIDSMLEPAFTSKVAKDKTRNLLFGIWNKLPKHISERFQSRGANLLMEHSEQHLVFHWGMMLSKYPFFAFVVGQIGKLTKLNDTFIYSQLEDRVTEQYGDTSTIKRSMQFVVRTLMNLGVLKNPKQGVYELNTVVSIEQPEVKGWLVEAIMRSNQSSSRSLSSINDDTVWFPFKLFFDLSDVQTNKELEAHLQSSDTVVFL

SEQ ID NO: 5392 - protein, 140 aa, Vibrio scophthalmi
MLKTIFFADVVRFIGRRKKHAEVFTYAQVQKNIVELYGDTETVKRSLRSVLKTLVDFRVLERQMNRTYKAYKLEHKVESKYKSWLLQSLMYNQRYRSRSLADMLDDLVWFPFVFSVSVNELETTWFDLHQQGNDLVLFKK

SEQ ID NO: 5393 - protein, 103 aa, Vibrio scophthalmi
MSKRVNFSRHIEIQWLDSVAVWVAEGKQKKELDEQIDLMLEPSVTCKVNRGKTRNQLTKLWSPNSDDVTESFTRFAIEAVLGSERPDFVLHWGMLVAKNNFFC

SEQ ID NO: 5394 - protein, 247 aa, Thiorhodovibrio sp.
MNGRHQAIGIKQVIRLDWMQRTANLLLAGVDAKSIRMELHEALNREADGQRSAQTRAFAVNNLMTIWCSADAELGPFRAAVLEILRQDPKSGLALHWAMISAAYPFWFNIARQTGRLLALQDQVTQAQIVARLKENYGDRQTVSRYARFVIRSFVDWGVLQDAPVKGCYEQSSPIAFDDRGLALLLYESALLASPEGKASLARLANEPAFFAFKLPLLSGGLLSESRARLDVVHGALDDQMLVRKPG

SEQ ID NO: 5395 - protein, 235 aa, Clostridium papyrosolvens
MLDRIGFDRVVKLNWLNKTVEIYNQEKDFKKVKLDLDYYLRDDVGGDNRRKTINILIRTWVNVDPVHVAIRDKALDLFKMADANERIAIQWSMLLLAYPIFDNLTAVAGKLLNLQDEFLLSMVRRRIYELWGERSTLQYAIDKMIRSQIDWGVLSDGEKPGEYKRIQPLEIKNKEVKLLLIEAYLLASGKPHLQFVEVNKLDELFPFKLDIGLDDFHTVDKFKLNKMGGEVVIGL

SEQ ID NO: 5396 - protein, 235 aa, Thermoanaerobacter ethanolicus
MKKVGFARRIKLEWLDKVVEFYKNEQEVSKIKKGLDDFLISEVKSKENRRKSIDILISSWVDVPEEFKYVRDKAVVLFDKVSEGEKKFIHWFMLISAFPLFSDISTVIGKLLSIQEEFKLDTVRQRIFEIWGERSTVKFSTDKIISSMVEWGVLSKAQKPGIYKKANTIEIKNKELKLLFLEVYLKSNKKSFISYAEIDKLYVIFPFELSFELGDFYDSPVLNVNKMGDNTVIVI

SEQ ID NO: 5397 - protein, 235 aa, Thermoanaerobacter ethanolicus; identical to SEQ ID NO: 5097

SEQ ID NO: 5398 - protein, 240 aa, Nitrococcus mobilis
MAPSAPQIGFDRFIPLEWAAAALRVRAELGSLDELNYLLDAAGLGVAARKKTRTVLNRLWLDPRPELVDFADRGTGIFKADPRVAVSALTWGMAIATYPFFGKVSELVGRLSALQGDCASAEVHRRMSETYGEREGTYRMTNMVLQSQTSWGAIERVEKGKRLVRLESIVVGDAQMVAWLIEAALRYIGKAVSVPSLASLAVIYPFVLDQPLGYVASKSPHLELKREGAGNQCVCLQVSQ

SEQ ID NO: 5399 - protein, 199 aa, Enterococcus faecium; identical to SEQ ID NO: 5151

SEQ ID NO: 5400 - protein, 222 aa, Eubacterium saburreum
MPESKAADTLKQNPGMERTKMERKSYSAGAVKFSFWFMEFRKTVQLLSEGESFVDIKKLNEETNIYGAPTKLRAQQIYSTVTARIKTLDESFYPIFLSSDLATQKLFVLTAALLHDTLFFDFVYEVVREKMILGSDELTDADIRIFFKNKQEQSEKVASLQDYTLRRLGSCYKTQLYEAGLLESNRANSTRKILKPILDIAFEHWLYDNDLGIMVKTLTGVR

SEQ ID NO: 5401 - protein, 192 aa, Escherichia coli
GDLLGGPLMSRESRVIAELLLTDPDEQTWQEQIVGHNILQASSPNTAKRYAATIRLRLNTLDKSAWTLIAEGSERERQQLLFVALTLHSPVVKDFLAEVVNDLRRQFKEKLPGNSWNEFVNSQVRQHPVLASYSDSSIAKMGNNLVKALAEAGYVDTPRRRNLQAVYLLPETQAVLQRLGQQDLISILEGKR

SEQ ID NO: 5402 - protein, 266 aa, Vibrio cholerae; identical to SEQ ID NO: 5058

SEQ ID NO: 5403 - protein, 201 aa, Escherichia coli
MTKNDKRWIGDLLGGSLMVRESRTIAELLLSEPDETTWQQQIINENILQASSTSTANRYARTLRLRLMTLDRECWQLIADGSESERLQMLLVALMIQSPVVATFIAEVVNPARQQFKEKLGINCWSEFVDENLRLHPELAAFSDSSIQKMGNNLIKALAEAGYLDSPRRRNLQNVFLLPVVAAALHRLNKAELLPILEGNA

SEQ ID NO: 5404 - protein, 199 aa, Enterococcus faecium; identical to SEQ ID NO: 5151

SEQ ID NO: 5405 - protein, 199 aa, Enterococcus faecium; identical to SEQ ID NO: 5151

SEQ ID NO: 5406 - protein, 202 aa, Eubacterium saburreum
MERKSYSAGAVKFSFWFMEFRKTVQLLSEGESFVDIKKLNEETNIYGAPTKLRAQQIYSTVTARIKTLDESFYPIFLSSDLATQKLFVLTAALLHDTLFFDFVYEVVREKMILGSDELTDADIRIFFKNKQEQSEKVASLQDYTLRRLGSCYKTQLYEAGLLESNRANSTRKILKPILDIAFEHWLYDNDLGIMVKTLTGVR

SEQ ID NO: 5407 - protein, 199 aa, Enterococcus faecium; identical to SEQ ID NO: 5151

SEQ ID NO: 5408 - protein, 199 aa, Enterococcus faecium; identical to SEQ ID NO: 5151

SEQ ID NO: 5409 - protein, 199 aa, Enterococcus faecium; identical to SEQ ID NO: 5151

SEQ ID NO: 5410 - protein, 202 aa, Stomatobaculum longum
MERKPYSAGAVKFSFWFMEFRKTVQLLREGKSFADIKKLNEETNIYGAPTKLRAQQIYSTVISRIKTLDESFYPVFLCSDLATQKLFVLTAALLHDTLFFDFVYEVVREKMILGSDELTDADIRIFFKNKQEQSEKVASFQDATLRRLGACYKTQLCEAGLLESSRLNSTRKIQKPILDIAFEHWLYDHALGIMVKTLTGVR

SEQ ID NO: 5411 - protein, 199 aa, Lactobacillus reuteri; identical to SEQ ID NO: 5011

SEQ ID NO: 5412 - protein, 201 aa, Stomatobaculum longum
MKLSSPYNGALTREQFLFYEMRTMAKLVAAGLTDEEATEAIIKDNLFQYPTEKSIKNLAGVCLKRLHSMNDDCLMEAIAKLPADAAKQICLYAMMKKNRLVWDFMITVIGEKYRILDTSFGKVDLNTFFMRLTEQDDNVASWSDATVQKIKQVLVRILVENEYLDSTRADHLNPVLIGSLLEERIRANDDNAALIAFNCLS

SEQ ID NO: 5413 - protein, 200 aa, Sporolactobacillus vineae
MPVGMNYSSSLKSFALLFTELKNLCMLRMQGLSDADLNDKILRDNLFQVASESRRKELKSVTMKRMRALDPYLMKKLVTGDLATGRVIALYALIMTDRLFREFMVEVVADKFAIRDDQLTNTDFDHFFERKRLLSMRVNKWTDYTFYKMRQVMIRILFESGFLKINKSARYLVRPIIDPDVRTYLADIGQPEIIAALVGD

SEQ ID NO: 5414 - protein, 199 aa, Enterococcus faecium; identical to SEQ ID NO: 5151

SEQ ID NO: 5415 - protein, 237 aa, Treponema primitia
MLKSVGFLRAVSNAWLDKTVELYLTGLDPDKIREELTNHISFELKGKESIRKTIDVLMATWININTENQQARKTAITAYKNCAENHNIQHYCMLLLAYPVFNDFCNLIGKISKMQDTFTKSWLRDKLFEQWGDRVSIDNSLKYLIQTLLSLQILERIGVGKYQIKKHEIMDNQNKILLLHALALLGGTKYCVLSSANFQPILFPYIVEFSPELILNNSILELCIFQGKAIISLKKDG

SEQ ID NO: 5416 - DNA, 591 bp, Halorubrum lacusprofundi
atgactgactcgccgtaccgcgcgttcaaggagaagctctgtacgttcgccgacggccaggccggcatccggaacccgttcgtcatcgctgctgtcgatcccgcggtcgaacaccaaacagcagaccgactcagttcctgggcgacgggcgctggtgaactcccgcctatcgatgacggtgtgactgtccagccgatatggctcgacgaactgctcccccagacgaaagtgtacaagctctcggtcgcgctcggcggtgagacgagccccgagcgtatcgagggaacgatgcaagatcggctcgccgaagaactcgtccaggagatgatcgagcaggaaatcggcgaggaaaagctggagacgcaaagccacgtcgtcctgctgctcaatctcggcagcctctatccattcacgcgtgcctcggaactactcgatgaactcgaccgccgaaacgtcaggtcgaccatcgggattccgttccctggcgatgacgtcggcgggaagttaagcttcttcgacggagactcacgacattactacccggcgcaccagatcgacggtcagatccgagaggtacatctccaacaatga

SEQ ID NO: 5417 - DNA, 582 bp, Halopiger xanaduensis
atgacgaccaaacgtcccttccacgacttcacggagcgactcgcacagttcgccgacggacgacgcggcatccgaaacccgttcgtgatcgtccccgtccagccgaagtacgagcgacgggtcgccgaacggctcaccgagtgggcgacgaacccgcatcgtaccgaggagttcccggatgacggaaccgtccaagtcctccggctggacgaactgttcgtcgaaaccgacgtcttcgaactcgcggtcgacctcggcgaaaacagccagccagcgactatcaccgaaacgatgcaagaccgattagcggaggaactcgtcgcggttatggtcgagaaaatcgacgcaccagcccagcagcgacacgtcgttctcctcacgcacctcgggagcctctacccgtttacgcgtgcgtcggaactgctcgacgagctcgaccgccgtaacgtccagtcgacgatcggtattccgttccccggagacatcgtcggtgggaaactgagcttcttcggcgaggaatcgcgcaactactaccctgcccaccagatcgaaggccgggttgagggggtgcatctccaatga

SEQ ID NO: 5418 - DNA, 603 bp, Salmonella enterica
gtgatcgatcccgtgcttgaataccgcctgtcacaggttcagagccgcattagcgaagagcgctttctcaaaaacaacggctccggtaatgagattgggttctggatttttgattatcctgctcagaatgagctgcaggtgcgtgaacacctgaagtatctgttgcgtaatctggaaaaggaccacaagttcgcgcacctcaacatctttcagatcatcgtcgacatgctcactgaacgtgggttatttgaccgcgtctgtcagcaggaagtgaaagtcggtaccgaagcgctgaaaaaacaactcgttggcttattgaatcagaaaaagatcgcggattacatagcaaaaaaagtcgatcttcagaatcaagagtttgtcattctgacaggaatgggtaacgcctggccgctggttcgtggccatgagctgatgagcgccttgcaggacgtgatgggttttacccccctgctgatgttttatccgggaacctatagcggacacgatctctccccattggcgggcattgattcccgaaattattatcgcgccttcaggctggtacccgaaagcgggcctgcggcgacattgaatcctcgttaa

SEQ ID NO: 5419 - DNA, 603 bp, Photorhabdus asymbiotica
gtgattgataaggttttggaataccgactagcacaaattgaatctcgcatagagatggagggaattccacgtaatactcgccccggtaatgaaatcagtttttggatttttgattatccggctgaaaaagagattcgggtgcgggaattcttgcgatatttggttaagcgattggaaaagaaacgcacatttgttcatttaaatatcttcaagatattgattgatatgttggaggcgcggaatttgtttgaacgtgtttgtgaacgcgaaaaacagatgggtaccgaagcgatgaaaaagcagctttcaggtttactcagtcagaaaaaaatagctgagcacattgctaataccacttctttaaaagatcaagaattggcgattatttcaggcttggggaatgcatggccttttgtgcgtggtcacgaattgatgagtgccttacaggatgtaatgggcttcacgcctttgttgatgttttatccgggaacttacagcggctatgacctgacacctctcacgggtattgattcccgtaattactatcgtgcattccgattggttcctgaaactggccctacggtattgctgaataatccttaa

SEQ ID NO: 5420 - DNA, 582 bp, Clostridium sticklandii
atgcagaatttagagaacagactcaaccagctagaggataaaataaaagaagatagctttagaaagaacaaaggactaggaaatgaagtaggctactatgtatttgactatagtgctgagcatgagcttcaagttcgaaatagaatctcatatctaaaatccaaatacagccaaaatagtgagctaaatatcgtagtatacgacctatatgacatcatcatagacatactagaaaaagaaggcttcttagatatatgcatggagtttgaaaagaccaaaggctttacagaaatcacaaaagcagtaaatgaaatgctaagaatggaagaggacaatcaaagtaatgaaatcatagcccacatcaaaaacaatactaaaagtggctctatcatcttcctaactggcataggcaagtgctttcctatacttaggtcacacaaaatactcaataacctgcaccaatatatagatgatgtaccagtagtactattttttccagggaaatacgatgggcaatcactgatgctattcgatgagataaaggatgataactactaccgagctttcaagctagtagactag

SEQ ID NO: 5421 - DNA, 240 bp, Acidiphilium multivorum
gtggacctcgtcgccgcgcagatgccccacgatcccgacccgctcagtgacattgtcttcattcagcgcactggcgctttgttccccgtctaccggacattctcattgttggaacagctgaaagggcgggtcacggtgccgacgattttgttttatccgggcgatctcgacggcgctgccgggctccgcttcatgggcgtgctggcagctgagcacaactatcgcccaaagatcttttga

SEQ ID NO: 5422 - DNA, 657 bp, Acidithiobacillus ferrivorans
atgagtctgaagctcaggcagcagcccttggcagcgcgctttaaccatctgctcaaggtcatcagcagtccgcgttttctggaaatgagagggctgaataacgatcttcccttctatatctgcgaattcaatgcgcaagaagcttttgagatgcagcgcacgcaacggcaactgatcagccagctccgtaacacgcacgtcgattgcctacaggggcgcggcgtcagggtgctggacatcaacctgtatgacctcagcgtcggcttgctccaggcccgtgaaggcggcgcagaaggtatctcgctctgggacgatatcctccgactggaacccgagatcgggaaagaccggctgttggagttgctgcaaaacgtgctggatatcaaggaacatctgattccggccattgcccaacgcctggcgcatacggactacgacgtgctgttcctctcgggtattggcgaggtgttcccctatattcgctcgcacaacgtgttgaacaacctgcaaagcacggccaaggataaacctactgtgatgtttttccctggtgaataccgccactccctggaacaaggcgcatcgctggaattgttcggcctgctgcatgacgataaatactaccgggcgttcaatattttcgaagttcaggtgtaa

SEQ ID NO: 5423 - DNA, 576 bp, Acinetobacter baumannii
atgagtcaaaaaatacatgagcgtctgaaccagattccagagcgaattctttccaccgagtttctcaccgggcaaggactgggcaatgaaattggcttctggatttttgattatgcacctgaagatgagttgaaagtgcgcgaatatctgcattttctagacgggatgctggagaaaaaacacagtcagctgaaggtggtgaatatcaacctgctgcaagccgtggtggattatctggctgagcgtaacttcatcgataaagccattcaaatgcaaaaagacaaaggcgatgaggcgctgctcaaagcgctgaaaggcccactgcatatggataagttcgcgccctatctggtgagtaaatatgccaccaatgcgcaagatattgtgttgatgactggggtaggttcggtttggccactgttacgtgcccatcacttattgaacagtttacattcgttactggggcataagccggtcgtgctgttttacccaggttattacgatggtcaagccatgagtttatttggaaaaattccaagcaacaattactacagagcattcagattagtgccttaa

SEQ ID NO: 5424 - DNA, 546 bp, Alteromonas macleodii
atgtcagaccgattatcaaaattactctctagtttcgaaagccatataagcattccatggccatcggcagtttctgctgatgagcgaacaatctttttggtctatcacaaagaagatgagcttaagttaagggctcgagtagaagagtttgaatacgcctgcactaacaataaccacccatggatgcttttagacttaactcaaagctttgaaacatggatggcagatcaagattataaagaaacttactttgaggacccagaatacctcaaggggctatttggtgacttcgccgatgagctggtcgccgacctgatcgctaaagtagaaaacaatcaaaacagcaacggggttgtagctcttttaggctgtggaacattatttggcttcgcttcagtgtcggggttggtagaatctttggcagaaaaaataacaggaaggctagttgtctttttcccaggtgaagtacacgaaaacaattatcaattattagacgctaaggacggctggggctatcacgccaccgccatttcagcaaatacgtaa

SEQ ID NO: 5425 - DNA, 564 bp, Anaeromyxobacter dehalogenans
atggcgcgactcgaagatctcgcggatctctacggccaacacatcgcgacgccctggcagcgtacggtcgccggcgcgcagcgcgtgatcatggttgcatacgataaggagcttgagcgagccctccgtgcgcgaaagggcgagttcgagacgcgcaccagggccgccggacacgattggcacgaggtagacctcaccaccgcgttcgcctcgtggatcgcagccgacgagtaccgcgacgcatacttcgagtcgcccgaggatcttcagctcaagctgaaggaggagttccccgagtacgcagccgagaagatccgcgcggttcttacaagcaacgacgtgtccgaggcgtcagtagtcgccgtgttgggcgcgggctccctctacggcttcacgtatgtgtccgaagtgctgaagcgcgtcgagcgcgacgttcgtggtcgcctcgtcgtgttcttcccgggcacgctcgagcagaacaactaccggctgctcgatgcccgcgacggatggaactacatggcggtcccgatctcgatctacagcgccgggggtgcagcatga

SEQ ID NO: 5426 - DNA, 579 bp, Aromatoleum aromaticum
atgaccgacactttcgaggaccgcctcaatcagatcctgcctcgcgtcacgtccgaggacttcctgcagaaccgtggccttggcaacgagattggcttctggattttcgactatccgcctgatgcggaaatcgccatgcggaatttcatttccagcgtgatcgaacccgttctcaagaaacatcagccgcccctgagttttgcaacgctcgacctgttcgagctggtggtgaacctcctcgaagatcgcaagctgctggacaaggccatcgacatgcaaggcaagcagggggacgacaaggcgctcgaatctctgcgtcgcgtgctcaaggaagacaagctcgccgagcgcatcgtgcagcaacacaatccggacgcactagacctcctgatgctcaccggggtgggagccgcataccccatgcttcgcacacatacgctgctctccgcgctacatccgcacatgaagcagacgcctctgctgatgttctaccccggccgctatgacggctactcgctacgcctcttcaacaagttgtcggaagaccactactaccgcgccttccggctcgtgccttga

SEQ ID NO: 5427 - DNA, 600 bp, Arthrobacter sp.
atgaccgccaagactctctctcagcaggaggagcacctgttcaggatcctgagtagccagcggttcctccgcatggagggtctcggcaatgaggtgccgttcttcatctacccctacgacccggagctcgcgcttgaggtcgccgatgtgaagaagcgggtcaagaacaagctggcgaacgccggcatccaggttcgcgagatcaacctctacgacctggccgtcgccctgatcagggagcgcggtgattgggacgacgtcatcgagctggagacctcagtcggcaagtctgagtttggcgaggtggtgcgctcgatgctgaaccctgaggttcacttggcaccagccatccgcgagcgtctgttggatggtgcgtttgacatcttctttctgaccggcatcggagaggtcttcccgttcatccggtctcacaacgtcctcaacaatctccagagcgtcgtgacgaacaagccgatgctcatgttcttccccgggcggtatgagttctctgcgacgcttgggtcatcactagtgctcttcggacggttgaaggacgaccagtactaccgtgccaagaacatcatcgaccaggaagcgtga

SEQ ID NO: 5428 - DNA, 564 bp, Azospirillum lipoferum
atggcgagaatcgaagatcttgcaaaggtttacgaacgccacatcaaattgccgtggcagcgtaccgtcgcgggagcgcagcgcatcgtcatgctcgtctatgagaaggaagctgagcgcgccctgagggcgcgcctcaagaacttcgagatcgccacggctgaagccggcaagacgtggcgaacggtcgacatcacggacagctttgctgcctggatggcgggcgaagaataccgcgacgcgtacttcgagatgccggaagacctgcaactgaagctggatgcggagttcgccggcttcgttgccgatcgcattcgattggcgctgaccgacccggccgttgatgaggacacggtcgttgcggtcatcggcgccggctcactcttcggctttacgcgcctttcgcgcgtgttgaccctggttgagccggacattcgcggccggttgctggtcttcttcccggggcagtatgaggacaacacgtaccgcctgctcgatgcgcgggatgggtggaactacttggccgtgccgatcacgatgcacggagggggagcacagtcatga

SEQ ID NO: 5429 - DNA, 708 bp, Bifidobacterium animalis
atgcaatcgtattccttctccggctatgatgcgctcctgtccgacggatcctacgacgcgaccaaggatttcgaacatgtgttcgaagtcatgtcgcagccgtcgttcctgcatatgaccggtctgggcggcgagcagccgttctacatctgcgactatccggcggaacgcgagctcgaggtgcgccgatgtatcgatacgcttgctgcacgtctgcgcacgacgaagtacgcggacggctctcccgcccccagcatcctgcgcatcgacctgttcgacaacgtatgcgagttcctcaggcaccgcggcgtgctcgagcgcgtcatcgccctcgaaccgcgtcggcatacgcagatctcctccgatccgatgctcgacgggttcctcgggctgctcgtcaacatggtgaacgcgacgacgaacaacctgtacgacttcctcgccgaacattacgagcaggcgttcaagaacggcgaggcggacatcgtgttcatcaccggcatcggcgccgtctacccctatgtgcgcggccacacgctgctcaacaacctgcaggggcgcatcgaggacagccccctcgtcatgtttttccccggcacctatgcgcagagttccgcgtccggctcgtcgatgcgcctgtacgaccggatcgaagcggagaactactaccgagcgaagaacatccgggacgtggccatcatcagctga

SEQ ID NO: 5430 - DNA, 612 bp, Bordetella parapertussis
gtgacagcagatatagccagaaagccaatgcaggacagatttcagcatctctttgctgtgatctcaggccagcgttttctcaacaagcaaggtctcggtaacgaggttccatttttcatctgccccttcaagccggaagagtctgttgaaatggagcggctccagcgtcagctggtcaatcgccttgagcaggctggtgttcggattctggagatcaatctgtacgacctttcgatagaaatcctcaaagaacgtgacatctgggaccagattgtcgagatggaggattctgtctccaaagagcagctcaaagagttattgcaaggcgtgctagaccccgaagcgcatcttgttccggccattgcggccaagctggcaagcacggatttcgaggttctttttctgtccggcgttggcgaggtgttcccctacatccgctcgcacaacgttttgaacaatttgcagagcacggcgaaagaaaagccgaccgtcatgttttttccgggagcctacacccactccctggagtccggagcatcgctcgatctcttcggaaggctgcatgacgacaagtactaccgggcgttcaacatctttcactgcgaagcatga

SEQ ID NO: 5431 - DNA, 564 bp, Burkholderia sp.
atgtcgtctaaggtcgccacgctggtgtccgcctaccgccaacacctgaccgtgccttggcaggcaggccttgcggccatccagcgcgtaatcttcgccgtctacgataaggcggatgagctgcgcctgcgcgccaacgtcggcgaatttgaacttgcttctcagcaagcaggtaagcagtggttattgctggatgtgacgaatgcgttccctgaatggatggcggcgcaggaataccgcgatgcttacttcgaagcccccgaagacttagccggctatcaggctggcgaactcaccgaattcgtggccgacctcaacgcaaagctgaaagcccgcattcgcagtgaagccggctctgatacggtcgtggcgttgctgggcgttggcacgcttttcggtttggcccgcgtttcttcagtggttgaaggcatcaaggacgccgttgaggggcggcttttggtgtttttccccggtgagtaccaccccgagagccatacgtatcgcctactagatgcccgagatggttggaactacctcgcggtaccattgctcgctcgagactga

SEQ ID NO: 5432 - DNA, 579 bp, Burkholderia gladioli
atgagcgcgtcctttgatgatcgattgaaccaggtgttgccgcgtcttctgtcggcggacgtgctcgaaaacaaaggcgcgggcggggaaatcggcttttggatcttcgactacccgccggatcgcgaaatgaccatgcggggctggctcgccgatgtgatcgagccgggcctgcgcaagcaacaaaagccgatccgatttgcgatcgtggacctcttcgagtgcatcattggcctgctcgaagaccgtcgcttgttggagaaggccttcgacatgcagcagaccaaaggcgacgaggcgctgctcacgtcgctgcgttcggttctcaaagaggaccgtttggccgcgcgcatcgtcgagcaaacgagggtcgaggagatcgacctcctgatcgtcaagggagtgggcgcctcttacccgatggtgcgcacccacacgctgctttcggccctgcatccgcacatgcagcacaagcctttgctgatgttctatccggggcgctacgacgggcagtcgcttcgtttgttcaacacgctcgtcgacgataactattaccgggcatttagcttggtgtcgtaa

SEQ ID NO: 5433 - DNA, 579 bp, Burkholderia vietnamiensis
atgagcgccagcttcgacgaccgactgaatcaagtgctgccgcgcatgctgtctgccgacgtgctcgaaaacgaaggggccggcggcgaaatagggttctggatttttgactacccgcctgatcaggaaatgaaggtgcgcggatgggtcgcggacgtcattgaaccaggcgtccgcaagcagaagccagatttgcgtttcgcaacggtggacctgtttgagtgtgtgatcgggctgctcgaagatcgtcgcttgctggaaaaggcgttcgagatgcaacggaccaaaggcaacgacgccgtgctgacgtcgttgcgctccgtgctcaaagaggatcgcttggccgcgaggatcgtcgagcagttcagcgtcgcggacctcgatctgttgatcgtgaagggcgttggcgccgtttatccaatgctgcgaactcacacgctcctttccgcgctgcacccccacatgagcgacacgccgttgctgatgttctatccgggccgatacgacgggcagtcgctccggttgttcaacgcgcttgtcgacgataactattaccgggctttcagcctggtgccctaa

SEQ ID NO: 5434 - DNA, 591 bp, Calditerrivibrio nitroreducens
atgggcacaaatcttacaagtaagctaaactgtcttataaatattttaaaagacgaaaattatttcagactggaacatattgccaatgaagttcctttttacatttttgattatgaccccgaagctgaactggatgtaagaaagaccattaagatcatatccgattctgaccaattaaagtacagaatagaagtggtaaatatttatgattttataataagttatttgcaagaaaaagattttttagaaaaaatttttgaaatggagcaaaaattatcccctgaaaaatttcttaccagattaaaatctataatagatcctgaattgattattaataagatagtacagctaaatgatgaaaaaaatcctgatgtatttatattaactggaattggcaatagttatcctataataaggatccatcagattattaatagattacaagaaaaagtatgcaacaaagttgtcatagttatgtatccaggtacttttgatgtaaatgaaacagaggggaaattgatattgtttaatagtcttgaaagtaaagctttttatagagcatttaaaatctgtgggggtagtttaaaatga

SEQ ID NO: 5435 - DNA, 585 bp, Carboxydothermus hydrogenoformans
gtgaaaacaatctatgaaaggcttgatgccttaattccagcaatacagaagaaatcatttgttgaaaataaaggtctgggtaacgaaatagggttctatatctttgattatgaacccaaatatgaactgcttgtccgtgagtatatccaatttttgaaggaaaaattcaagaacggtatcaatgggtataaaatcaaagaatttgacctttacgaaataatgattgacattcttgaggccaaaggttaccttaccaagaatattgagatggaagctattaaaggtagcgaatatgtatttaatgccactaaaaaagcattaagattaactaccgaaaatgacctgattgtccaatacattcgggaacgggtagaggataaggatatcatatttttgactggtgtaggaaaagcctggcccattatcaggtcacatactatccttaacaaccttcattcggtgatagaacatgtgccgcttattatgtttttcccaggcacttacgacggcgtcgaacttgttctgcttgatgaaatcaaggatgataactattatagggctttcagacttattgagagatattaa

SEQ ID NO: 5436 - DNA, 591 bp, Chlorobium phaeobacteroides
atgccaatgcaagacagatttcagcatctttttgctgtgatctcgggccagcgttttttgggcaagcaaggtctcggtaacgaggttccgttctttatctgtcccttcaaaactgaagagtccgttgaaatggagaggctccagcgtcagctggtcaatcgccttgagcaggccggtgtccggatactggagatcaacctgtacgacctttcgatggaaatcctcaaagagcgtgatgtctggaaccaaattctcgagatggaggattctgtctccaaagagcagctcaaagagttattgcaaggcgtgctagaccccgaagcgcatcttgttccggccattgcggccaagctggcaagcacggatttcgaggttctttttctgtccggcgttggcgaggttttcccctacatccgctcgcacaacgttttgaataatttgcagagcacggcgaaagaaaagccgaccgtcatgtttttcccgggagcctacacccactccctggagtcaggagcatctctcgatctcttcggaaggctgcatgacgacaagtattaccgggcattcaacatctttcactgcgaagcataa

SEQ ID NO: 5437 - DNA, 585 bp, Clostridium clariflavum
gtgaaaactatttatcaaaggcttgatgaaatcatacagcggattacgaaagaatcatttagagaaaatacagggcttgggaatgaaataggatactatatattcgattatgaaccaaggtatgaaatgcttgtaagagagcatgtacgttttcttatacagaagattaatgaaggagactatggttttcacataaaggaatttgacttgtatgaaataatgctggaacttcttgagacaaaaggttatcttgagaagaactttaagatggaacaggtaaagggtagtgaatttgtatttaatgctactaaaagagcattaaggcttactgagaaagatgacctcattattcaatatataagggatagggtagtaaaaggagacgtagtatttataactggtgtggggaaggtatggccgattatacgctcacatacggtattaaataaccttcatcaggttttggacgaagtacctgtaattatgttttttccgggagtatatgatggacttgaactggtactttttgaagaaattaaggatgacaactattatagagcatttaagttagtggatagatattag

SEQ ID NO: 5438 - DNA, 585 bp, Clostridium clariflavum
gtgaaaactattaaccagagactggatgaaattatcctaaggattacaaaagaaaactttagaaaaaatacaggtcttggtaatgagataggatactatatatttgattatgaaccaaggtatgaaatgcttgtgagggagcatgtacaatttttgaagcagaaaattaacgaaggggattatggttataatataaaggaatttgacttgtacgaaataatgctggagatccttgaaagcaaaggctatcttgaaaaaaactttaaaatggaacaggtaaagggcagtgaatttgtatttaatgccacgagaaaggcattgagaattaccgaaaaagatgatcttattatccattatataaaggaaagagtagaaaaagatgatatagtgtttataaccggtgtgggaaaggtatggccgattatccgctcccatacggtgttgaacaatcttcaccaggttttggacgaagtacctgtaataatgtttttcccgggaatatatgatgggcttgaactggtgctttttgaagagattaaggacgataattattacagagcgtttagattagtggatagatattaa

SEQ ID NO: 5439 - DNA, 585 bp, Clostridium ljungdahlii
atgaaaactatatatcaaagattggatggaataatacctaagattacagataaatcctttagggaaaataaagggttaggtaatgagataagttattatatatttgattatgaacctaagtatgaacttttggtaagagatcatattcagttcataaaacaaaaaattagcgatgaatactctaatattcatataaaagaatttgatttatatgaaataatattagaaacgatggataaaaaaggatatctgcaaaaaaacattgaaatggagaagaaaaaaggtagcaaatatgtttttaatgctattagaaaatcacttagattgactcttaaaaatgatatggttttggattatatagtaaatagagttgaacctaatgatattgtgtttataactggtgttggcaaagcatggccaattatgcgttcacatacagtattgaataatttacataatgcaattgatcaagtgcctgtagttatgttttttccaggggaatatgatggcttagaattgattttatttaatgagatcaaagatgataattattatagggcatttcaattaatagataaatattaa

SEQ ID NO: 5440 - DNA, 585 bp, Clostridium saccharolyticum
atgatagaactggaaaacagattgaataaactcgaggaaaagattaagcagccgaatttcagaaaaaacaaaggattaggaaatgaagttggttattatgtgttcgattatccagcggaatatgagctgttggtacgggagaggatcgagtaccttgcttcaaagtatgaaaatgacaatcatgatttccggattgttgtctttgacttatatgacatcataatcgacaatctgatacgagaaggctttttagacatatgtatggactttgagaaagcaaaaggtttttctgaaataaccaaggcagttaatgaaatgctgagaatggaagaggacaatcagagtaatgaaatattagcgcatattaggaacaatacaccgagtaactccattgtgttcttgaaaggtgttggaaagtgcttcccaatgctacgatcacacaaaattttaaataacttgcatcaattcatagatgatgtgccggttattatgtttttccctggaaagtatgatgggcaatccttaatgcttttctcagaaatcaaagatgataattactacagagcattcaagcttgtagattaa

SEQ ID NO: 5441 - DNA, 576 bp, Clostridium saccharolyticum
atggatttaagccaaagactggatgagatggagcttgcaatccataagccgtctttccgaaaaggaacaggccgcgcaaatgaggtcaactattgggtgtttgattatccaccggaaaaggaactggaagttcgggagcgtgtagagtatctgaaaaataagaacgaccggggcgatgatgattttgagcttgtggtctttgacctgtatgatatcatcattgactttttggaaaagaaaaacttcatggaaaagtgctatgactttgaaaaaaagcgagggatcgagcgtatcgtcaaggcagtgaccaactccatgaaggtaaatgacgatgacagcctgatcgtgcaatatatcaaagaacatacgccggagaatgcagtcgtgttcctgaccggtatcggcaagtgctatccgattttgcgctcccacaaggtgcttaacaacttgcaccaggcgtttgtgcggtgcccggtcgtgatgttctttccgggaacctataatgaacaggaactgattctgttcaatgagattaaagacgataactattaccgggcattccgactggtaaagtga

SEQ ID NO: 5442 - DNA, 579 bp, Clostridium sp.
atggcaagcttaacagaacggctcgatcagatggaagccgccatccggaaaccttctttccggcagtcaagcggcagagccaatgaagtgaattactgggtgttcgattatccgccggaaaaggaactggaagtccgggagcggatcgaatatctgaagaacaaaaacgcaaagggtgttgatgggtttgagctcgtcgtgtttgatctctatgacatcatcatcgactatctggagaaggaagacttcctggaacagtgttaccgcttcgagaagaagcgcggccttgaccggatcacaaaagcggtcagcaattccatgaaggtcaacgatgatgacagcctgattgtgcagcacatcaaagacaatacaccggagaatgcggtggtgttcctgaccggaatcggaaagtgttatccgatccttcggtcccacaaggtactgaacaacttgcaccaggcatttgtaagagttccggtcgttatgttcttccccggaacctataacgaacaggagctgatcctgttcaacgagatcaaagatgacaactattaccgggccttccggttagtaaagtga

SEQ ID NO: 5443 - DNA, 576 bp, Cupriavidus necator
atgtcctcactcaaagctgacttcgacgagctgcgcgagcgcatccggcacgggcgcgagctcggccatgcgagcttcgagccgatctactacctcgtcttttctccggaccagatcctcgaagcgaagcgacagacgcccgcctgggtggccaagctccaccaagaaggctggaacgtgcacaccttctccattgcggaacaaatctgggcgctactcaaggacgatccattctggtcgctctgcgtgatggaagacaagtctgccccactggattggccgcgcaccaacaaggccttggcagacatcttgacggcggataacggtctattgaagcggctggaggacaccttgcaacctctagagggccagcagaacgcgctgctattggtgaccgacctggaggcactgcatccgtttctgcgcattggagccatcgaaagccagcttcacggcaagtttcacgtgccgacgatttttctataccccggcgtacgaaccggcaagacgcgcctgaagtttctgggcttctacccggaagacggcaactatcgctcagtccatgtcggcggctga

SEQ ID NO: 5444 - DNA, 609 bp, Cyanothece sp.
atgtcttctcttgaaacaatatcaatcagccaaagatttgaacatctattatcggtcatgtctggggagcgatttctcaaaaaacagggaattggcaatgaaattcccttttttatttgtccttacccacctcaagacagtgttgaaatggaacgtctgcaaaagcaactgattagtcagttgaatcacagagggatttgtgtattagagatcaatctttacgatctttgtcttgaattattgaggaaacgggggatatttgagcaaattctcgatatagaattttcgatatctaaaggggaactgaaggagcttttacaaaatgtgttggactcggagagtcatttaattccagccatcgcccaaaaactccaagaaaatccgtttgatattctgtttttatccggcgttggcgaaatttttccttatatccgttcccataatgttctcaataacctccaaaccacgacaagcaaccaaccgacggtgctgttttttccgggggcatatacctattccctagaatcgggagcatctctcgatttatttggactcttacgagatgacaaatattatcgagctttcaacattgacgagtacaaagtttaa

SEQ ID NO: 5445 - DNA, 573 bp, Dehalogenimonas lykanthroporepellens
gtgccatatctcaaggctaatttcgatgaactgattgagaggatgcggcatgggcgggatcttggccacgccagcttcgagccggtttactacctcgtttttcctccatctcagattctggacgtgaaacgctcgttgccagcctggacgtcaaggcttcgcaatgagggctgggatgtgcatcccttttccattgcggaacacatcacctcaattctttcaacagccgccccaagaaaaatctggctttcggctgatcggaaggctccccaggcatggaagcggaccaacgatgccctggcaaatgcgctgtcgcaaggatctctacagcagcgtcttgaggccgaactcacgaaattacaggacattccgaacgccctcttactcgtcaccgaccttgaagcgctacatccttacatgcgaatcggtgcgattgagagtcagctatacggaaaatttcatgtgccaaccgtcttcctctacccgggagagcggacaggtaaaacacgcctgaagttcatgggcttttaccctgaagacggcaattatcgttcggtgcacgttggcggataa

SEQ ID NO: 5446 - DNA, 612 bp, Desulfobacula toluolica
atgactgttgatacgcaaacacaaccaataccggaaagattcaaacatcttcagacactgatcagcagtgatcgattcttaaaaaaacagggacttggaaatgaagttcctttttttatctgtccatatcgaccttccgaagctgttgaaatggaaaggatgctaaaacagttgaccaacaaattgtcacaaaccggcgttcaggttctggagatcaatttatatgacatatctgttgagatcttgaaagaaaatggtgactgggaatggtatctggaagaagagtccaagatgaccaaagatgagttaaaagaagagttacagtccattctggatattgaaaccgtgttggtgcctgcaatcgcaaaaaccataacagaacaagatcacgatgttgtttttatgtccggtgcaggtgaagtatacccctatatccggtctcataatgttttgaataatttgcaaagcacagtcaagaaccaccccatggtcatgttttttccgggggaatatacccattcactggaatcaggcgcatccctggatttgtttggcaggctgcacgatgacaaatattatagagcattcaatatatatcactgcgagatttga

SEQ ID NO: 5447 - DNA, 555 bp, Desulfomicrobium baculatum
gtgagcaaagttaaaaggctgatccaatcctatgccaactttatcgccgtcccttggcgtgaagatgccgccccagcccagcgggtcattttctgcgtttatgacgagaatgaagaacttcgtctcagggccaaaatcgaagagttcgagctgaccacacgccaagccggtcacgactggtttgtctttgatgtgaccgactcattcgccctgtggttggcaaacgaggattacgccgaggaattcttcagagaaccaagcctactgggcgaccttctcccggaggaatatcttcgtttcctaatctcatccttcaatacgtacataggtgaggccacggcaaatccaaacgctgtaatcgcggtgctgggtgtgggcgcactctttggattcgccaaggtcaaagacctcgtggatagcttggctcctttggtcaagggacgcctgatgatctttttccccggcagttacgaaaacaacaactatcgcctgctcgacggctacgatggctggaattatctcgcggtacccatcaccgccgacaaatcattctag

SEQ ID NO: 5448 - DNA, 579 bp, Desulfosporosinus meridiei
atggccagtttggaagaacgcttggatcaagcagaacgaatgatcaaaatgcccagcttccgccagaataaaggcctgggtaatgaagtgggctattacgtttttgattatcctgctgaaaaggaaatggtcgtcagagaacgcattgaatacataaaggccaaaaactctaaaggcacagatgggtttgaactcgttgtcttcgacctttatgatatcgtaatcgatatgttggagcaggaaggctttatggaacagtgctacaagtttgaaaagaaaaagggcctggaacgaatcgttaaagcggtcggtaatcttttgcagattaatgatgatgccagcatgattgttcaatacattcagaaacgaacaccccaggaagccgttgtttttctgacggggattggcaagtgctatccgctacttcggtcacacaaggttctcaacaatcttcatcaagcgattgactatgtaccggtcgtaatgttctatccaggcaaatacgatgggcagaccttgattctgtttaatgagattaaagacgataactattaccgagccttcaggcttgtggagtaa

SEQ ID NO: 5449 - DNA, 576 bp, Desulfovibrio magneticus
atgagcacaacgtttgaatctcgtctgaacaaaataattgacaggcttgtttctaaagaactcctatcgaatgccggccttggaaatgaaattggtttttatgtcttcgattatccacctgccaacgagttgcaggtccgagcatttatagaaaccatagaggatcagttgccaaagcgcaaatctggcatacgatttcgacatattaatctttttcagcttctcatagattatctgcaagagcgaaggctgctaacgagggcatttcagcttcaacgggaaaaaggagatgctgaactcctaaaggctctcaagggtcctctccatgagcaaaagatcgctcagtattttgtgcaagtcacccagccagaaaaacaggaattggtcctcatgtccggcgtcgggagttcgtggccgatgctgcggacccatacgttgctgaacagcctgcacccccttatgggggacacgcccctcgttattttttacccaggcgaattcgatggtcaaggcctcaggctatttgggacgatgaaagaaagtaattattaccgcgcgttcaggctggttgcctaa

SEQ ID NO: 5450 - DNA, 591 bp, Desulfovibrio vulgaris
atgccgatgcaggacagatttcagcatctctttgctgtgatctcaggccagcgttttctcaacaagcaaggtctcggcaacgaggtcccgttctttatctgcccttacaagccggaagagtccgtcgaaatggagcggctacagcgtcagctggttaatcgccttgagcaggccggtattcggattctggaaatcaatctgtatgacatttcgatagaaatactcaaagagcgtgacatctgggaccagattgtcgagatggaggattcagtctccaaagagcagctcaaagaactgttgcaaggcgtgctggaccccgaagcgcatcttgttccggcgattgcggccaaactggcaagcatcgatttcgaggttctttttctgtccggcgttggcgaagtgttcccctatatccgttcgcacaacgtcttgaacaatttgcagagcacggcgaaagaaaagccgaccgtcatgtttttcccaggagcctacacccactccctggagtctggagcatcgctcgatctcttcggaaggctgcatgacgacaagtactaccgggcgttcaacatctttcactgcgaagtataa

SEQ ID NO: 5451 - DNA, 612 bp, Desulfovibrio vulgaris
gtgacagcagatatagccagaatgccgatgcaggacagatttcagcatctctttgctgtgatctcaggccagcgttttctcaacaagcaaggtctcggcaacgaggtcccgttctttatctgcccttacaagccggaagagtccgtcgaaatggagcggctacagcgtcagctggttaatcgccttgagcaggccggtattcggattctggaaatcaatctgtatgacatttcgatagaaatactcaaagagcgtgacatctgggaccagattgtcgagatggaggattcagtctccaaagagcagctcaaagaactgttgcaaggcgtgctggaccccgaagcgcatcttgttccggcgattgcggccaaactggcaagcatcgatttcgaggttctttttctgtccggcgttggcgaagtgttcccctatatccgttcgcacaacgtcttgaacaatttgcagagcacggcgaaagaaaagccgaccgtcatgtttttcccaggagcctacacccactccctggagtctggagcatcgctcgatctcttcggaaggctgcatgacgacaagtactaccgggcgttcaacatctttcactgcgaagtataa

SEQ ID NO: 5452 - DNA, 552 bp, Desulfurivibrio alkaliphilus
gtgagcagggttaaacgtctggttcagtcataccgcaaatacatcgcggttccctggcgggatgatgccgccgccccccagcgggttattttctgcgtctatcacgagaccgaggaactccgcttacgggcgaaaattgatgagtttgaaatcgccacccgccaggccggccacgaatgggccgcttttgatcttaccgacacctttgccgcctggctgacctcccagcgctacgctgcaagctattttcaaaaaccgcacctgctggccactctgttgcctaaatatagggcctatattggcgatcagtttcgggccttcctggctcagaacagggctgatgccaataccgtggtggctctcgccggcgtgggttcgctattcgggctgcaaaaggtcaaggatgttgtcgaggagctggcgcctctggtccccggccggctactggtctttttccccggcagctacgaaaacaacaattaccgactgctggacgggtatgacggttggaactatctggccgtgcccctcaccgccgacaaggaatggtaa

SEQ ID NO: 5453 - DNA, 615 bp, Enterobacter cloacae
atgagagcgaaactggacagtaagccgcaattgtcagctcgtctggaacaaatcgaagaccggcttaaaagtgaaggcttcctgaagaaccaagagctcggtggtgagatcggtttttatatctttgattacccacctcaatttgaacttaccgtacgggaatatctgagattgactctgcctcgcctagcccggcaggggctgaatttcgctcatctcaatctgttcgaagaggtactggcaattttgcaagagcgtaaattgttagataaatcttttgatctggaacgcaaaaaaggtaccgatgagctagccaaagcacttaaaggacctcttgaacaaggtcgaattgctaagcatctgatagataaagtgcttccggcctcgccacaatttgtattgttatcaggtcttggccaatgctggccattgctacgtggtcatagtttgcttaatgcattacatgcccatatgggggcaataccattggtattgttttatccgggcagttacaacggcctcgaactttatccttttgatctggacagcgcagaagtggcaacagccaactactaccgagctttccaactggtgcctcacgcatctaagtactga

SEQ ID NO: 5454 - DNA, 603 bp, Erwinia sp.
gtgatcgatcccgtgcttgaataccgcctgtcacaggttcagagccgcattagcgaagatcgctttctcaaaaataacggctccggaaacgagattggtttttggatttttgattaccccgctcagaatgagttacaggtacgtgaacacctgaaatatctgttccgtaatctggaaaaagactacacgttcgcgcacctaaatatctttcagatcattatcgacatactcaatcaacgtaggttatttgagcgcgtctgtcagcaggaagtgaaagtgggcacagaagcgttgaaaaaacagcttgtaggcctgctcaatcaaaagaagatcgccgatcacatagcaaaagaagtcgatcttaaaagtcagaatttcgtcatccttactggtatgggtaatgcctggcccgttgttcgtggacatgagctgatgagcgccctgcaggatgtaatgggttttaccccgctgttaatgttttacccgggaaagtacagcggacataacctggccccgttaacagatattgactcccggaattattatcgcgccttcaggctggtacccgaaagtggaccatcggcgacattgaatcctcgttaa

SEQ ID NO: 5455 - DNA, 603 bp, Erwinia pyrifoliae
gtgatcgatcccgtgcttgaataccgcctgtcacaggttcagagccgcattagcgaagatcgctttctcaaaaataacggctccggaaacgagattggtttttggatttttgattaccccgctcagaatgagttacaggtacgtgaacacctgaaatatctgttccgtaatctggaaaaagactacacgttcgcgcacctaaatatctttcagatcattatcgacatactcaatcaacgtaggttatttgagcgcgtctgtcagcaggaagtgaaagtgggcacagaagcgttgaaaaaacagcttgtaggcctgctcaatcaaaagaagatcgccgatcacatagcaaaagaagtcgatcttaaaagtcagaatttcgtcatccttactggtatgggtaatgcctggcccgttgttcgtggacatgagctgatgagcgccctgcaggatgtaatgggttttaccccgctgttaatgttttacccgggaaagtacagcggacataacctggccccgttaaccgatattgactcccggaattattatcgcgccttcaggctggtacccgaaagtggaccatcggcgacattgaatcctcgttaa

SEQ ID NO: 5456 - DNA, 603 bp, Erwinia pyrifoliae; identical to SEQ ID NO: 5455

SEQ ID NO: 5457 - DNA, 408 bp, Erythrobacter litoralis
gtgttggatttgaacctctttgatattgcactcgatatcctctctgagcgtgggattcttgaagaggtgctcgagattgaggccgacaccagcaagggcgagatcaaggaactactgcaaggggtcttagacccaaaggctcacctcgtcccacatatcggaaaggcaatcgaagccgtaccgcacgacgttattttcttgtccggcgttggtgaagtgtacccctacatccgctcacacaacgttttgaacaatctacagagcactgcaaaagaggcgcccaccgttctcttttttcccggaagctacacccatgcattggcgacgggtgcgtcgctggagctcttcggtcagctccatgacgacaagtactaccgcgccttcaacatcctgaattacgaggtctaa

SEQ ID NO: 5458 - DNA, 603 bp, Escherichia coli
gtgatagatcccgttcttgaatatcgcctgtctcaaatccagagtcgcattaacgaagatcgcttcctcaaaaataacggctccggaaatgaaattggtttttggatctttgattatcccgcacagtgcgaactgcaggtacgggagcatttgaaatatctgctccggcatttggaaaaggaccataaatttgcctgtctgaatgtcttccaaatcatcatcgatatgctcaatgaacgcggccttttcgagcgcgtctgccagcaggaagtcaaagtgggtactgagacgctgaaaaagcagcttgctggtccgttaaatcagaaaaagatcgctgattttatagcgaaaaaagtcgatctggctgcccaggattttgtcattcttaccggcatgggcaacgcctggccattagtacgcggtcatgaactgatgagtgccttgcaggatgtcatggggttcaccccactgctgatgttttatcctggcacctacagcgggtacaacctttccccgctcacagacaccggttcacaaaattattatcgcgctttcagactggtaccagatacgggacccgcagcaacattgaatcctcaatga

SEQ ID NO: 5459 - DNA, 603 bp, Escherichia coli; identical to SEQ ID NO: 5458

SEQ ID NO: 5460 - DNA, 603 bp, Escherichia coli
gtgatagatcccgttcttgaatatcgcctgtctcaaatccagagtcgcattaacgaagatcgcttcctcaaaaataacggctccggaaatgaaattggtttttggatctttgattatcccgcgcagtgcgaactgcaggtacgggagcatttgaaatatctgctccggcatctggaaaaggaccataaatttgcctgtctgaatgtcttccaaatcatcatcgatatgctcaatgaacgcggccttttcgagcgcgtctgccagcaggaagtcaaagtgggtactgagacgctgaaaaagcagcttgctggtccgttaaatcagaaaaagatcgctgattttatagcgaaaaaagtcgatctggctgcccaggattttgtcatccttaccggcatgggcaacgcctggccattagtacgcggtcatgaactgatgagtgccttgcaggatgtcatggggttcaccccactgctgatgttttatcctggcacctacagcgggtacaacctttccccgctcacagacaccggttcacaaaattattatcgcgctttcagactggtaccagatacgggacccgcagcaacattgaatcctcaatga

SEQ ID NO: 5461 - DNA, 603 bp, Escherichia coli
gtgatagatcccgttcttgaatatcgcctgtctcaaatccagagtcgcattaacgaagatcgcttcctcaaaaataacggctccggaaatgaaattggtttttggatctttgattatcccgcacagtgcgaactgcaggtacgggagcatttgaaatatctgctccggcatctggaaaaggaccataaatttgcctgtctgaatgtcttccaaatcatcatcgatatgctcaatgaacgcggccttttcgagcgcgtctgccagcaggaagtcaaagtgggtactgagacgctgaaaaagcagcttgctggtccgttaaatcagaaaaagatcgctgattttatagcgaaaaaagtcgatctggctgcccaggattttgtcattcttaccggcatgggcaacgcctggccattagtacgcggtcatgaactgatgagtgccttgcaggatgtcatggggttcaccccactgctgatgttttatcctggcacctacagcgggtacaacctttccccgctcacagacaccggttcacaaaattattatcgcgctttcagactggtaccagatacgggacccgcagcaacattgaatcctcaatga

SEQ ID NO: 5462 - DNA, 594 bp, Escherichia fergusonii
gtgcacaatatgaaggctctccagaccaggcttgatcttatacaggaacgaattgaaagccctaagtttttgaaaaacgatggcttgggcaatgaaattggattttgggtatttgactatccagccaagtatgaactgcttgtacgagagcaccttaagcacgttgacgaaaaactcaacaagcgtggttaccgctttgtccatctcaatatttttgaagtcttgatagatatgcttgaggagcgaggccttttcgaccgagcttgccagcgtgaattgcaagtcggtgttgatggtcttcgaaaaacactagccgggcctctgagccaagagaaagtggcaaggtatatcgcggacaaatataagccatcagaacttgagtttgtgttgctgtcaggcttaggcagtgcgtggcctcttgtccgaggacatgagttacttagtgctctgcaagacgtgatgggtagcacgccattagtgcttttctatccgggtgaatatagcggaagggatttgcatccttttggcatgatcgaatctaaaaactactatcgcgccttcaagcttgtgcctgaagacggtaaaaaaaattaa

SEQ ID NO: 5463 - DNA, 567 bp, Exiguobacterium sibiricum
atggcgaatttaaatgcaagactagatagtatcattccaaaaatcaaagaagaaaaatttattgatgggcgcggcttagggaatgaaattagtttttatgtttttgattatgaagcaaaggatgaacttattgttagagattatgtaaaacacataaaaaaagagttcaattatgagggaactgatagaagtatcattgaattcgatttgtacaaaatgcttatcgagattacaaaagaaaagcgtatctttgatcgcgtctttgatatggaagaacatcaaggaaaagatgccttatttagagctatgaccgcgtttgccaaaccggaagtatttgtacagaaaatcaaggaacagctagacgatcacaatgttgtatttctcactggcatcgggaaagtgtatccatttgtacgttcgcacaatattttaaataaccttcaagaagtattggataagacacccgtggtaatgtttttccctggaacatacgatggtcaatcattgcaattattcagtaagtttaaagacgataattattatagagcatttcgcttagttgattaa

SEQ ID NO: 5464 - DNA, 558 bp, Flavobacterium branchiophilum
atggcatatatagatgaaaataaagcaaagtttgacaatttaaagtctatccttgatgtaaaaaacagatcgcaattaagtttagtagctaatggtggttattcaatattattcacctatccaccgaaagaggaaaatttgtacatagaaaaagctaaaaaggaactaagttcaactaattttaagtttattgacgcaagcaaaatatttgttgattttattgatgattataatttagacaatcttattgaagtttataaagatttaaagcctaactcttataaaattttcatagacaatacaggaaccgacaaagatttttttgatgccattgttaatgaaatcattgaaacttcaaaacaaggattaatacccgttttaatcagaacaggagttttctacggaacaggtatagaaaatataaacattacacaacacagcaccattgatgaactcaatatgcctcttgtgatattttatccaggagaaattaacggagaccatcatcattatttaaatgcaaaacaatcatctaattacagatgcacaattatttaa

SEQ ID NO: 5465 - DNA, 576 bp, Gallionella capsiferriformans
atgagcgtatttgaagagcgtcttaaccaaatcctgccgcgtcttacctcgaaagagctgttgaacaacgaaggcctcagcaatgaaattggcttctgggtctttgattaccctcctgagttcgagctggaaatgcgttcatttctggctgacgtcatcgaacctgcacttgccaaacatcatccgccgatacgctttgccacggtcaatgtttttgatctggctatcggcttgctggaagagcgcaagttgctcgataaggcattcgatatgcagcaggcacaaggtgatgacaaagcacttgaatcgttgcggcgcgtcctgaaagaggacaagttggctgaacgcctcgtgtcccagatagatgtcgataatcaagacttggttattctgacgggtgtcggatctgcctatcctatattgcgcacgcacactttgttatcagctctgcatccgttgatgaaagacacgcccttgctgatgctgtatccaggtaaatatgacggctactccttccggctattcaacaaactttccgaagatcactactaccgcgcattccgcttggtatcctga

SEQ ID NO: 5466 - DNA, 555 bp, Gallionella capsiferriformans
atgagcttggcacagacaattttagaaaaacttaaggaataccttactcttccctggccgcagaatgtctctgctcgtgagcgagttgtgatggttgtatatccgccaaacgatgagcgaaaattaagacgcttactggagtctggcgaattttcaagggaaattgccaccaccgaccatgggtggactgagcttgaccttggtccagaattttccaagtggctggcgggaagtgaatatgccgaacgatatctgcagcgcccagaaagactttgggatgactcaggcaacattagaggccttagagaacaccttattcaccaagttgccgaaaaatgcaaagcgatgacctccaacgatgtactggctctagtcggcggtggcagtttgtttggattatttagcgtgtcatctttggttgagcaaattgaaagccacattcctggtcgcttggtgattttcttccccggtgagcatgatgcaaaaaataacagttaccggctcctcggagcaaaagacggctggggttatcttgccgttcccattacctgctga

SEQ ID NO: 5467 - DNA, 540 bp, Geobacillus sp.
gtggagattcaaaaaaaattagatcggttttttgaagagattcaaaaagatgaatttttgcagatgagaggattaggaaatgaagtaccgtatttcatttttgattacgaaccggaacatgagttgattgtccgccaatcgatccgatattttacgaatcggattcatttaaacattaaagtgctcaatttattgaaaatggttattgaactatttgacgatattggattagaagggttaaaacaatttgaggaagaacaaggaacggaagccttgtttgacgctttgcgcccaacgatcgaagaagaacagctagtagacaaaattgccgaagcggcagaacaagcacaaatcatttttatcaccgggattgggagtgtatttccattagtacgggctcatgaattgctaaatcaattgcatccgaaagtaaccaacgtgccaatcgttattttttatccaggaacatatacagggcaaggcctgagcctatttaatcgtttcgaatccaacggatattatcgggcattttctatctaa

SEQ ID NO: 5468 - DNA, 600 bp, Geobacter sulfurreducens
gtgtcatctttggaacagaatcttgatctattacgccaggatctggtcgctgagccaatgcggattgcggcccacagcgatatgcccttcgcgattttccgctactctccggaagaagagttccagctgcgcaagcgtctccgtttgctggcctattccctttctgagaatcatggccgcaaagtagcgttcctctcaatctcacgacttgtgtggggtatcgtgcgccggttcgagggtacggactatctcttcaaaactgagtccatcaggggattccaagctgctgaggaacatataaatcgtcttctcagttccgaagactaccgtcctatagccgatgaagtactggaacgtatcaaagggttcgatcacgaccgtgatatcgttttcctggtccgtgccggcggcttcgctccatttatctatcgctgctctagtcttctcgatgggctgcatcgcaggacaaaagtgccggtcattcttttttatccggggagcgctgaggctgggacggatctgaaattttttgacctcccttcggaggctaatctcggcgtgtacaactatcgggtcaaaatatacggagtggataaatga

SEQ ID NO: 5469 - DNA, 546 bp, Haliscomenobacter hydrossis
atgcaagcaaaaattgaccaactattggccgccttcgataaggttgtaaaagaaccttggtctaccgtgttgtcgggccaggagcgggtttggtttttggtgtacgatcctgctgagcagcgcaaagtggagctgcggctaggagattttgagacctacaccctcaaagcaggcaagcaatggcgcagcatttccctcaagcagtgtttcccagcctggatgacccaacacgactaccaggaggaatacttcgccaatcccgagtacatcgttgaccaactcgaagcggagttcatcccttttgccatccagtttttgcgcaaggaattgcgcaaactcgatcaggatcagcacaccctggtggccattaaggatgtatcggctttgtttggttttgcacgcctgtcggaggtactaaagggctgcgagaaggattttagcggacgtatgctcattttttttcctggggaatttcaacacaatcaataccgtttgctcgatgcccgcgatggctggagttatttagcaagacccattaccgtttaa

SEQ ID NO: 5470 - DNA, 549 bp, Halobacillus halophilus
atgaaatcgacatatgaacgcttagagcaaatggagaagaggatcaaccaggaaggattcacgaaccccaaaggcatcgggagtgatattcctcattttgtactggattatccgccgcaggacgagttgcaagtacgtgtatatttaaaaaacatgttgaaacgtaccaaggtaaatattagagaggtgaacttatttgagtttctgctctccttttttgaagaggatgaaatggaagaattgtatgaagtggctgaagaggagggtctacgtgggttaaatgatgtaatcgagccaattcttaacgagggtaatacaatgatccagcaatttaaagatatgacagaagaagcggagctaattttcattactggtgttggcacagcacaccctttcttaagatcaagccagttattaaaagctatttcaagtaaagggtacaagaagcctatcgtgcttttttacccaggggaatttacagggttaaggttgaagttattcagtattctggattatgaagatgactatcaactatctcgaatttcatga

SEQ ID NO: 5471 - DNA, 582 bp, Halobacteroides halobius
atgtctcggattcatgatcgtttagatgagatattgccacggattcaggaagaaagttttatggagggaaagggattaggtaatgaagtaggatattatgtatttgactatgaaccagaagatgaattattagttagggatcatgtacaatttgttaaagagaaaatgaataataaagaaatatatcctgatattatagaatttaatctgtatcatgtaatgttagatatattagaagataaaggttatttaagaaaaataatgaagatggaagagagtaggggaactgataaagctctaaatggacttaaatctagtttgcgattaaccagtagtggtagtaattctttggtgaaatatattacggataaggtttctgatgatcaaattgtatttataactggtgttggccaagcttggcccgtaattagatcacatactgtactcaataatttacaccaagtcttagatagtgtgccagtagttatgttctttcctggtgagtatagtggttctgaattaattttatttggaaagattaaagatgataattactatcgtgcttttagattggttgagtag

SEQ ID NO: 5472 - DNA, 603 bp, Klebsiella oxytoca
gtgatcgatcccgtgcttgaataccgcctgtcacaagttcagagccgcattagcgaagaacgcttcctcaaaaataacggctccggtaatgagattgggttctggatttttgattatcccgctcagaatgagctgcaggtacgtgaacacctgaagtatcttttccgtaatctggaaaaggaccacaagttcgcgcacctcaacatatttcagatcattatcgatatgctcactgaacgtggtttgtttgagcgtgtctgtcagcaggaagtgaaggttggtaccgaagcgctgaaaaaacagctcgttggcttgttaaaccagaaaaagatcgcagattacatagcaaaaaaagtcgatcttcagaatcaagaatttgtcattctgacgggcatgggtaatgcctggccgctggttcgtggccatgagctgatgagcgccttacaggacgtgatgggttttacccccctgctgatgttttatccgggaacctatagcggacacgatctctcccccctggcgggtattgattcccgaaattattatcgcgccttcagactggtgcctgaaagtgggccagcggcgacattgaatcctcgttaa

SEQ ID NO: 5473 - DNA, 600 bp, Lactobacillus amylovorus
atgactgagaatattaaagttaggatcgaacacttaaaagaaaaaatggacgattttaagtttcaacataacgaaggtttatcaaatgaagtaggctattatgtttttgattatccagcagatcaggaactttatatgcggaagcagattgataaaattcaagaaagcccccttgcagcaagagttaatctaaaagtatttgatatttatgacattatgatgcatttgctcaaggatcaagaaaaatatactggatctgatcctattccgattttagaggatattgagaaaaatcaaggattcgatgttttaatcgaacaaataaacaacattcttgaaatgagtgaaaataataatttgattgttggatatattaaagaaagaattccagaaggtgatggacaatgtattgtatttctgactggactaggcaaagtctatccaattattcgcgctcataaaattttaaacactatgcatcaagtattagataataatccagttgttatgttctatcctggaaactacgatgaaatgagcttgcgtgcatttggcgaaattaaagatcagaattactatagagcattcagaatagattaa

SEQ ID NO: 5474 - DNA, 585 bp, Lactobacillus casei
atgacattagtaagtgaacgctttgaccgatttcggaaaaaaatacgaaatcctgcttttcaggaaaatcgagggctctcgaatgaagtcgggttctatattttcgattacgatccaaaagatgagttattcgttcgtaatgaggtcgaagatattgcgcacaactcgaccactgcttcaattggtgcaaatgtccaagtgtttaatctgtttgatgtcgttattcgactgattgatgagatgggttatctgcaagagttcattcaaattgaagaaaaagacggtattgatatggtgattaggcaaatcaataatgtcttaaaaatgggtaaagaacgcaacttgatcgttcagtacatactggatcatctggaacatcgggatgagcgcaatattatttttatcaccggtgttggtcaggtgtttccactgattcgtgcccaccgtgtcttgaacacgatgaaccaagtgattaaccaaacgcctgttgtgatgttttatccaggcagttataacagtttgtctcttcgcgcgtttggcaaactagatgacaagaactactaccgtgcatttcgagttgaatag

SEQ ID NO: 5475 - DNA, 600 bp, Lactobacillus helveticus
atgaatgagaatattaaagttaggatcgaacacttaaaagaaaaaatggacgattctaagtttcgacataacgaaggtttatcaaatgaagtaggctattatgtttttgattatccagcagatcaggaactttatatgcggaagcagattgataaaattcaagaaagcccccgtgcagcaagagttaatctaaaagtatttgatatttatgacattatgatgaatttgctcaaggatcaagaaaaatatactggatctgatcctattccgattttagaggatattgagaaaaatcaaggattcgatgttttaatcgaacaaataaacaacattcttgaaatgagtgaaaataataatttgattgttggatatattaaagaaagaattccagaaggggatggacaatgtattgtatttctgactggactaggcaaagtctatccaattattcgcgctcataaaattttaaacactatgcatcaagtattagataataatccagttgttatgttctatcctggaaactacgatgaaatgagcttgcgtgcatttggcgaaattaaagatcagaattactatagagcattcagaatagattaa

SEQ ID NO: 5476 - DNA, 600 bp, Lactobacillus helveticus
atgactgagaatattaaagttaggatcgaacacttaaaagaaaaaatggacgattctaagtttcgacataacgaaggtttatcaaatgaagtaggctattatgtttttgattatccagcagatcaggaactttatatgcggaagcagattgataaaattcaagaaagcccccgtgcagcaagagttaatctaaaagtatttgatatttatgacattatgatgcatttgctcaaggatcaagaaaaatatactggatctgatcctattccgattttagaggatattgagaaaaatcaaggattcgatgttttaatcgaacaaataaacaacattcttgaaatgagtgaaaataataatttgattgttggatatattaaagaaagaattccagaaggggatggacaatgtattgtatttctgactggactaggcaaagtctatccaattattcgcgctcataaaattttaaacactatgcatcaagtattagataataatccagttgttatgttctatcctggaaactacgatgaaatgagcttgcgtgcatttggcgaaattaaggatcagaattactacagagcattcagaatagattaa

SEQ ID NO: 5477 - DNA, 600 bp, Lactobacillus johnsonii
atgactgagaatattaaagttaggattgaacatttgaaagaaaaaatggatgatcctaaatttcaacataacgaaggtttatcaaatgaagttggctattatgtctttgattatccagcagatcaggaactttatatgcggaagcagattgataaaattcaagaaagtccccttgcagcaagagttaatctaaaagtatttgatatttatgacattatgatgcatttgctcaaggatcaagaaaaatatactggatctgatcctattccgattttagaggatattgagaaaaatcaaggattcgatgttttaatcgaacaaataaacaacattcttgaaatgagtgaaaataataatttgattgttggatatattaaagaaagaattccagaaggtgatggacaatgtattgtatttctgactggattaggtaaggtttatccaattattcgcgctcataaaattttaaacactatgcatcaagtattagataataatccagttgttatgttttatcctggaaactacgatgaaatgagcttgcgtgcatttggcgaaattaaagatcagaattactacagagcattcagaatagattaa

SEQ ID NO: 5478 - DNA, 591 bp, Lactobacillus reuteri
atgtataaagaggagcaagtacattttgaaaaattgatacagaaaattcagaaacctgattttcaacgtaatcaagggttatcaaatgaagttgggtattatatttacccatataatgttgcagatacacctagggtgcgtgcaaatttagatgatcttactaagtctaaaacagcaatgaaaattaacctaaaagtatttgatttgtatgacattatgctggatagtattcataaattaaaagggatagcagatgatgatccatttcggattttagctgaaatggaaaagcaaagtgggatcgatcaagtagctcagcaaattaatagcttgatgcggatggatgaaaacaacaatgatgttgttatgtacgtacaggaccacgttgataatcagcattgtgtgattttcataactggtgttgggaaggtttacccgctgattagggcgcacaaagtgttaaatacaatgcatcaagtgttggataaaaacccagttgtgatgttttatcccggtaagtataatgaacaaaatttacaaatttttggtgaagctaacgaccaaaattattatcgtgcatttttaatctag

SEQ ID NO: 5479 - DNA, 585 bp, Lactobacillus rhamnosus
atgacgcaattaagtgaccgatttgaccggtttcgcaaaaaaattcgcgatcctgcatttcaagagaatcgcgggttatcaaatgaggttggtttttatatctttgactacgaccccgaagatgagctgtatgttcgaaatgaggtagaagatattgctcatgattcgacaactgcttcaattggcgcaaatgtccaaatgttcaacctttttgacgttgttattgatttaattgaccagatgggatacttgcagcaatttattgagattgaaaaagacgatggtatcgatatggtcattcgtcagatcaataacgtgctaaaaatgggagacgagcgtaatctgatcgtaagctatatcttggatcatctcgaacaccctgaggagcgaaacatcatcttcattaccgggatcgggcaggtgtttccattgattcgtgctcatcgagtcttgaacaccatgaatcaggttattgataaaacgcctgttgtcatgttttacccagggagctacaacagtttgagcttacgtgcttttggcaagcttgatgacaaaaactactaccgtgcatttcggatcgaatag

SEQ ID NO: 5480 - DNA, 585 bp, Lactobacillus rhamnosus; identical to SEQ ID NO: 5479

SEQ ID NO: 5481 - DNA, 579 bp, Leuconostoc kimchii
ttgagtgaactgactgagaaatttgaaaatttgaggcacagactaaaagtggacggcttaacagcccatcacggtctttcaggtgaggtgccatactttatccttgattaccgtcctcaagatgagttgtatgtacgtgatgagactaatcaaattgtcaatggcggaccatatggtgagcatcaaatgaatattaagctgttcaacttgttcgatattatgatggatactctgaatgaatttgggtatacggaaataatttatcaattcgaaaaagaacaagggatggactttgttattgagcaaattaacaatttaatggctacaaacgaagaaaataatcgatttgtcgaatacattaagagtcgagttaatccggatgaggatattatctttattgaggggattggacaaattttcccgcttgtccgtacacacaaaattttaaatacaatgacacaagtgattgactacatgccagttgtgttgttttatcctggaaagttcgataacattaaactaagtatgtttggcgagttaaacgacgataattactatcgagcaacacaaattaattaa

SEQ ID NO: 5482 - DNA, 579 bp, Methanobrevibacter smithii
atgaatattgatgagaagcttagtaaaattgaaccaaaaattaaagagccttcatttcttgagaataaaggtttaagtaatgaagtaggttattatatttttgattatgatccgaaatatgaacttaaagttcgtgaagaagtttcaaggattaaaaataaaatcaataattcaagttatgcatttactattaaagaatttgatttatatgaaattatcattgatattttaaatgaaagaggttatttagaaaaagtttttaattttgaagaaaaaaaagggatagaatttacaactaaagcaattatcagtcttttaaaattaaattcagataacaataatgttattgtaaactatattttagagagaactccagataactgtgttgtatttttaactggtgttggaaaggcttatccaatattaagatcacataatgttttaaataacttacatcaaaagttagacgaggttccagttgttttatttttcccaggacaatattctggtagagaattagttttatttaatactattgaaggaagtaactattatcgagcatttccattgattaggtga

SEQ ID NO: 5483 - DNA, 546 bp, Methanoculleus bourgensis
atggttatgagtaagattgacgaccttcttgaagtttacaggacgcaagtttcgttgcaatggaatgagatgctctccggacaggaaaaggtctggttctgcgtctacgatccttcctacgagcggcgcatacgcgctcgtctcagcgaattcaagatagttaccgtgcagtccgggcacacctggcaggaggtcgatatcaccgggctgtttgagaattggctggcagggaacgagtaccgtgaggacttcttcacggatccgtcactgctcaggtacgaccttgatgactttgttgcccgcctcgcagatcaccttacagagaagataagatctgctgaaaattcaaccgtggtcgccgtaatcgggattggcagcctctatggaatcgtccgggcaagtgcagttatcgaccgcctggtcagatccacggacatccccggtcgcctgatgttcttctttccgggggaccgggataggcgcaattatcggctgctgaaagcccgtgatggatggagctacctcgcaacgcctattgaggcgtag

SEQ ID NO: 5484 - DNA, 582 bp, Methanolobus psychrophilus
atgaaactcgaagagagactcgaacttctaaaagaagaactgcaaaaagaagatttcttaaaatcaaggggtcttggcaatgaagttcccttctggatctttgattatcctcctgagaaagaacttcttgtaagagatactatcacaaaaatcacagcgaacctggaaaagagatcgatcccggtgcttgaaatcaatctttatgatgtatgtcttgaaataatagaagctaaaatatctgctgagaagataactgcatttgaggagagcaaaggctctgatgaactgcttaagaaattaaagttaatgctgaagcctgatattttgaaaagtgccatccagcagaaaatgaatgagaatggtggttttcagctgatatttctgaccggcgtgggtaaggcctggccgatggttcggtctcatactattcttaataacgtacagcctcttcttggtaatataccgcttgttacattctatcccggcaagtacagtggttttgatcttagtctattcggaaaattcagggatgcaaattattatcgtgctttcaggctcataaacacggacagggtttcttaa

SEQ ID NO: 5485 - DNA, 591 bp, Methanomethylovorans hollandica
atgctgcccatgaagctggaagaaaggttagagcaactgaaggagcaggtccagagcgatgattttctcaaatccaaaggacttggtaatgaagttcctttctggatattcgattatcctcctgataaagaattgctgattagggatactatccttaagatcaactcatctctggagaagagatccattaacgttctaatgctggacctgtatgagatctgcctggagctcatagagaataaaataaaaatagaacaggtcgatcagttcgaaaagaaaaagggttctgatgaattgctcaagaaattgaagctcatgcttaagcctgaaatactgaaaaatgctattcaggctaaaatggagaaaaatgggaatttccagatgatcttcctgacaggtatcggtaaggcctggccgatagtgcgttcacattccattttaaacaatctgcagcctgtatcgggcaatcttcctcttatcgccttctatcccggcaaatacagtggttttgaccttagtttattcggtaagtttaaggatgcgaactattatcgtgccttcaggctgatcaatgatggcaccgatccttag

SEQ ID NO: 5486 - DNA, 591 bp, Methanosarcina acetivorans
gtgctgtattctaaatttatgaaacttgaagagcatctggaactctttaaagaaaaaataaaaacaaaggattttctggtatgtaaaggcttgggaaatgagatcccatactggatatttgattatgagcccgaaaaagagcttctagtcagagacacaattgaaaagatggtcacaagctttgagaccaaatattctcttaaaataattgaaattaacctgtacgatctgtgtctcaaaatactgagtcagaagctgagcgatgaaaaaataatccagtttgaaaagaaaaagggttcagatgccttacttgaaaaaattagattaattcttaaccaggaagccacaaaaaaagaaatctccgagatacttcagggagactatgacattattttcctgacaggagtaggaaatgcctggccaatagtcagagctcattctgtccttaataaccttcattccgttacaggcaaaaagcctcttgtgatgttttaccctggaaaattcagcgggcttgacctgagcttattcggagagttcaaaagcaagaactactacagagctttccgattaatgccagaggcaatgtaa

SEQ ID NO: 5487 - DNA, 573 bp, Methanosarcina mazei
atgaaacttgaagagcgtctggaactctttaaagaaaagataaaaacaacggattttctggaatgtaaaggattgggaaatgaaatcccatactggatatttgattatgagcctgataaagagcttctagtcagagacacaattgaaaagatggttacaggctttgagaccaaatattctcttaaaataattgagattaacctgtacgatctgtgtctcaaaatactaagtcagaagcttagtgatgaaaaaataacccagtttgaaaggaaaaagggttcagacgccttacttgagaagataagacttattcttaaccaggatgctacaaagaaagaaatctccgagatacttcagggaaactatgatattattttcctgacaggagtgggaaatgcctggccaatggtcagagctcattctgtccttaataaccttcattccgttacaggtaaaaagcctcttgtgatgttttatcctggaaaattcagcgggcttgacctgagcttatttggagaattcaaaagcaagaactactacagagctttccgcttgatgccagaggcaatgtaa

SEQ ID NO: 5488 - DNA, 555 bp, Methanospirillum hungatei
atgactaatattgaaaagttactagacgtctttggtaagcaggtttcaattccctgggatccccgagctgcacctgaagagaaggtgtggttttgtgtctatgatccttcagatgaacgtcggttactgagaaggatagatgaatttggcctggcaactgaaagagcaggccatagctggcttcttattgatatgttcacattttttgatgaatggtgtactgtccacccctacagggaagaatttttcaaaaatccgacacgtctaaaatctgcagaaaaaatgttccttcaattcatcatcgaacggttatcacatcagtgggataaagacgacaattcaaagataatcgctatttcagggacgggggcactttttgggataattcggttgagtaaattgattgaggagatagtgaagaaacttcctattcctggcagattattagtttttttcccagggagtcatcgggggtattgctaccagtttatgaatgatcatgatgggtggaattataaggcatttccaattgaagtaaaggatgaagacgagtaa

SEQ ID NO: 5489 - DNA, 579 bp, Methanospirillum hungatei
atgaatactgaggcccggatggaacttctcaaagggaaaatcgttcgtgaggattttttaaaagcaagagggctcgggaatgagatccccttttggatatttgattacccgccggaagatgaacattttgtcagatattcgatacggaagattcaggaaaaactgacttctcgctctattcattatatggagatagatctgtatgaattatgtctagagatcattgagagcaaaatatcatcagataagatcaatgaatttgagaagaataaagggtcggataaattattaaaaaaattgcagattattctgaaaccagagaatttaaagaatgagattcagcagagagttgtttcagaggacgcttttgagttgatattacttaccgggataggaaaagcctggccacttataaggctccactctattctcaacaatcttcaaccggttctgggaaatattccgttattagccttttaccccggtgagtataccaattcggagttgagtcttttcaggaaattcaaagatgcaaattattaccgggcgtttcggatgattgacgaaggaactgcataa

SEQ ID NO: 5490 - DNA, 600 bp, Microlunatus phosphovorus
gtgacggttcatgatctcactcgccaggaggagcacctgttcgcggtgctcagcggtgagcgcttcttgaagatggagggcctgtcgaacgaggttccgttcttcatctacccctacgagcccgagcatgccctcgacgtggcgaaggcgaagaagcgagtcaagaaccggctggcgagcaggggcatcgaggttcgtgaggtcaatctctacgacctctcggtcgagatcctgaaggagcggggcgactgggatgaagtgctcgaggtcgagcccgagctggacaaggccgagttcaccgagatgttgcagtcgatgctcaacccgcagcaccacctcgcccccgcgatccgagatcgcctcgctgatggtggtttcgacattgtgttcctgaccggaatcggcgaggtcttcccctatatccggtcccacaacgtgctcaacaacttgcagagcgtcgtggtaggccggccgatgctcatgttcttccccggccgctacgagcagtccgacactctcggctcctcgctggtgttgttcggcaggttgaaagacgaccagtactaccgcgccaagaacattctggaacaggaaccgtga

SEQ ID NO: 5491 - DNA, 561 bp, Moorella thermoacetica
gtgagcagaattgaagaactggcaaaccgctatcgtaatcatattgctgcgccatggcagcataacttggccggtgagcaaaagacgatttttgttgtctatcctccagtcgatgagcgcaaactccgggctaggttagaattgttcgaaatggcaacaattgcctccgggcataaatggaaatcattcgattttaccccgacctttgcccaatggatgagcaagttagaatacagggaggtttatttcgaagagcccgaaagcctggcgttaccccttgagactgaatttctatattttgccgctgatgaactccgtaaagtacttgccggtgaagatgttgattctgacactgtagttgccgtttatggcgtcgccagtctgtacggattcgccagtgtatcggcgattctaaaagaagtagtaagggatattcgggggcgattggtagtcttttttccgggcgaatatgaaaacaacaattatcgtttgctcaatgcgcgcgacggatggaattacctggccattcccatcactttacataatggggtgaacgattga

SEQ ID NO: 5492 - DNA, 603 bp, Parvularcula bermudensis
atgacagccaagatgaaccagaaagagcgcatcgatcacctcttcagtgtggtgaccagcgaacggtttttgtccaagcagggcctcggaaatgaggtgccattcttcatttgcccatatcctgctcgggaagggctaacgatgcatcgtgaccgcgagggcctcgccaaacgtgtaattcacgcaggagtccgggtactggatctaagcctttacgatctgtcgctagagatccttgccgaaagacgtgtcctggaagaagtccttgcgattgaatcgaacgcggaaaaggatgagctccgagagctcctccagggcgtgcttgatccgcaggcgcacttgatccctcgaattggtgaagcgatcgcctctcaagcgcacgacgtcatttttatttccggtgttggcgaggtctatccctacatccgatcgcataacgtgctcaacaatctgcaaagcacagccaaagacaagccaaccgttatgttctttcctggagaatatacacatggattggcaacgggcgcatcgctggatctattcggcctgctccacgacgataaatattatcgagccttcaacattatgaactacgaggtctga

SEQ ID NO: 5493 - DNA, 603 bp, Pectobacterium carotovorum
gtgatcgatcccgtgcttgaataccgcctgtcacaggttcagagccgcattagcgaagagcgctttctcaaaaacaacggctcaggtaatgagattgggttctggatttttgattatcctgctcagaatgagctgcaggtacgtgaacacctgaagtatcttttccgtaatctggaaaaggaccacaagttcgcgcacctcaacatctttcagatcataatcgacatgctcaccgaacgtgggctatttgagcgcgtctgtcagcaggaagtgaaagtcggtaccgaagcgctgaaaaaacaactcgttggcttgttgaatcagaaaaagatcgcggattacatagcaaaaaaagtcgatcttctaaatcaagaatttgtcatcctgacaggcatgggtaatgcctggccgctggttcgtggccatgagctgatgagcgccttgcaggacgtgatgggttttacccctctgttgatgttttatccaggaacctatagcggacacgatctctccccattggcgggcattgattcccgaaattattatcgcgccttcaggctggtacccgaaagcgggcctgcggcgacattgaatccccgttaa

SEQ ID NO: 5494 - DNA, 576 bp, Pelobacter propionicus
atgaatgaagctctgaaagaacgactcaataagattcttgatcggataacctcacccgaatttctgagcaatgcagggcttggcaatgaaatcggtttctacatctttgattatccatctgaagcggaacttgaagttcgccagcacgtcgagtttgtcatggacaaggcatcaaagcggaagcctgaattgcgaatcgcccatgtgaatttgtttcagcttctggtggattacctgaaagaacgcggacttcttgaaaaggccctcgccatgcagaaggacaagggtgacgaggctatgttcaaggctctgagaggaccgctgcatgaggaaaaaatcgccaaggaatttgccaaggcagcgcagcccgaaagccatgatttcgtcttcatgaccggtgtgggcaatgcctatccgctgcttcgctcccatacgttgctgaataacctgcatccgctcatgggaggaaccccgctggtggtcttctatcccggatcatatgacggccagggtttgagccttttcggtaagatgaaagacaacaattattatcgggccttccggctcgtcgtgtga

SEQ ID NO: 5495 - DNA, 594 bp, Pelodictyon phaeoclathratiforme
atgccatttctcactgaacaaaagcagaaattcgatgatcttcgtgtggttttacatgaagacaaccggacgcaactaaagcgaacggcaaacggtggaaacaccgttttatttgtctatcccccggcagaagaggaggagtatatcgctaaggcgagagaactctatccggacggttattttattgatatcgcggagctgtttgtcaaaagcattgacctgcttggtgatgaatacaacagcgtcaacggaacagacaaggagcgtaaggcgctggagggtttcaaggcattttaccgcgagaacagcagcacctcattcaaggtgttcacaaacgaatacccaaactgcctcttctccttgattgtcacggagatatgccaggcaagccgtgttgaaaaaacagcctttctcattcacaccggcgctcttgaaggtaccggcattgagaatgtcaacattatggaacacaaaaccgtgatgatgcagggtataccgcttgtcatcttctatcctgccagctacatgaacaacgaactgctcttcctcaaccataaacaggcatcaaactaccgatgccatcttgtcaaatag

SEQ ID NO: 5496 - DNA, 582 bp, Polaromonas sp.
atgacgctgagttttgatgaacgactgaatcaaatcctaccgcgggtgacctcgcgggattttctcgacagcaagggcttagggaacgaaatcgggttctggatcttcgactacccgcccgaccacgaaatggcggtgcgtgacttcatctcgggcatcctattgcctgcgctcgtcaagcgccaaccacccattaacgccgggacagtcgatcttctccaattggtaacagggttgctggaagagcgcaagttgctcgacaaagcaattgaaatgcagcaaagcaagggcgacgacagcacacttgccgcgctgcgctccgtgctcaaagaggacaagctcgcccagaagatttccacccaattcgacattcgcggtctcgacctcatgattatttccggcgtgggcagcgtctaccccatgctcagaacccacaccttgctttcggccctgcatcccatcatgggcaacacgccgctgctgatgttctttccgggccgttacgacgggcactccctgcgcttgttcaatacgttggcggaagaccactactaccgggctttccgcctggtgcccgaataa

SEQ ID NO: 5497 - DNA, 573 bp, Pseudomonas brassicacearum
atgtcatcgctcaaagctgatttcaatgagttgatggagcgaattaagcaggggcgcgagtttggccatgccagcttcgagcccattttctatttggtttttccgccaaatcagatcctcaatgtgaagcgcgaaacacccgcgtggatgcaccgactgcgtaacgaaggctgggaagtcgaaaccttttcgatcgccgagcatgttgcagacattatcgagaaggcaccgcttcgcaagatttggctcgcggccgatcagaaagcacccttggcatgggacaagaccaatgcgtcgctcgctaatgccatcagtaatggcgcgttacaggcacgcattgaagccaagctggccgaacttgaaggcaagcctaaggccattttactagtcaccgatcttgaggcgttgcatccctacacacgcatcggtgtcatcgaaggcaagttgcaaggcaaattccatgtacccacggtgttcttctaccctggtgtgcgcaccggcaagacacgactcaaattcctggggttctaccccgacgatggcaactaccgctctgtccacgtcggcggctaa

SEQ ID NO: 5498 - DNA, 591 bp, Pseudomonas stutzeri
atgccgatgcaggacagatttcagcatctctttgctgtgatctcgggccaacgttttctcaataagcaaggtctcggtaacgaggtcccgttcttcatctgtcccttcaaaccggaagagtccgtcgaaatggagcggctccagcgtcagctgatcaatcgccttgagcaggccggtgttcggattctggagatcaatctgtatgacctttcaatagcaatccttaaagagcgtgacatctgggaccagattgtcgagatggaggattctgtctcaaaagagcagctaaaggaactgttgcaaggtgtgctggacccagaagcgcatcttgttccggccatcgcagccaagctggcaagcacggatttcgaggttctttttctatccggcgttggcgaggtgttcccctacatccgctcgcacaacgttttgaacaatttgcagagcaccgcgaaagaaaagccgacggtcatgtttttcccgggagcctatacccactctctggagtccggagcatcgctcgatctcttcggaaggctgcatgacgacaagtactaccgggcattcaacatctttcactgcgaagcctga

SEQ ID NO: 5499 - DNA, 612 bp, Psychrobacter cryohalolentis
atgactatgagcaacgtacaagcatgtgataaaaaaagttatgaccatcttttttctgtcatttcaagtgagcatttccttaagatgcaaggtctagggaatgaggttccatttttcatttgtccttttaggcctgaagaatcaaacgagatgctacgtcttgaagaccaattaactaagcagttacagaaaaatggtatcaatatcttggctataaatttgtatgatctgtctatagagctacttaaagagcgcgagatttttgatcagatactagaagtggaacagcagattgacaaagaacagctgaaagagttgcttcaaggagtcttagatcctgagtctcatttggcaccagcgattgccagcaagctaagtagtacagaatacgatgttctttttctatcaggtgttggtgaggttttcccgtatatacgttcgcataacgttttgaataacttacaaagtacagccaaagaaaaaccaaccgttatcttttttccaggagcctacactcattctttagagtctggcgcatcgcttgatttatttggcagactgcatgatgacaaatactatcgagcatttaatatttatcactgtgaagcataa

SEQ ID NO: 5500 - DNA, 600 bp, Rhodococcus erythropolis
gtgactcccaccgaattttcaaggcaagaggagcacgtgtttgccgtgctcagagggaaacgtttcctccagatggagggcctgagcaacgaggttccgttcttcatctatccctacagcccagagaacgcccttgcggtcgccgggtccacgcgccgcatccagaatcggctacgcaacgagggtgtcgaggtacttgagatcaacctctatgacctgtcggtggaggtcctcaaggagcgcggggtctgggaccgcctgctcgcgctggaaccggagcaggacaaggacgacttccgtgagctgcttcaggggatgctcgatccgcagctgcacctcgcgcccgcgatccgcgccaaactggccgaaagcgacttcgacattttctttctcaccggtattggcgaggtctttccgtatatccgctcgcataatgtgctcaacaacttgcagagcgtcgtgacgggcaagccgatgcttatgtatttccctggacgttacgaacaatccgacacgttggggtcttcgctcgtgctgttcgggcgactcaaagatgaccagtactaccgagccaagaacatcttggaacaggaggcttga

SEQ ID NO: 5501 - DNA, 576 bp, Rhodopseudomonas palustris
atgaccgacttcgagaggcgactacgcagcgacctcgagccgcacctggcggcggaggatccgcgcgccaagatcagcgcgtaccacgacatgccgtacgcactgttccgctacgatccggagcaggagttcgcgctgcgccgggaactgacgatgctcgcgacccgcctgacccagaagggcaaacggatcacgcgcatctcgctggcggaatgcctttcggaggccatgacctcgcaaaggccgctcgaggattggtacgttgccgagcggtccggcacggtcgaggagaccgtgcagaccatcaccaacatcctcgaggagtacgcgccgctggtcgatctcgtcgccgcgcgcatgccggaggatccggacccgaaaaaggacatcgtgctgatctcccgcaccggggctctgtttcccgtctaccgcaccttctcgctgctggagcagctgaagggccgggtacacgtgccgaccatccttttctacccgggagacctcgacggcgctgcggggctgcgtttcatgggcgagctcgacgccgaacacaattatcgaccgaagatcttctga

SEQ ID NO: 5502 - DNA, 549 bp, Saccharophagus degradans
gtgagcaagcttaaacgccttgtcgaaaactatggcaactacatcgcaacaccctggagtgaagcggcagcagctcagcgtgtcattttctgtgtgtataacgagaatgatgagcttcggcttcgggtctccattgatgagtttgaactggcaaccaaagcaaagggccatcaatggtgtcactttgatcttaccaatacctttgctgattggttggcaagtcaaaaatatgccaagagctattttcaaaaacctcagctgatcaacacgctactgccaaaatacgccgaatacatcgccgctcagtttaaagagcacattgccagcgccggagccgacaacagcaccgtcgttgccgtgtcaggggtgggcagcttattcggttttcaaaaggtgaaagacatcgtcgataagctagcgccaatggtgcctggccgcctgctggtgttttttcctggcagctacgaaaacaacaattaccgattgctcgatggttacgacggctggaactacctcgccgtgccaatcaccgccgaaaagatttattaa

SEQ ID NO: 5503 - DNA, 603 bp, Salmonella enterica; identical to SEQ ID NO: 5418

SEQ ID NO: 5504 - DNA, 603 bp, Salmonella enterica; identical to SEQ ID NO: 5418

SEQ ID NO: 5505 - DNA, 603 bp, Salmonella enterica; identical to SEQ ID NO: 5418

SEQ ID NO: 5506 - DNA, 603 bp, Salmonella enterica; identical to SEQ ID NO: 5418

SEQ ID NO: 5507 - DNA, 603 bp, Salmonella enterica; identical to SEQ ID NO: 5418

SEQ ID NO: 5508 - DNA, 603 bp, Salmonella enterica; identical to SEQ ID NO: 5418

SEQ ID NO: 5509 - DNA, 603 bp, Salmonella enterica; identical to SEQ ID NO: 5418

SEQ ID NO: 5510 - DNA, 558 bp, Selenomonas sputigena
atgagcaaactgaacgagcgccttgacgcccttcggaagctggtgcagagtcaagattttctcaacggaaaaggactgtccaacgaggtcaatattcgcattttttgttatcatcccaaggatgaaatggctgtccgtcattttacggaaaaattgacggagggtgttggcacgggctgccgcatcatagaatacaacctttacaaagtgtttcttgccatttgcgaggataagcgcatcgcggacaaaatccccgatttagaaaataaaaagggacataaattcgtcttgggacacctggcgcgtatagcaaacaatctcgcctttatcgaaaaaatgaaggctgagcctcataacgtcggcgatgtcattctcatcacgggcgtgggagaggcgtttccctttatccgtgttcatgcgcttttggatgccatgcagccgcatttttgcgatgtgccgatcctggtcatgtacccagggacatttgacggccgctatgtaagattgttcgacaagctgacacccaatccgtattatcgagcctttaatgtagtgtag

SEQ ID NO: 5511 - DNA, 543 bp, Shewanella sp.
atgtccgacagacttaccaaattacttaacagctttagcaaccatatcagtgtgccctggagtaacaccatctccgccgaggaaaaagcaattttcgtggtgtatgacaaggccgatgaactcaagcttagagcacgattgactgaatttgaacaggccagtatagaggcccaacatccatggttattgctcgatttaaccaacgcctttgccaactggatggccgagcaggattacaaagaaggctattttgaagaccctgaatacctcgaaggtagctacgactactttgctgatgaactagtgaaattactgagcgctgaaattaacaaccagcaaacggccgacactgtcgtagcgttaatgggatgcggtgcgctatttggcttcctgtcagtatctgcactggtcaaatcgctggctgcgcaggtgaatggccgcttggtggtgtttttccccggagaatatcacgacaataactacaaattacttgatgccaaggatggatggggctatcaagccaccgctatcacagccgtttaa

SEQ ID NO: 5512 - DNA, 543 bp, Shewanella sp.
atgtccgacagacttaccaaattacttaacagctttagcaaccatatcagtgtgccctggagtaacactatctctgccgaggaaaaagccattttcgtggtgtatgacaaggccgatgaactcaagcttagagctcgattgactgaatttgaacaggccagtatcgaggcccaacatccatggttattgctcgatttaaccaacgcctttgccaactggatggccgagcaggattacaaagaaggctattttgaagaccctgaatacctcgaaggtagctacgactactttgctgatgaactggtgaaattactgagcgctgaaattaacaaccagcaaacggccgacactgtcgtagcgttaatgggatgcggtgcgctatttggcttcctgtcagtatctgcactggtcaaatcgctggctgcgcaggtgaatggccgcttggtggtgtttttccccggagaatatcacgacaataactacaaattacttgatgccaaggatggatggggctatcaagccaccgctatcacagccttttaa

SEQ ID NO: 5513 - DNA, 603 bp, Slackia heliotrinireducens
atgtctgcggaattcgagcacatcaacgatgcacgctccttcatcgtcgagaagctttccgagaattctctccttggcaggggcggctacatgatgagaaacgcgctctacgtcctggactacaaaccagaacaggaaccctacgcgagggacctcgtgcgggcgatatgcgaatccgacctgcctgcccgttcggtgcgcccactcgtcgtgaacctctacgacatcgtgctcgcattcctcgacgaacagggcatgtgggagccccttgtcgaggcggaacccgatgcttcgcgcgaggagctcatcatgatgctccaggacaccgtcagcgtgcgcgacgtcatagccccggcggtcaatgcggccatcgaggataacccggacgccgacatcgtgttcattactggcgtcggggagacctatccgtacgtgagaacccacacattgcttcaagagatgagcgccacgaagcccgtagtcctcgtgttccccgggcgcttcgagcgccgcagcgacggctccacctcgctgaacatactcaacctcgaccagggtacgaccggaggctactaccgtgcgacccgagtattcgacctgtaa

SEQ ID NO: 5514 - DNA, 609 bp, Spirosoma linguale
atgacaggtcaatttgatcaactttatcataaactaactgaagtgacattccaggatccggctaccggaaacttgtttttccctgtctatctcttcacctacacgccaaccgaagaatatagtgtccgtgaacaaatctcagccttaggcgagcgactccttcgaccctatggtcagaatgaagtactcgtacttaatctattcgatgcatttctggactacctacgggctgacgactacggcgatgagactttactggacatcctgcttgataaagaacgtcaggaaggctatttaggcgatattgacgagttacttcgtaaaaaagcgggtgaggaggagtttatcagctttgtggcccatcgtattcgcacgtacctgaatttgccctctcaatttccacgtgttttcgttctcctgcacggttttggcagtctgtttcccttattacgggttagcacttttctcaacaagttcgagcggcatgtcgtcggctttaaattgattgtcttttacccaggtacataccaacatcaacgctacgtacttttcaaccaactccacgatgaacatttgtatcgtgctatccacctgaacgccttgctctaa

SEQ ID NO: 5515 - DNA, 600 bp, Sulfuricurvum kujiense
atgagtcctgacgtcatcaaaaagaaattcgaccatatttacgcccaggtttccactcctcagttcttacggatggaagcgcttggcggggaagtaccatttttcatcacctcatacgatcagcgcaacgccgatgtgatcgatcaggagatcggccgactggccagccgaatgcggatggagggaatatcggtggcactgatcgatctctttgacgttgtgatcgctatcctcgaagaaaaagagctccttggtcccatcctcgaaaccgaagcggatctagccaaagacgaactcttcgaccttttctctggagcgctcgatgtacacacgtaccttgtcccgaaaatcgaggaactgatccgggaaaaaggggatgcccagatcgtctttctcaccgggatcggagcagtatacccctatatccgctctcacatcatcctgaacaatctccaaaacgccatcaaacacatcccgacgctgatgtttttcccgggcgtttacaacaccgtctcgctcagcctcttcggacggctcaaagacgacaactactaccgtgcattcaatctcgatacactcaacctcaaggaacgtaaatga

SEQ ID NO: 5516 - DNA, 600 bp, Synechococcus sp.
atgtcctcgctcaaagatagcattgctcctctcgaaagcgactttaagtctgatcccccgcgtatcaatgtttaccatgatctcccatttgcgatctttagatacaacccaaccgacgaatgggagcttcgtcgggaaattaagttgctagccactcgccttgaagcatttggcaagacagtccacacaatctcgatgtctgaattgttctggactgcgatggaaagggttaatcagaaagatgaagacgagggtttggatgcgatcttcagcttagaaaaagatcggggatacgttgaggctcaacagcaggtcacaacatacctctcaaacaaagtctggataccgctctgggacttattggctgaacagcttacacccatcaaccctgataactctgtggtctttctcactcgcattgcagtcatgtccccaggtattttccatatgtcaacgctgctcgataaaatgcatggcaagaccagagttccaaccatcctgttctaccctggctccattgacggcacaacggggcttcggtttatggaactgaaagatcatgatgcattaggtaactaccgggtaaaaatatacggctga

SEQ ID NO: 5517 - DNA, 558 bp, Syntrophomonas wolfei
atgaacttggttaatcctgaaaacatggttttgaccaccatacggctggttgagtccgatgaaaaatcacatattcgtttaagtgccaatggcggtaattcaatattactggtatgtgagccagaccgggaaatagattatatccgagccataaggaaattaatgcctgaggataaataccagatcattgatttaagcgatttgctctgtcaatttgtcgagcagaacaaatccaacctggaagaaatgtttaacctgctgcaagggtcgctgcatcaaatatttaaaaccccggccggagaagaaggcagcgattatttagggttaattctgcaggctgtcgatagcagcttaaaagcagataagatcccggtattgattaacaccggtactttgtacggcagcggaattgggagcatacatattgtagagaacgatttagtaatgcgggccaaatcacctttaattattttatatccggccacctgggttcaggatatgcttatgtttttaggaaaaagaccggcatccaaatacagatgcatggtgcttaagtag

SEQ ID NO: 5518 - DNA, 567 bp, Syntrophomonas wolfei
atgaacagcaccagcaagcgattagagcagattatccccaggatacaatcggaatcattcattcaaaataaaggactggggaatgaaatcggtttttacatatttgactatgaccctgccgatgagatgctggttcgggattatattaaacatataaagagcaaatttaactacgaagggtctaatcgcagaatcatagaatacgatttgtacgaaattctgctggacatcacccgggagaagaagattttcgagccaatactattaatggaagaaaaacggggacaggcccagctggccgatgccattatgcaagctgccggttttgaggactacatcaataaaatgacttttgagcaaaagccgggcaatgtactattccttactggggtaggaaaagtttatccctttatgcgttcgcacaaaatcttaaacaatctccatcatgtgtttgaccaactaccggtggtgcttttcttcccgggcagttatgatggacagtcgctgaaattgttcaatcgttttcaagatgaaaattactatcgtgcttttcagttagtgaaataa

SEQ ID NO: 5519 - DNA, 561 bp, Syntrophus aciditrophicus
atgggaagaatcgaagaactggcaacgcgataccgtggccatatcggtgcaccatggcagcgcaacctcgccggtgaccagaaggcaattttcgttgtgtatccgaaaacagatgaacggaagttacgggcgcggctggaactattcgagatggcgactacctcgactggtcacggctggcgcctgctggacataggcgacacgttcgcagggtggatggcgaacactgactatcgcgaggcatacttcgaagacccggaagctttggcgatgaagctacggagcgacttcgttcaggacgccgctggcagaatccgtgaaatacttacggccgaagggactgacgaagataccgtggttgctgtccaaggcgtcgggtgcctcttcggcttcacccgtgtttcgctggttctcaaggaagtggtcaaggacatccggggcagactgttggtgttcttccccggtgaatacgaagaaaacaaatacagattactggacgcaagggatggctggaactacctggccgtacctatcacgcttcataatggggtaaacgactga

SEQ ID NO: 5520 - DNA, 588 bp, Tepidanaerobacter acetatoxydans
gtggctacaacaaaagaaagacttgataaaatacttcctgcaataaccaaaaaatcttttagggaaaacaaaggtcttggaaatgagattgggtactatatttttgactatgaacctcaacatgagatgttggtaagggattatatcaattttttaaaggacaaagtaaatagtgggaactatggatttaaaataaaagaattcgatttatatgaaataatgttagaaattcttgactcaaaaggatatctcgaaaaaaaatttcgaaatggaacgaaaaaagggagtgaatatgtatttaatgctgccaaaaaggctttaagacttacaactgctaatgatttaatcatcaaatacataaaggatcgagttgaagaagacgacataatttttttaacaggagtaggcaaggcttggcctattatacgttctcatactatactcaacaacttgcatccggtagtggatgaaatcccgctggttatgtttttcccagggacctatgatggtggttctcttgttttgcttgatgaggttaaagatgataattactacagggcctttagatttattgacgaatatcagtaa

SEQ ID NO: 5521 - DNA, 588 bp, Tepidanaerobacter sp.
gtggctacaacaaaagaaagacttgataaaatacttcctgcaataaccaaaaaatcttttagggaaaacaaaggtcttggaaatgagattgggtactatatttttgactatgaacctcaacatgagatgttggtaagggattatatcaattttttaaaggacaaagtaaatagtgggaactatggatttaaaataaaagaattcgatttatatgaaataatgttagaaattcttgactcaaaaggatatctcgaaaaaaatttcgaaatggaacgaaaaaagggaagtgaatatgtatttaatgctgccaaaaaggctttaagacttacaactgctaatgatttaatcatcaaatacataaaggatcgagttgaagaagacgacataatttttttaacaggagtaggcaaggcttggcctattatacgttctcatactatactcaacaacttgcatccggtagtggatgaaatcccgctggttatgtttttcccagggacctatgatggtggttctcttgttttgcttgatgaggttaaagatgataattactacagggcctttagatttattgacgaatatcagtaa

SEQ ID NO: 5522 - DNA, 585 bp, Thauera sp.
atgaccatgacgcagacatttgaggaacgcctcaaccagatcctgccgcgcatcacgtctgaggacttcctgcagaaccgggggcttggcaacgagattggtttctggatctttgagtacccgccggagcaggaaatggctgtacggagtttcctgtctgaggtcgtggagcccgcattgcggcgcagacagccgccgttgagatatgtctgtgtcaaccttctcgaactcgtcgttgacgtgctcgagcaccgaaagctgttcgacaaagtcatcaagatgcaggcggagaagggggatgacgcagtctttgcatcgctccagggggtactcaaccaagagaagcttgcgcagcgaatcgtcggtctccacaaccccgatgagctcgacatgatgatcttcaccggcgtcggggccgcgtacccgcttgttcgtagccatacgctcctcaatgcgctccatcccttgatgaagaacacgcccctcctgatgttctttcctggccggtacgacgggtactccctgcggctcttcaacaagctgaccgacaagcactactaccgcgccttccgcctcgtgccttga

SEQ ID NO: 5523 - DNA, 564 bp, Thermacetogenium phaeum
gtgagtagaattgaggaactggcaaaccgctatcgcagccatattgctgcgccatggcagcataatctggccggcgagcaaaggatgatttttgttgtttatcctccagtcgacgagcgtaagctccgtgccaggttggaattgttcgagatggcgaccattgaatctggacataaatggaaatcatttgactttactcaaactttcgcccgatggatgagcaacttggaatataaggagatttatttcgaggagcccgacagtctgacgataccccttgagggtgaattcccgcattttgcagccgccgaactacgtaaagtacttactgcagaagatgttgactctaacactgttattgctgtttacggcattgccagcctgtacgggttcacaaaagtatcccaggttctcaaagaagtcgccagagatgttcgcgggcggttggtagtcttttttccaggcgaattcgaaaacaacaattatcgtcttctcggtgcacgcgatgggtggaattacctggccatacccatcacattacataatggagtgagcgaccgatga

SEQ ID NO: 5524 - DNA, 585 bp, Thermoanaerobacterium thermosaccharolyticum
atgaaaaccatttatgacaggttagatgaaataatgcagcgtataacgaaagagtctttcagggaaaatacaggtctcggaaatgaagtcgggtattacatattcgattatgaacccaaatatgaaatgcttgttagagattacgtgcagtttctcaaacaaaaaatcaatgggggaaactacggctttactataaaagaatttgacctgtatgaaataatgctggaacttcttgagacaaaaggttatcttgagaagaactttaagatggagcaggataagggaagtgagtttgtatttaacgctacgaaaaaggcattaaggcttacagagaagaacgaccttattatccagtatatcagggatagggtcaaaaaaggcgacgtagtatttatcactggcgtgggaaaggtatggccgattatccgctcgcatacggtgctaaataatcttcatcaggttttggatgaagttccagtagttatgttctttccaggagtatacgacggacttgaactggtgctgtttgaagaaataaaagacgacaattactatagagccttcaaacttgtagaaagatattga

SEQ ID NO: 5525 - DNA, 639 bp, Thiocystis violascens
atgaccctgcccctgttcatgccatctcccttaaaggacggcttcagcgctttgcggtgcgatctcattcacgaggacggaccgcgcatcagcaccatgcgcaactatcggttcgcgatccttcaatacgacccggccgaggagttcaagctgcgtgctgaggttcagcggctcagtgccgatctgatcgccagcggctggatggtgctgtcgatcagtctccagcgattgctgctggagcgtatccggaggcaggggccagagtgggtcgaccgtgtgatccagatggagcggcagatggcccatatcgcccccgagcgcggactcaattatctcaaatccaagcttacgcccttgatcgaaggccccgatgggctcgccgccgattgcagccgcctcatcagcgcgcatgccgaccagcatccggagacgcttgaccagaccctggcgctgatcggccgcgccggggcgctctatcccttcttccgctcctcggcactgctacgtcatctcgacggccgcacccgtggggtcccggtggtcctgctctatcccggtaagaaacagggcagcaagggcctctccttcatgggtatgctcaacccggacagcgactaccgcccgcgcatctatccctag

SEQ ID NO: 5526 - DNA, 573 bp, Thioflavicoccus mobilis
atgccatcgctggacgctagcttcaaggagttgcagcttcgcctgcgggacggttccagcctgcgcaacaccggcggtgaccccgtctactacctcgtctatccgccctccgagatgttgcgggtcaagcgccggctcaaggtctgggagaagcagcttaggatcgacggttgggagccgcggatcctgtcgttggccaaggtgatcggcgactacttcgagacccacccactgcgccctttctggctgagcggggaagccgcgaacccggacctggacgccgcgaacgagaccctgcgtgccgccctgatcgacagcgggcatgtcgaagagcagatcctcaagtccctggccgcgatcgagacgaagccgggggcgctcctgatcgtcacggatatcgaggcgatccacccctatctgcggatcggcgctgtggagcagcgtctccagggcaaggtgccggtgccgatcatcatcctctatcccggtgtgcgctccgggcagaccagcctgagcttcctcggaatttacccggacgacggtaactatcgctccgtccacgtcggtggctga

SEQ ID NO: 5527 - DNA, 594 bp, Vibrio cholerae
gtgcacaatatgaaggctcttcagaccaggcttgatctgatattggaacgaattgaaagccctaagtttttgaaaaacgatggcttgggcaatgaaattggattttgggtatttgactatccagccaagtatgaactgcttgtacgagagcaccttaagcacgttgacgaaaaactcaacaagcgtggttaccgctttgtccatctcaatatttttgaagtcttgatagatatgcttgaggagcgaggccttttcgaccgagcttgccagcgtgaactgcaagtcggtgttgatggccttcgaaaaacactagccgggcctctgagccaagagaaagtggcaaggtatatcgcggacaaatataagccatcagaacttgagtttgtgttgctgtcaggcttaggcagtgcgtggcctcttgttcgagggcatgagttacttagtgctctgcaagacgttatgggtagcacgccattagtgcttttctatccgggtgaatatagcggaagggatttgcatcctttcggcatgatcgaatctaaaaactactatcgcgccttcaagcttgtgcctgaagacggtaaaaaaaattaa

SEQ ID NO: 5528 - DNA, 549 bp, Vibrio cholerae
atgccctttatagctgatcacaaacaaaagtttgctgacctagactttaatattgaaaaccaagatcagcttcgtcggcaagccaatggtggtaacagtatattgttttcctattgtccaggtgaggaaaatttatacattgacaaagcgagagatatttatgaagagaaagcggaattcatagatatcagccaattacttgtcagatttatagattccgatggctgggatgctttctccgagtactacagagatttcattaacactccacatgttgttttcaaatctgacgatccagaacaagacctttttgacatgattatttcagccattaaacaggcttgtgaaaaggataagattccatttcttattcgaagtggttgcttgtatggcacgggtatagagaatgtgaacataatggagcacaaagatgttatgcagctaaagcatccacttgtcattttctatccatcgaaaatatcagaagacaacattttattcttgaattttagaccagcatcaaagtatcgctgtacgttagtgaaatag

SEQ ID NO: 5529 - DNA, 603 bp, Zymomonas mobilis
gtggacacgaaaactgatcggcgcgcccgcgccgagcacctgttcagggtagtttccagtgatcggttcttgcaaaagcaagggctgggaaacgaggttccctttttcatctgcgcttttgatgccgaagacggactgagcctgggcgaggatcgcgaggatctgatcgcccggctgagccacgccggtgtgcgcgtcctcgatatcgatctctacgacctttcactcagaatcctcgaagaccgcggaatcttcgagcagatccttgaggtggaagccgaaacggaaaaagcggaactcaaggaactgttgcagggcgttctggacccgcaggcgcacctcattccagagattgcgcggcgcatcgaagaggtcccgcacgaggtgatcttcctgtcaggcgtaggcgaggtttacccctacctgcggtcgcacaacgtactcaacaacctgcaaagcaccgcgaaagaccgcccgacggtcatgttctttccgggaaaatacacgcacgcgttggcgacaggagcatcgctggaactgttcggcctgctgcatgacgacaaatactaccgcgcgttcaatatcatgaattacgaggtctga

SEQ ID NO: 5530 - DNA, 573 bp, Magnetospirillum magneticum
atgagcattctcgacgaccgcttaaacaaggttctggatcggttgatatccgacgacctgctgagcggtcgtgggctgggaaatgaaatcggcttctacattttcgattacccagccgagaacgaacttacggtcagagaacacattggattcctgctggagcagctacccaaaaagcgtcctgggctgcgggtgaagcacatcaacctctttgatatggttcttgggcaccttggtgaccgcaagttgttcgacaaggctatcgagcagactcgcaagaagggtgatgctttcttggtgaaggcattgaaggaaccgcttcacggcagcaagctcgcacctgtttttgaagctgcgtgcgatctgccgaatcatgatctcgtgctggtatccggcattggcaccgtgtacccgctgcttcgcacgcatagcctgctgaacaacctgcaccatgtgatgcgggacaaaccactcgtgatgtttttcccaggaatttacgacggacaaatccttcggcttttcgggaagctgaaggacgacaactactaccgggcattcaaattggtgccttaa

SEQ ID NO: 5531 - DNA, 591 bp, Marinobacter aquaeolei
atgccgatgcaggagcgactacagcacctgttcagcgtggtttccggccagcggttcctgaacaaacagggactgggtaatgaagtgcctttcttcatctgcccctaccggcctgaagaagcggtcgagatggagcgtcttcagcggcagttggttaaccggctggagcaggcgggcatccggatcctgagtatcaatctgtacgacctggccgtcgatattttgaaagaaagagacatctgggagcaggtgttagagctcgagcccacggtctcaaaggatcagttgaaagagctgctacagggagtgctggacccggaagcccatttggtgcccgctattgcggcaaaactccagtccgttgagtttgacgtgctgtttctctcaggggtgggcgaggtcttcccctacatacgctcccataacgtgctcaacaacttgcagagcaccgccaaagaccagccaacggtgatgttcttcccgggttcctatacccactcgctggaaaccggtgcatcgctggatctgttcggcaggctgcatgacgacaagtactaccgtgcgttcaacatctttcattacgaagcctga

SEQ ID NO: 5532 - DNA, 648 bp, Nostoc punctiforme
atgcccacattgaccattaatcagcgccttgatgcactgctaccaaagctgcaagatgcacgtctgctgagtaaccgtggcattggtaacgaaattggcttttatatttttgattatgacgctgaatatgaaccactggtacagcgctacgtcgatcgcctgaagctgcaattgacgagttcaccctccgggttcgccagtccctctttgtcggaacaacaagaccgggctggctcaccgatccagcttattttgctggaaattgacctttacaagactattctcgacattttgtcagaacgaggggtactcaaaaaagcttttgagttggaagcaactaaaggaaatgctgccctggctaagaccgttgcgcctcttgtccgacctgaccaggttattgcctacatccaaaaaaaacttaggggtgatgaacagcttgtaatcatgactggagttggtgctagctggccccttttacgatcgcacagtattctcaacaacctacacccagtacttgacaaaatccctctagtgatgtttttccctggttcttacgatgggcacgaactacgcctattcgacacctttaaggatgacaactactatcgggccttccctctgattccccaccaacaacaccacctatga

SEQ ID NO: 5533 - DNA, 603 bp, Rhodobacter sphaeroides
gtgagacagccgaccacccgcaaggagcgggcagagcacttgttcaaggtcgtcaccagccagcgcttcctgaccaagcagggcctcggcaatgaggtaccattcttcatctgcccctacccggcagaagaaggactgtcgatggttgaggaccggtcggacctggttacgcgcataagacatgccgggatcgatgttctcgacctgagcctgtacgatatctcgctcgacatactcgaagagcgcggcatcctcgaccagatcctcgagatcgagccggagaccgacaaaggcgagattcgggaacttctgcagtccgtgctggatccaaaggccaacctcatcccgaggatcggcgaagccatcgaagccgcaccgcatgacgtgatcttcctgtccggcgtcggcgaggtctatccgtacatccggtcgcacaacgtcctgaacaatctccagagtacagccaaggacaagccgacagtgctgtttttccctggcagctacactcacgcgctcgcgacgggagcctcactcgatctgttcgggcgccttcacgacgacaagtactaccgggccttcaatattctgaactacgaggtttga

SEQ ID NO: 5534 - DNA, 594 bp, Runella slithyformis
atgctccagcctcaacactacagcacagcgcaccattttgataatttgttcaacatcttttccaacgctcggtttctgaataaagaaggtttgggaggggaattgccttttttcattcattcatttccggtagcaaaacaacccgaagtggaaacaggcattcattcgctgctcagacggctacaaatgaatggcattgaagtggtagaaattaatttgtatagcgtatgcattgatattctgaaacgggaaaatctgtttgagcaaattcttaaccgagagaccgctttacctaagcaacgtttactgagagtattgagtggcccgctcaatattgatacttcagtaatacccgagattcatcaacgattggaaaaacaatccgccaaaattgtctttctcaccggcattggcgccgtgtaccctgtcattcgctcccatacaattcttaataacctgcaaacgctcgtgggtgatttgcccttggtgatgttttttcccggcacctacaacaaccactcgcttacgctgtttgaccaactgaaagatgataactactatcgcgcccacaaccttaatgactataaattataa

SEQ ID NO: 5535 - DNA, 582 bp, Halorhabdus utahensis
atgacaagcaagcggccgctccacgacttcacggagcggctcgcccgattcgcggacgggcgtcgcggcattcggaacccgttcgtgatcgtgcccgtccagccgaaatacgagcgacgcgtcgctgaccgcctcgtcgagtgggcagacgacgcgcacgataccgaggggttcccggcggacggaaccgtgcaagtcctccggcttgacgagttgctcgtagagaccgacgtgtttgacctcgcggtcgacctaggtgaggaggccgaccccgcgacgatcgaagacacgatgcaagaccgactcgctgaagagttggtcgaggtcatggtcgaagaaatctccgctcccgaccagcagcgacacgtggtcatcctaactcatctcggcagtctctatcccttcacgcgggcctcggagttgctcgacgaactcgaccgccgcaacgtccagtcgacgatcggcatcccgttccccggggacatcgtcggcgggaagctgagcttcttcggcgaggaatcgcgcaactactacccggcacaccagatcgacggccgcatcgaggaggtgcatctccaatga

SEQ ID NO: 5536 - DNA, 582 bp, Halobacterium salinarum
atgacaaccaaacgtcccttccacgacttcacggagcggctcgcacagttcgccgacggccgacgcggcattcgaaaccccttcgtgattgtccccgttcagccgaagtacgagcgacgcgtcgccgagcggctcaccgagtgggcgacgaacccgcatcgtaccgaggagttcccagatgatggaaccgtccaactcctccgacttgacgagctgttcgtcgaaaccgacgtcttcgaactggcggtcgatctcggtgagaacagccaaccagcgaccatcaccgaaacgatgcaagaccgattagcggaggaactcgtcgcgattatggtcgaaaaaatcgacgcaccagcccagcagcgacacgtcgttctcctcacgcatctcgggagcctctacccgttcacgcgtgcgtcagaactgctcgacgaactcgaccgccgcaacgtccagtctacgatcggcattccgtttcccggaaatatctacggtgggaaactgaacttcttcggcgaggaatcgcgcaactactacccggcccaccagatcgaaggccgggttgagggggtgcatctccaatga

SEQ ID NO: 5537 - DNA, 582 bp, Haloarcula hispanica
atgacgacaaaacgtcccttccgggacttcacggatcggatcgcacagttcgccgacgggcgacgcggcatccgaaacccgttcgtcatcgttcccgtccagccgaagtacgagcgacgcgtcgccgaacggctcaccgagtgggcgacgaacccgcaccgaaccgaggagttcccggacgacggaaccgtccagatcctccggttagacgaggtgttcgtcgaaacagaagtcttcgaactcgcagttgacctcgggaagcacagccaaccagcgacgatcaccgaaacgatgcaagaccggctagcggaagaactggtcggaattatgctcgataggatcgaggcaccgggcgagcagcgacacgtcgtcctcctcacacatctcggcagcctctacccgttcacgcgtgcgtcggagctcctcgacgaactcgaccgtcgcaacgtccagtcgactatcggcattccgttccccggagatatcgtcggtgggaagctgagtttcttcggcgaggaatcgcgtaactactacccggcccaccagatcgaaggccgggttgagggggtgcatctccaatga

SEQ ID NO: 5538 - DNA, 591 bp, Halophilic archaeon
atgaccgactcaccgtaccgcgcgttcaaggagaagctctgtacgttcgccgacggtcaggccggtatccggaacccgttcgttattgtggccgtcgaacccgctatcgaacatcgaactgttgaccgactcagtggttgggcgacagggtccgacgagccaccagtcatcgatgaagacatctctatccaaccgatctggctcgacgaactgcttccgcagaccaaggtgtataatctgtgcgttgccctcgggagcgagacgagcccggaacgcatcgagggcacgatgcaggaccggctcgccgaagagctcgtccaagagatgatcgagaacgagatcgacgaagagcatctgaaacaacaaagccacgttgtcctgctcctcaatgtcgggagtctctacccgtttacacgtgcctctgaactcttcgacgaactcgaccgccggaacgtcagatcgaccatcgggattccgtatcctggcgatgacgtcggcgggaagttaagcttcttcgacggagactcacgacattactacccggcgcaccagattccgggtccgattacagagagacacctccaacaatga

SEQ ID NO: 5539 - DNA, 621 bp, Natrinema pellirubrum
atgagccagacgagttcgtcgccgtatcgtgaattcaaggagaaactacggacgttcgctcaagggcaacacgggattcgtaacccgttcgtcatcgctgctgtcgacccagcagtcgagcatcgggtcgcagataggctcgcaacttggtccgatggacgaaaggaagcgccagagatccctgacaacgtaaccgtccagccgatctggcttgacgaactcctgccacggaccgatgtgtacaaactcctcgtcgacctgggcgaacccctggctgaactcgagggcgatacgtcgccaggtgagcgtatcgaggagacgatgcaggaccggcttgccgaagaactcgttcagcaaatgatcgaacacgagctcagcgaagcccagctggagacccagagccatgtggtactcttgctaaatctcggcagtctgtatccgttcacgcgtgcctcggaactgctggacgagcttgaccgtcggaacgtaaagtccaccatcggaatcccattcccgggggacgtcgtcggcgggaagctgagcttcttcggcggtgagtcacgccattactaccccgcccaccagattgacggccagatccagggggtgcatctccaatga

SEQ ID NO: 5540 - DNA, 636 bp, Planctomyces limnophilus
atgacagccgatcttttctctcaaactccgcttcaggaagcgattcatgcgctgcggtcggacctcatccaggaagatggcccccgcatcagcacgatgcggaactatcgattcgcgattgttcaatacgatcccaaagacgaattccgtcttcggcgtgaagttcgccggctcaacaccgaactcgtatccgaaggttggatggtgctgacgatcaatctgcagaagctcctcctggatcgcgttcggtcgcagggtgaggatttcattcaacggttagtcgaacgcgaaaaacgaacttcccaaaaatcgatcgagcgtggcatccaggaccttcagacacggcttgccccgctgatagaggggccggaaggcatcgcagccgactgcagtcgaatcatttgtgattatgccgatcagaacgcagagaccattgatcgaacggtcgccatcgttggtcgggccggcgcactgtatccgttctttcgatcatcagccctactgcgccatctggatggcagaacacggaacgtccctgtcgttttgctataccccggagaacggcgtggagaaaaaggactctctttcatgggagttgttgacccagacagcgactacagaccacggatttactaa

SEQ ID NO: 5541 - DNA, 636 bp, Anaeromyxobacter dehalogenans
gtgacggagccgctcttccagcagtcgacgctcgacgacgcggtccaggcccttcgccgcgacctcctcgcggatggcgggccgcgcatcagcacgatgcgcaactaccggttcgccatcctcccgtacaagcccgccgaggagttcaagctccgcaagctcatgcgccggctcgcggacgatctgaagggcgaggggtggggcgtcctcgccatctccttgcagaagctgctgctcgaccgcatccgcgcgacgggaacctcgaacgtcgaggcgctgatcgcgcgagagaagtcgctgcacgggcgcgatccggagcgggcgctcgagcacctccgtcagaagatcgggccgctcatcgagggcccgggcggaatcgccgccgacgtcgcgcggctgatcgacgggttcgccgcggcgaaccccgacgcggaccggaccctcgtgctcgtcggccggagcggcgcgctctaccccttcttccgcacctcggcgctgctcaagcacattgacggcaagacccggaacatcccggtcgtcctgctttacccaggcgagcggcggggcacgacggagctctccttcatgggcgagctgaagcctgaccgcgattaccgtccccgcatctatccgtag

SEQ ID NO: 5542 - DNA, 618 bp, Haliangium ochraceum
gtgagcaagcccaagcaggccttcgccgccctgcgccgcgatctcatcgacgacaacggcccgcgcatcagcaccatgcgcaactaccgcttcgccatcgtccagtacaagccccacgaggaatacgccgtacgcgccgagacccagcgcctgtcctccgagctgtgcgccagcggctggagcgtcatccccatcgatctccaccgcctgctcatggagcgcgtgcgcgcgcagggcgatgactggatgacgcgcgtcgtcgacatggagcgccgcctggcccagaccgacccgcgccgcggcctcaactacctcatccagaagctcacgcccctggtcgagggcccggacggcatcgccgctgactgcagccgcatcatcaccgagcacgccgaagcccaccccgagcgcgtcgagcgcaccctggcgctcatcggccgcaccggcgcgctctaccccttcttccgctcctcggccctgctgcgacatctggacggccgtaccaaaaacgtccccgtcgtcctgctgtacccgggcgagcgccccgctgccaccgggctctcgttcatgggcgagctcgcccccgaccacgactaccgcccgcgcatctacccgtga

SEQ ID NO: 5543 - DNA, 618 bp, Haliangium ochraceum
gtgagcaagcccaagcaggccttcgccgccctgcgccgcgatctcatcgacgacaacggcccgcgcatcagcaccatgcgcaactaccgcttcgccatcgtccagtacaagccccacgaggaatacgccgtacgcgccgagacccagcgcctgtcctccgagctgtgcgccagcggctggagcgtcatccccatcgatctccaccgcctgctcatggagcgcgtgcgcgcgcagggcgatgactggatgacgcgcgtcgtcgacatggagcgccgcctggcccagaccgacccgcgccgcggcctcaactacctcatccagaagctcacgcccctggtcgagggcccggacggcatcgccgctgactgcagccgtatcatcaccgagcacgccgaagcccaccccgagcgcgtcgagcgcaccctggcgctcatcggccgcaccggcgcgctctaccccttcttccgctcctcggccctgctgcgacatctggacggccgtaccaaaaacgtccccgtcgtcctgctgtacccgggcgagcgccccgctgccaccgggctctcgttcatgggcgagctcgcccccgaccacgactaccgcccgcgcatctacccgtga

SEQ ID NO: 5544 - DNA, 729 bp, Fusobacterium sp.
atgaagaaaacattagaaattaaaaatttatcttattcttttggagataaccatattctaaaagatataaatatttatgttaaagaaaatgaaatggttgctatagtaggtagtagtggagttggaaaatctactcttttcaatcttattgctggtgttttaaaaaaacaaagtggtgaaattactattgatggaagtgatgattacataggtaaggttgcctatatgttacaaaaagatttactttttgagcataaaacaataattaataatgtaattttacctctaattatagcaaaaatagataaaaaagttgcacttgaagaaggaagaaaaattttaaaacaattcaatttagaaaaatatgttgataagtatcctaagcagttaagtggaggaatgagacaaagagtagcacttattagaacttatatgtttaaaagaaatatttttcttttagacgaagctttttcagctcttgatgctataactaaaaaagagttacataaatggtatctcaatctaaaaaaagagtttaacttaacaactttacttataactcatgatattgaagaagctatatttttaagtgatagaatttatatcttagctaataaaccaggagaaattataaaagaaataaaaattgaaattaatcctaatgaagatatagatgtacaaagattattttacaaaaaagaaattttaaatattatgaatattgaataa

SEQ ID NO: 5545 - DNA, 1329 bp, Rhodopirellula sp.
atgacggcaatgaccaaccgagacattcagcacatcttcgagtcgctccgcaagggcttggttcccgaacgcggcatcgacgctttcgcagtcggcatcgaaaagcttcgtggcgagatggagcgtcaattggaattggcggaaggcggcgagggcacgatcaagtttctccgtggcggctacgggtgtggcaagacgttcatggcccggctttccctgctggatgcccaaacccacgggttcgcgactagctttgttgtcgtctctgataacgatctgcgttttcaccgtttcgacgatgtgtatcgaaaggtgatgatcgaacttggcacgaatgtttgtccgcgtggtgcgatgggagacatcctggaccgctggatcggaaaggtggaagacgcattgatcgcgtccggcgaagacgagaacgcggacgattttgatgccaaggtccgcaagcgacttgatgacgacctggcgtcgatgacaggcggacaggcacctcaagatttcattcgcgtcatccagacaatctttgacctcaaacaacagggcaacgccgcggaagccggctcattgatctcttggctctgtggcagcggcaacgtggctgcgtccgccaagaaggccgctggcatcaagggtgacatcactagtcgcgacgcgttggactaccttcgtggtgtgctggagatcgtcaaggcggccggctacaaaggtttggtgatcgtgattgatgaagcggaaaccatccttcgcatgcgcaaggactcgcgtcacaagtcgctcaatgggatccgacagattgccgatgccgcaggctcctacccgaaaatgttatgggtgttcacgggaacgccagacttctttgattcgcgacagggcgttgccggacttgcaccgctgcacgatcgcattcaattcatgaaacaaggacggtttgcgagccttcggcaagctcaattggaattgacaccgtttgacgctgaacgattgcgcagcgtcgccgtcaagcttcgcgaactgtatccaaccaacgatcaatctcgtatcgacagcaaggttagcatcgaattcatagaccgattggtcaacgaggtcacgcagggtttcaagggggatgtcggggtggttccacgacaatttcttcgccaatttgtgacgcagttggacctagtggacgagaatgaggattacgatccgatgacggagtacgggttcgagccgcaagatctatcttcagaagaacagttggcgatcagtggtgccgcgctcacgcagggcgacggggacgacgatggcgaaccgcccgttgctgaggatatttggtga

SEQ ID NO: 5546 - DNA, 1320 bp, Pseudanabaena biceps
atgaatttgagtgctaaggataccgaacatgtttttgaaaagttgcgatcgggagttgtgccagaacggggactagaagcatttgctgtcggcatagatcgatctcgtaaggaaatccaacgccaactcgaactcgctgctgatggtgaaggcgtgtttaagtttttgcgaggtggttatggttgcggtaaaacctttatgtctcgccttgccaccctcgaagcccgcgatcgtggctttgccactagttttattgtcgtttccgataatgatttgcacttccataaatttgatgatgtctatcgcaaagccgtacaggagcttggcacaaatgtatgcccaaggggggcactaggcgatattctcgatcgctggattgcgagagttgaagatatgctgatcgctgggggcaaggatgaagacgatcctaattttgatgatgccgtgcgcgatcgcctcgatgaagaacttgcttccatgacaggggggcaagttcctgaagacatgacacgagtattgcgaaccatctttaccctcaagcaacagggaaactttgccgaagccagcgccctcatttcttggctatcaggcagtgaaaatgtcgcggcaagcgccaaaaaaattgcagggattaaaggcgatattggcagccgtgaagccctcgactatttacttggcattttgcagatcgtcaaggcggcaggttacaagggctgggcgatcgtcattgatgaagcggaaacaattttacgaatgcgtcaagatgtgcgcggtaaatccttaaatggcattagacaaatctgtgatgccgccgatcgctttcatgggttgctatggatttttacaggtacgcccgacttttttgatacaaaacgtggcattgcgggactaacgcctcttcacgatcgcatcaagtttgaaacctatagcggctttagtagtccgcgtcagccccaattggaactcaccccctttgatgctattcgtttaaaggaagttgccctcagactgcgtgaactttttaacgctggcgatcgcattcatttggaacgaaaaatcacccttgaatttatcgatcgcctgattgcagaagtaactaaaggctttaaaggcgatgtgggcgtagtgccacgtcaattcttacggcaatatgtgaatcttctggatttggttattgataaccctgacttcgagccgatcagtgccttatctctgcccgaagataccctcaatgactatgagctccgcatcaagtcaggcttgccctattgcgatcctgaaccagaagaaaatgaagtttacgccgttgttgaattttaa

SEQ ID NO: 5547 - DNA, 1326 bp, Saccharomonospora glauca
gtggtgaccagcgcggtcagcgaggcccggaggcgggacgtgatcaacgcgttacgtcggggcaccgtgccgcagagcggcctggacctgctcgcggtgggtctcgaccgcttcgccaccgccatggacgacgacctcgccaccgtcgcccggggcggtgcggccttccacgccgtgcgcggcgagtacgggtcgggcaagaccttcttcgcgcgctggctcgccgagcgggccaaacgccggggactggccacctccgagatccagatctccgagaccgagacaccgctgcaccggctggagacggtctaccgacggctcaccgaacggctggccaccgccacccaccagcccagcgccctgcgcgccgtcgtcgactcctggctctacaccctcgaagaacacgtactggacgcaggggaggtcgccgaggacgactcgacggcgttcgccgccgcggtcgacaccctcgccgaacaacggctcgccgacgtggcgcgcacgacacccgcgttcgccgccgcgctgcgcggctaccggcaggcactcgccgacggtgacaccgccaccgccgaagccctcatcgcctggctgggcgggcagaagtccgtggcggcctccgcccggcgcgcggcgggcgtgcgcggggatctcgaccacttcggcgcgctcgggttcctgcagggactgctcaccgtgctgcgtgactgcggacaccccggactgctgctcgtcctcgacgagacggaaacgctgcaacgggtccgtggagacgtacgcgagaagggcctcaacgcgctacgtcagctcgtcgacgagatcgacgcgggccgcttccccggactgttcctcgtactcaccggcacacccgcgttcttcgacgggcagcagggcgtgcagcggctcccaccgctggcccaacgtctcgccaccgacttctccaccgacccgcgcttcgactcaccacgggcggtgcagctccggctgcccggcttcgacctcgaccggctcggtgaactcggccgcaccgtacgcgacctgtacgcgggcacggcccgcaaccccgagcgcgtacgggaggtggtggatgacgcctacctcgccacgctcgcgcgggcgctcaccggcgaactcggcggcaaggtcggcgtggcaccccggctgttcctgcgcaaactcgtcgccgacgtgctcgaccgcgtggacgagttcgccgacttcgacccgcgccgcgactacgcgctcacggtcaccgaaaccgaactcaccgacgtcgaacgcaacgccgtggcgagtgccgacgacgtcgacctggaactgccgtga

SEQ ID NO: 5548 - DNA, 1293 bp, Rhodococcus triatomae
atgagcaccctgtcgccggtccgccgccgcgagctgctgcagtcgctgcggcagggcaccgtccccgacggcaacctcgatgcactagccgtgggcatcgaccgcttcgcggcgaccgtcgacgccgacctcgacgccgtggccgccggcgggcgcgccttcaaggcggtccgcggcgagtacggatccggcaagacgttcttctcccgctgggtcgagcagcgcgcgatgcgccgcggcctcgcggtcgccgaggtgcagatcagcgaactcgagacgccgctgcacaagctggaaaccgtgtaccgccgcaccatcgaggagctgcgcacctccgcgttcgcgaagagcgcgttccggccggtgatcgacgcgtggctgtacggcatcgaggaagacgccgccaccgccgctggcgtcgacgaagcgacctccgagcaggtgttggagctgctcgaacagcgactcaaatccgtcgccaccgcggcgccgacctacccgatggtgctgcgcgcctaccggtcggcgctggagcgggaagacgccgccaccgccgacgcgctcattgcctggctgggtgggcaaccgcatgtgggtgctgccgcgaagcgggccgcgggggtccggcaggacgtcgatcatttcgccgcgatgggcttccttcaggggctgctcgccgtgctcaagggttcccggcatcccggtctcgtgctcgtcatcgacgaggtggaaacgctgcagcggatgcgcagcgacagccgggccaaggcgctgaacgcgttgcggcagtggatcgatgaactcgactccggccgctaccccggcctgtacctgctgatcaccggaaccccggcgttcttcgacggccgcctcggggtgcagtccctgccgccgctcgcacagcggctgcacaccgacttcggcaccgacgcccgcttcgacaacccccgcgccccgcagatccggctcaccggattcgacctcgatcggctcgtcgaggtcggcgcccgggttcgtgacatctactccgacggctcctccgcaccggaccgggtccggtcgatggtcgacgacgcctacctccgcgatctcgcgtccgcggtggccggtgagctaggcggcaaggtcggcgtctcgccgcgcatcttcctcaagaagctggtcgccgacattctcgaccgcgtcgaccagttccccgatttcgatccgcgccagcactattcgctgaccattgcggacacggagaaggcggagatcgcccgcgccaccactgccgacgaggtggagctgtga

SEQ ID NO: 5549 - DNA, 1326 bp, Saccharomonospora cyanea
gtggtgaccagcgcggtcagcgaggcccggaggcgggacgtgatcaacgcgttacgtcggggcaccgtgccgcagagcggcctggacctgctcgcggtgggtctcgaccgcttcgccaccgccatggacgacgacctcgccaccgtcgcccggggcggtgcggccttccacgccgtgcgtggcgagtacgggtcgggcaagaccttcttcgcgcgctggctcgccgaacgcgccaaacgccgaggactggccacctccgagatccaggtctccgagaccgagaccccgctgcaccggctggaaaccgtctaccggcggctcaccgaacggctgaccaccgccacccaccagcccagcgccctgcgcgccgtcgtcgactcctggctctacaccctcgaagaacacgtgctggacgccggagaggtcaccgaggacgacccggcggcgttcgccgccgccgtcgacaccctcgccgaacagcgactcgtcgacgtggcgcgcacgacacccgcgttcgccgccgcgctgcgcggttaccggcaggcactcgccgacggcgacaccgccaccgccgaagccctcatcgcctggctgggcgggcagaagtccgtcgccgcatccgcccggcgcgcggcgggcgtgcgcggggacctcgaccacttcggcgcgctcgggttcctgcagggactgctcaccgtgctgcgcgactgcgggcaccccggactgctgctcgtgctcgacgagaccgaaaccctgcaacgggtccgcggcgacgtgcgcgagaagggcctcaacgcgctacgtcagctcgtcgacgagatcgacgcgggccgcttccccggactgttcctcgtgctcaccggcacacccgcgttcttcgacgggcagcagggcgtgcagcggctcccacccctggcgcaacgcctcgccaccgacttctccaccgacccgcgcttcgactcaccacgggcggtgcagctccggctgcccggcttcgacctcgaccggctcggtgaactcggtcgcaccgtgcgcgacctgtacgcgggaacggcccgcaaccccgagcgcgtacgggaggtggtggatgacgcctacctcgccacgctcgcgcaggcgctcaccggtgaactcggcggcaaggtcggcctcgcaccccggctgttcctgcgcaaactcgtcgctgacgtgctcgaccgcgtggacgagttcgccgacttcgacccacgccgcgactacccgatcacggtcaccgaaaccgaactcaccgacgtcgagcgcaacgccgtggcgagtgccgacgacgtcgacctggaactgccgtga

SEQ ID NO: 5550 - DNA, 1326 bp, Gordonia polyisoprenivorans
atgagtgggtcgtctccgaacgggccggctccgaccggtctgtcacccgtgcggcgccgtgagatcttgaccgcgttgcgccagggcagtgtgccatcgggcaacctcgacgtactggccgtcggtatcgattcctttgctccgacgatcgatgacgagatcgcggcagtggcggccggcgggtcggtcttcaaggcagtgcgcggcgaatacggctcgggtaagacctttttcgcccgatgggtggagcagcgggcgatacgacagggcctcgctgtcgccgaggtacaggtcagcgagttggagacaccgctgcacaagctggagacggtgtatcggcggaccacggaatcgcttcggacatcggccttcgcgccatcggcattccggtccgtcatcgatgcgtggctgttcgagatcgagaatgacgccgctgccttggtagccggcgatgtaccgaccgcggacgaagtcggcgcgctgctcgaacagcgactcgcggcggtggccactgcagcaccggtataccccatggtgttacgtgcataccgcagcgcggtggagtcgggtgacgcggtcaccgccgatgcgttgatcgcctggctcggcggccagccccacgtggccgccacagcaaaacgcgccgccggagtccgccaagacgtcgaccacttcttggcgatgggcttcttgcagggtctgctcgcggtactcaagggcgccaggcatcctgggctggtcctggtgatcgatgaggtagagaccatccagcgcatgcgctccgacagccgggcaaaggcgctgaatgcgttgcgacagtggatcgacgagctcgactccgggcgctaccccggcctgtacttgctgatcaccggcactccggcgttcttcgacggccggatgggtgtgcagtccctgccgccgctcgcacagcgtctggcgaccgatttcaccaccgacccgcgcttcgacaatccgcgcgcaccacagatccggttgcgcaacttcgatattgaccggctcgtcgaggtcggtacccgggtccgtgaggtgtacgccgacggcgccggagacccgacgcgcatccgggccgtggtcgatgatgcctacatcggggatctcgcacgagcgctggcaggaaagttgggcgggcaggtgggggtggcgccgcgacttttcgtcaagaagctcgtcgtcgacgtcctcgaccgggtggacctacacgccgacttcgatcctcggcgcgactacgcgctgacggtctcgggcagcgaactcaccgataccgaacgcgccgcggcatcgcccgacgacatcgagttgtag

SEQ ID NO: 5551 - DNA, 1020 bp, Amycolatopsis azurea
gtgtaccggcggctgaccgaacgactgtctacggcgacccaccaaccgagcgcgttgcgatcagtgatcgattcctggttctacacgctcgaagaggaggttctcgacactggcgaagtcgacgaggaggacgaagacgccatcgccgaagccgtggacactctcatggagcgtcgcctaggtgatgtcgccaggacaacccccgccttcgcttcggctctccgcggataccggcatgtgaagcgtgccgatgatgcggcgaccgcagaagcggtaatcgcttggctgggcgggcaaaagtcagtggcggcctccgcgaagcgagccgccggagtgcgcggagacctcgaccatttcggggcgctcggctttctccaaggcctgctgaccgtgctgaaggattgcggtcacccgggccttttggtcgtgctcgacgagatcgagaccctccagcgcgttcggggtgatgtgcgcgagaagggcctcaacgctctccgccagttgctggacgaaatcgacaccggccgctttccaggactcttcctggtgatcaccggcactcctgcgtttttcgatggacaacaaggcgtccaacgcctaccgccgctcgctcagcgacttgcgaccgacttcaccaccgacgcccgcttcgacaacccacgtgcggttcagctccggcttcccggattcgacctgaaccggcttggggagcttggtcggaacgtccgcgatctctatgtcggcgatgccaaggagcccgaacggatcgccgctcgcgtggacgacgcctatgtcgatgaactagctcgggctgtcaccggcgggatgggtggcaaggtaggtgtcgcaccacgcgtcttcctccggaaactcgttcaggacgtgctcgaccgggtcgacgaacacgaggagttcgacccgagggtgcactatccggtaaccgtcaagggctctgagctctcagaggaagaacgcaacaccgtcgccgatgtcgacgacatcgatctggatctcccgtga

SEQ ID NO: 5552 - DNA, 1320 bp, Marinobacter sp.
atgtcgattagccagcaacggcgtcaggatattctggatgcgctgcggcgtggaactgtaccccaatacggtttggacgccctggcggttgggctgcaaccgttcgagcaggcgtttgacgaagagttaggaaaagtgtgccgtggtggtgccgttttcaaagcaattcgtggtgaatatggcagcggcaaaacctttgcatcgcgttggctgcgtgaaaaagcgcacggttgtgggttcgcctgtgccgaagtgcaaatttcagaaaccgaaacgcctctgcatcggctggaaacggtttatcgacgcttgatggagcgtctgaccacgccagacagcgcttctggtgcatttcagaacattgttgaatcctggttttatacgctggaagaagatgtgctgtcgcagcaggatatagacccagaagactccgaggctttggtcagcgcaacggatgttctgatggagaaacgattgggtgaggtggtgcgctcggcaccggcatttgccttaacactgcgtgcttatcgccgcgcactgttggaaggtaaagaagaaattgctgatggcttactggcctggatggcagggcagccgaatattgcggccgccgtgaagcgttacgcgatgattaagggcgatattgatcattttggagctttgagcttcttgcagggcgtactgaccattttgaaagactctggccatccgggattgttattggtgtttgatgaagttgaaaccctgcaacgcatgcggggagatgttagggataaaagcttgaacgcactgcgtcagctgatggatgaagtggattctgggcgcttccctggtttgtatcttgttataaccggcacgcctgctttttttgatgggcccatgggggtgcaacgtctggcaccgctggcccagcggcttgctgtggattttaataccgatgcccgttttgataacccacgagctgtacaggtgcgcttgcgtggctttaacctggcgtcgttggaagaagtcgggtgcaaggttcgtgatctttatgcgcaaaacagtgttgttagcgagcgaattttgcagtcagctgatgatcgttatattgcggaattagcacaggcggttaccggtaagctgggtgggaaaatcggtatcgcaccgcgtatatttttgaaaaaactggtgggcgatgtgttggatcgcattgatcaatttgatgatttcgatcctcgtaaacactatgcgctgaccattgcagacactgagttgacggcggtcgagcgggctaataaacctgcaggttcggtcaatgatattgaacttgatatttga

SEQ ID NO: 5553 - DNA, 1317 bp, Saccharopolyspora erythraea
gtgagcgtggtcagcgaagctcgacgccgcgacgtgatcgacgcgttgcggcgcggcactgtgccccaggctggactggacctgctcgtggtcggacttgaccggttcacgaccgcgatgagcgacgatctcgacaccgtggcgcggggtggtgccgccttccacgcagtgcgcggcgagtacgggtcgggcaagacgttcttctcccgctggctggccgaatccgctaagcggcgcgggatggcgacctccgagatccagatctccgagaccgagaccccgttgcacaagctggagacggtgtaccggaggctcaccgaacgcctcgccaccgccgcacatcggcccagcgcgctgcgttccatcgtaaactcctggttctacacgcttgaagaacaggtcctcgatgccgacgagatcaaccccgacgaccaggctgccctcggcgaggccgtcgacgcacttctggagaaacgcctcgccgacgtcgcgcgcacgacccccgcgttcgccgctgccctgcgtgggtatcggcatgccgtcgactccggcgacaccaccacagccgaagcactgatcgcatggctcggggggcagaggtccgtcgctgcatccgcgcgtcgggccgccggtgtacgcggggatctggaccacttcgccgctttggggtttctgcagggactgttgacggtgctgcgtgactgtgggcatcccggactgctgctggtgctcgacgagaccgagacgttgcagcgtgtgcggggcgacgttcgggagaaggggctcaacgccctgcggcagctcctcgacgagatcgacgcgggacgctttcccgggttgttcctggtgatgactggaaccccggcgttcttcgacgggcgtcagggtgtgcagcggctgcccccgctcgcgcagcgtctcgccacggactttacgacagacgcgcggttcgactcgccgcgcgccgtgcaactgcggctgccaggattcgacctgccgtccctgggcgagctggggagacgcgtgcggaacctctacgccgatggagcacggaatcccgagcgagtgcgttccctcgtcgacgattcgtatgtggatacgctcgctcgggcgctcgccggcgaacttggcggtcaggtcggagtggcgccgcggatcttcctgcgcaaactcgtcgccgacgtgctcgaccgcgtcgacgatttcgacgacttcgatccccggcagtactacaccctcacactcagctcgggtgacctatccgaagtggaacgcaacgcgtcacgtgctgaggacgtcgacctggatctgccgtga

SEQ ID NO: 5554 - DNA, 1350 bp, Streptomyces turgidiscabies
gtgagcaccaccggatcccagcgcctcgcacaggtgagcgccgcccgccgccgtaccgtcatcgacgcgctgcggcgcggtgccgtacccgacagcggactcgacctgctggccaccggactcgaccggttcgaagcagccctggacgcggaactggacgccgtggcgtccggcggctccgtgttcaaggccgtgcgaggtgagtacgggtccggcaagacgttcttcacccgctggctgggggagcgggccaagcgccgcaacttcgccgtggccgagatccaggtctcggagaacgagaccccgctgcaccggctggagaccgtttaccggcggctcaccgaacggctcaccacctccagtttcccgcccagcgcgctgcggcccgtggtcgacgcctggttctacgccctggaggaggacgctctcgcggccggagcgaccgaggaggaactgccgaacgaggtggagaggctgctcgtcgcacggctcgccgaggtctcccggcacgccccgtcgttcgccaccgctctgcgcggctaccggtccgccctcgcggacggcgacgaggcgactgccgcggccgtcctggcgtggctgggcggccagccgcacgtcgcggcctccgcccgccggtcagccggggtacgcggcgacctcgaccacttcggtgcgctcgggttcctgcaggggctcctcaccgtactgcgcgactccgggcacaccgggctgttcgtggtcctcgacgaggtggagaccctgcagcgggtccggtcggacgcccgtgacaaggcactcaacgcgctgcggcagctcatcgacgaggtccactcgggccgtttccccggcctctatctggtcatcacgggcaccccggccttctacgacggtcagcagggcgtacagcgtctggccccgctggctcagcggctggccaccgacttcacgaccgacccgcgcttcgacaaccctcgcgccgtgcagatcaggcttcctggcttcaaccaggagtccctggtcggactcggcctcaccatccgtgacctgtacgccgacgccgcagagatgcccgagcgcgtgcggaaggttgtcgacgacgcgtatgtcgccgacctcgcggtggccgtcggcggcgcgttgggcgggaaggtcggagtggctccccggctgttcctgaagaaactcgtcggggacgtactcgaccgcgtggaccagttcgacgacttcgacccccgacagcactaccggctcaccgtcggcggcagcgaactcaccgatgtcgagcggaacctggccgccacggtgtccggagactccgcgtcggccgatgacatcgacctggagctgtga

SEQ ID NO: 5555 - DNA, 1314 bp, Gemmata obscuriglobus
gtgacggtcagcccccgccgccgccaggagatcgtcgacgccctgcgccgcggcacggtcccgcacagcagcctggacgccttcgccgtcgggctggagcggctcgaacccgtgttccaggaggagctgctcgccgtcaaggcgggcggggccgcgttcaaggcgtgccgcggggactacgggtgcgggaagacgttcctggcccggtggctggcagaccgggcccgccggctggggttcgccacggccgaggtccaggtgtcggagaccgagacgccgctgcaccggctggagacggtctaccgccggctgtgcgagcggctggccacggccgatgcgtcgcaaggagccttgcggaacctgatcgacgggtggatctacgccctggagcaggacgcactggccgagggcgggacgggggacgagggcgagctgctggcccggacggaccgcctgatggagcagcggctggcgagagtcacggcggcggcacccaccttcggcacggccctgcggggctaccgccgggcgcaggtggcgggggacgcggcgaccgccgacgcgatcctggcctggctggccgggcagccgaacgtggccgcggcggcgaagcgggcggccggggtgaagggggagatcgaccacttcggagcgttaaccttcctccagggcctgctgacggtcgtccgggactccggcggtgccggcctgctggtcgtactcgacgaggtggagaccctccagcgggtccgcagcgacgtgcgggacaaggggctgaacgcgctccggcaactgatcgacgaggtggacgggggccggttccccggcctgtacctgctcgtcaccgggacaccggccttcttcgacggcccgcagggggtgccgcggctggagccactggcccagcggctgcacgtcgacttcaagacggacgcccggttcgacaacccgcgggcggtgcaggtgcggctggccgcgttcgacctggaccggctggcggcggtcgggtgccgggtccgcgagatctaccggcagcactgcccggcggccgaccggatcgcccgcctgtgtgacgacgcctacgtccgggatctggccgcagcggtcgccgggaaactcggcgggcgggtggggatcgccccgcgggtgttcctgaagaagctggtggccgacgtgctggaccgcgtcgaccagttcgccgacttcgacccgcggcgggactacgccccgacggtgaccgagggcgagctgacggcggccgagcgggccgccgcgcaggcgaccgacgtggacgacatcgagttggacccgtga

SEQ ID NO: 5556 - DNA, 1281 bp, Rhodococcus ruber
gtgagcgcggcggtgtcgccacggaggcgacgagagatcctcgacgcgctgcgacgcggcaccgtccccgcgaacggtctcgaccagctcgccgtcggactcggacggttcgaatgcgaactcgatgccgagctcgaggtggttgccggcgggggagcgatgttcaaggccgtgcgcggcgactacggctccggcaagacgttcttcgcccgctggctcgccgaccgcgccaccaaacgcgggttcgccgtcgccgaggtgcagatcaacgagatcgacacgccgctgcacaagctcgaaactgtgtaccggcgcagcatcgaatccctgcgtactgcctcgattccgccgtccgcgctgcgtccgatcctcgacgcgtggctgttcaccatcgaggacgacgcgacgcagcagggcgcgagtgtcgacgacctgctcgaacgtcgcctcgccgacgtcgccgcgcgcgcaccggtgtttcccatggcaattcgtgcctaccggcagatggtggccgagggggaccacgacggcgccgacgggctggtcgcgtggctcggcggccaaccgcacgtcgcggcgtcggtcaagcgccgcgccggcatcaagggcgacctcgatcatttcctggcactcggcttcctacgcggactactcgcggtacttgccgacgccggcaacgccggtctgctgctggtgctcgacgaggtggagacgttgcagcgggtgcgctccgacgcccgcgccaaagcactcaacgcgctgcgccagttgatcgacgagatccacgacgggcatttcccgggcctgtatctgctgatcaccggcacaccggcgttcttcgagggtcggcagggcatccagttgctgccgccgctcgccgaccgcctgcacaccgacttctcccgcgacccgcgcttcgacaacccgcgcgccccgcaactcaggctgaacggcttcgacctggatcggctcgtcgagctcggtggacgggtgcgggatctgttctgtagcggaatcgactccgccgaacgtgtgcgggcgaccgcagacgacgagttcctccgccgcttcgccggtgcggtcgccggcagtctcggcggtcgcgtcgggatcgcgccgaggttgtttctgcgcaaactcgtcgacgtcctcgacgtgatcgagttgcacccggacttcgacccgtacaccgattacgagatcaagatcggggcatccgagttgtcagaggccgagcgggaggtcgtgtcggcgggcgatgtggagctggacctgtga

SEQ ID NO: 5557 - DNA, 1275 bp, Mycobacterium xenopi
gtgagcgtgtcggcgcggcggcgccgcgagatcctcgacgccttgcggcgcggcaccgtgccgtccaacgggctcgaccagttggccgtcgggctggggcgattcgaagccgaactcgatgcgtcgctggacgccgtcgctgccgggggcgcgatgttcaaggcggtgcgcggcgaatacggctcgggtaagacgtttttcgcgcggtggctggcgggccgggcgatgaagaagggcttcgccgtcgccgaggtccagatcaacgagattgacaccccgctgcacaaactggagacggtgtaccggcgcagcatcgaatccctgcggaccgcgacaattccgccgagcgcgttgcgcccggtgctggacgcctggctgttcaccatcgacgacgacgcccgccagcagggcgtggacgccgacacactgctggaacgccggctcgccgacgtcgcggcgcgagcaccggtgttcccgttggcgatccgcgcctaccggcgcatggtcgccgacggggatcacgacggcgccgacgggctggtggcctggctcggcgggcagccccatgtcgccgcggccgtcaaacgccgggccggcatcaagggcgatctcgaccactttctcgcgctgggctttctgcgcggcctgttggcggtcctggcggacgccgggcaccccgggctgctgctggtgctcgacgaggtggagacgctgcaacgtatccgcagcgacgcccgggccaaggcgctcaacgcgttacgccaactcgtcgacgaaattcacgacggccatttccctggcctttatttgttgataaccggaactcccgccttcttcgtgggccgccaaggcatcccgttgctgccgccgctggccgaccggcttcacaccgagttcgccaaggacccgcgcttcgacaacccgcgggcgccgcaactgcggctcaccgggttcgaccagccccggctgatcgaactgggcacccgcgtccgcgcgttgtacatcgccggcgtgcccgaccccaaccgagttgcgtccgtcgccgacgactcgttcctgcaacggttctcggccgcggtcacaggcgagctcggtgggcgagtcggcatcgcgccgcggctgttcctgcgcaaactcgtcgacgtcctcgacaagatcgaacagttcccggacttcgacccgtaccgggattacgaggtgcgcatcgccgagaacgaactgtcgcccgccgaacgcgccgcgctgaccgccgacgacgttgcactcaacttgtga

SEQ ID NO: 5558 - DNA, 1302 bp, Micromonospora sp.
gtgacggtcgaggtgagcgcccggcggcgcaaggacatcgtcgacgccctccgccggggagccgtgcccgccaacggcctggacgccctcgccgtcggactcgaccgcttcgctgcggccctcgacgaggacctggaccgtgtcgccggcggcggcagcgtgttcaaggccgtgcggggtgagtacggcgcgggcaagaccttcttcacccgatggctcggcgagcgggcgaaacgccgtggcttcgcggtggcggaggtgcaggtctccgagctggagacgccgctgcaccggatggagacggtctaccgccggctggtcgagcaactgaccaccgagcagttcgcgccgagcgcgctgcgacccgtactcgacggttggatctacgcccttgaggaggacgtgctggccgccggcacggtcgccgaggccgacgcggacggtctcgaccgggcggtcggcgaactgctcgaacgccggctcgcggacatctcccgcagcacccccgggttcgcggcggcgctgcggggctaccgggccgccatcgccttgggcgaccacgtgaccgccggaggactggccgcctggctgggcggccagccgcacgtcgcggcgtcggcgaggcgggcctccggggtcaagggcgacctcgaccacttcggggcgctcagcttcctgcagggcctgctgacggtgctgcgggacagcggccaccccggcctgctcctggtcctcgacgaggtcgagaccctgcaacgggtacggtcggatgcccgcgacaaggccctcaacgcgctgcggcagctcgtcgacgacatctacgccgggcgcttccccggcctgttcctgctgatcaccggcaccccggcgttcttcgacggccagcagggcgtgcaacggctcgcgccgctggcgcagcgcctcgccaccgacttcgggccggagccgcgctgggacaacccgcgcgccacccagctccgcctgcccggcttcacccagaccgccctggttcagctcgggatacgggtccgcgagatctacggcagcgaccgggtcaccgccgtggccgacgacgagtatctcggcgagctggcgagcgccgtcgccgggcggctcggcggtcaggtcggggtcgccccccgggtgtacctcaagaagctcgtcgccgacgtgttcgaccgggtggaccagttcgccgactggaacccccgggagcactacgcgctgacgctgcgctccgacgagctgacggaggtcgagcggaacgccgcctcggccgacgacgtcgacctgaccctgtga

SEQ ID NO: 5559 - DNA, 1374 bp, Saccharomonospora xinjiangensis
atggcaggcgccgtgagcgaggcgcgcaggcgggacgtgatcaacgcgctgcgccggggaaccgtgccgcagaccggtctcgacctgctcgcggtgggactcgaccggttcggcaccgccatggacgacgacctcgccaccgtcgccaggggaggagccgccttccacgccgtgcgcggcgagtacgggtcgggcaagacgttcttcgcgcgctggctcgccgaacgcgccaagcgcaagggcctggcgacctccgagatccagatctccgagaccgaaaccccgctgcaccggctggaaacggtctaccgcaggctcaccgaacgcctgagcaccgcgacccaccagccgagcgccctgcgcgccgtggtcgattcctggctctacacgctcgaagaacacgtgctcgacgccggggaggtcaccgaagaccacgaggaggcgttcgccgccgctgtggacacgctcgccgagcagcgcctcgccgacgtggcccgcacgacacccgcgttcgcctcggcgctgcgcggctaccggcgggcactcgccgacggcgacaccggcacagccgaggcgctcatcgcctggctcggcggccagaaatccgtcgccgcctccgcccggcgcgtggcaggcgtgcgcggggacctcgaccacttcggcgcactcggattcctgcaaggtctgctcaccgtgctgcgcgactgcggacaccccggcctgctgctcgtgctcgacgaaaccgaaacgctgcaacgggtgcgcggcgacgtgcgggagaagggcctcaacgcgctgcgccagctcatcgacgagatcgacgcgggccgcttccccggcctgttcctcgtcctcaccggcacacccgcgttcttcgacgggcaacaaggcgtgcagcggctgccgccgctggcgcagcgcctcgccaccgacttctccaccgacgcccgcttcgactcaccccgggccgtgcagctgcggctccccggcttcgaccttgagcggctcggcgaactcggccgcaccgtgcgcgacctctacgcgggcacggcacgtcaccccgagcgggtgcgcgcggtggtggacaacacctacctcgccgtgctggcggaggcgctcaccggcgaactcggcgggaaggtcggcatcgcgccacggcttttcctgcgcaaactcgtcgccgacgtgctcgacagggtggatgacttcgccgacttcgacccgcgccgcgactacccgatcaccgtcaccgacgccgaactcaccgacgtcgaacgcaacgccgtcgcgggcggcagtgtcggcagtgccggcagcggcggtagtactggtgatgccggcacggctgacgagatcgacctggaactgccgtga

SEQ ID NO: 5560 - DNA, 1323 bp, Bradyrhizobium sp.
atgagcgagacgagtgggccgagcgtcctcctccgcaaagacgtcatcgaggcgctgcgccgaggaacagtgccgcgtcgaggcctcgacctgttcgcggtcggcaccgaccgcttttccgtatcgctcaaagaagagctggaacgctgcgcaacgggcggcgcggtgttcaaagctcttcgcggcgacttcgggtgcggcaagagcttcaccgcgcgctggtaccaacagcaagcgctcgcgcgcggattcgctgttgccgaagtgcagatctccgagaacgacaccccgcttcaccggcttgaaacggtgtaccgccgggcgacagaaggtctgcgcacagcggagtgggacacgggcgcgtttcgcgcgatcatctcgcagtggctaatgggcctcgaggaagaggtctcgcgtacgctccgggatcccgatgacatgaaggcgctttcggaaggtgtggggaacttgctcgaggcacgtctgaaggacgtgagcgcagtgcagccccaatatgcagcggtgctgcgcgcataccacgccgccgaagtcgcaggtaacctcgcgctctccgaaggcctcattgcgtggctgatgggccagcccaacgtcagcgcggacatcaagaagcaggcaggcatcaagggcgagattgaccacaccggcgcgctcggcttcctacgcggcctcctcgcggtgctccagcagtgtggacggccgggcctcctgctggtgctcgacgaggtcgagacgatccagcgggtccgctcggacagccgcgacaagagcttggaggcgattcgaaaactgatcgatgacctctacggcgggcgcttcgcggggctctacgtcctcatcacgggcacacccgcatttttcgacgggccgaacggcgtgaagcgcctgcccccgctcgctcaacgtctgtacgtcgacttctcgggggatgcgaagtgggacaacccccgcgacgtccaggtgcgcctcttcccgtttgaccaagagcggctcatcgaggtcggccgccgcgtgcgtgacttgtacccaacagaacatcctgagcacatgaaggcgcgtgtcactgacgcagtgctgactggcgtcgcgcacgaggtcgcaggaaagctaggcggcaaggtaggtgtggcccctcgaatcttcctgcggaagctcgtggcgacgatccttgatcgcgtcgacctgttccccgagttcgacccagccaaggacctcaatatccgcgtcgacgtggaggagctcacagtcgaagaacaggcggccgccgccggcaagaggcccgacgatatcgagatcgacctgtga

SEQ ID NO: 5561 - DNA, 1317 bp, Planctomyces maris
atgatcagtccccggcgcagagaagaaattattgacgccctcaggcgtggtaccgtcccccagaacagtctcgatgcatttgccgtcggtctcgatcattttgaaccggcactcaaagaagaactggagaaagttgcttcctcaggcggagtatttaaggcagtccgaggtgaatacggctgcggaaaaacattcttctcacgctggctcgcagatcaggcacgcaaacagggatttgcctcggcggaagtccaggtctcggaaacggagacacccctgcatcgcctggaaacagtctatcgcaggctgatggaacggctttccacagcagggactccccagggtgcctggcgaaatattgtcgatggctggttctatgcacttgaggaagatgtcctgtctgaaggacagattgacgaagcagatcagcaggccctgctggagcgcacgaacgagttgctggaacagcgactggccaaggttaccgatatcacgccgactttcagctcagccttgcgaggttatcgccgggcacaggtggcaggcgaaagagcaatcgcggacggtattctggcctggctggccgggcaaccgaatgtgtctgcctcggccaaacggtattgtggcgtgaagggtgatatagaccattttggcgcattgagttttctccagggagtcttgactgttctgcgtgattccggacatccgggactgctgttgattctggatgaagtggaaaccattcaacgtgtgcgcagcgatgtacgggataaaagtcttaatgcactgcgtcagttgattgacgaagtcgattcgggtcgttttcccggactctatctgttggtaacaggcacacctgccttttacgaaggtcctcagggaattcaacgactggaaccgctggcccaacgtttgcatgtcgacttccagaccgatgcccgatttgacaatccccgcgccccacaaattcgccttccggccttcagcctcgaacgtctctgcctggtaggatgtaaggttcgagatatctaccagcagcacgcacaggcctcagaacggattgcagagttgtgtgatgacagctatgtgcaggaactggcccaggcagtggccggtaaactgggtggaaaagtgggagtggctccccggatctttctgaaaaagctggtggcggacatcctcgaccgcatcgaccagttcgacgatttcaaaccgcacgaacattacacgctgacgatgaccgattcagaattaaccaccgtcgaacgccaggccgctggtgctacggatatagatcagatcgaactcgagttatag

SEQ ID NO: 5562 - DNA, 1350 bp, Streptomyces gancidicus
gtgagcaccaccggatcccagcgcgccacacaggtcagcgccgcccgccgccgtaccgtcgtcgacgctctgcgccgcggggcggtgcccgagagcgggctcgacctgctcgccacggggctcgaccggttcgaggcggccctcgacgccgaactggacgccgtcgcgtccggcgggtccgtgttcaaggctgtgcgcggtgagtatggctccggcaagacctttttcacccgttggctgggggagcgagccaagcgccgcaacttcgccgtggccgagatccagatctcggagaacgagacgccgctgcacaagctggagacggtttaccggcggctcaccgagcgcctcaccacctccagcttcccgcccagcgccctgcggccggtcgtcgatgcctggttctacgctcttgaggaggacgctctcgccgccggagcgaccgaggaggagctgcctggcgaggtggagaagctgctcgtcgcgcggctcgccgaggtgtcccggcacgccccctccttcgccaccgccctgcgcggctaccgggccgccctcgccgacggcgatgaggcgaccgccgcagccgtgctggcatggctcggtggccagccgcacgttgccgcctccgcccgtcggtccgcaggcgtacgcggagacctcgaccacttcggggcgctcggcttcctgcagggcctgctcaccgtgctgcgcgactccgggcacaccggtctcttcgtcgtcctcgacgaagtggagacgctccaacgggtccgttccgacgcacgggacaaggcactcaacgcactgcgtcagctcatcgacgaggtgcactccggccgcttccccggcctgtacctcgtcatcaccggcacgccggccttctacgacggccagcagggcgtccagcgcctggccccgctcgcccagcggctcgccaccgacttcaccaccgacccgcgcttcgacaaccctcgcgcggtgcagatcaggctgcccggcttcacgcaggaatccctggtcggcgtcggcgtcaccattcgggacctgtacgcggacgccggcgcgtcgcccgatcgcgtgcggacggtcgtcgacgacgcctatgtcgcggacctcgcgcgggctgtcggcggagcactgggcgggaaggtcggggtggcgccccggctgttcctgaagaagctcgtcggtgatgttctcgaccgtgtggaccagttcgacgacttcgacccacggcagcattacaaactgacggtggccggcagtgagctcaccgacatggaacgcaacctggccgcttcggtcaccggtggctccgcgtccgccgacgacatcgacctggagctgtga

SEQ ID NO: 5563 - DNA, 1296 bp, Gordonia amicalis
atgagtaccctttctccggtgcggcgccgagaggtgctgacggccctccgacagggcaccgtccccgccggaaatcttgatgttttggcagtcggaatagaccgctttgcgccgacagtcgacgaggagatcgaaacggtcgctgcaggcggttctgcgttcaaagctgttcgcggtgaatacggttcgggaaagacgttctttgctcgctgggtacagcaacgtgcaatgcgtcgcggaatggctgttgccgaggtacagatcagcgagctcgagaccccgcttcacaagctcgaaaccgtctatcgccgcacgaccgaatcgctgcacacggcagcctttccaccctcagccttccggaacgtgatcgacacctggttgttcgggatcgaggaggacgccgccgccgcggccggagttgatgaggcctccaccgcacagatcgaggcgctcctcgagcagcgcctggcagcagttgcatctgcgaccccggtgtatccgatggtgttgcgtgcgtatcgagatgcactcgagcgggaggacgtggccactgccgacgcactgatcgcctggctcggtggacaaccgcatgtgggcgctgcagccaaacgtgccgccggcgtgcggcaagacgtggaccacttcctcgcgatgggctttctacaaggcttgcttgccgtcctcaagggcgcccgccatcccgggctattgctcgtgatagacgaggtcgaaaccctccagcgcatgcgatcggacagtcgagccaaagcgctcaacgcgctgcgccaatggatcgacgaactcgactccgggcggtatcccggcctgtacttgatgattaccggaacaccagcgttcttcgatggccggatgggaatccagtcactcccaccactggcgcagcgtctccatacggacttcaccacggacgcacgtttcgacaacccacgtgccccgcaggttcgcctcgccggattcgatctggatcgcctggtagaggtgggcatccgggtacgcgatctgtttgcagacggagcgcaatcacccgaacgaatccgcacagtcgtcgacgacgcgtacattcgtcacctcgcatccgcggtagcaggaaaattgggtgggcaggtcggcatctcgccgcgactgttcctgaagaagttggtcctcgacgtgctcgatcgagtggacctacatgacgaattcgatccgcgccaacactattcactcaccgtggacaagaaggaactcaccgacatcgaacgagccgccatgtcagccgacgacatcgagctgtga

SEQ ID NO: 5564 - DNA, 1281 bp, Mycobacterium intracellulare
atgagcggcgtggtcagcgcgcgccggcggagagaagtcttagacgctctgcggcggggcaccgtgccgcacaacggcctggatttgcttgcggtcgggctcgaccggttcgaggcaagcctcgactccgagctcgacagcgtccggtctggcggcgcggtattcaaagccgtccgtggtgagtacggctcaggcaagacattcttctcacgttggctcggcgaaagagcgaagcggctcggcatggcagtagccgaggtacagatttcggagacggagaccccactccacaaacttgaaacggtgtaccgccgagtctgcgagtcactggagacagcggagttcccgccttcggcttttcgtccggttcttgatgcgtggttgttcgctctagagtcggaaggtaattcggtcgatgaccttgtcgagagacgactggccgatgtctcgcgcacgacccccgctttcgcctcggcgctccgcggatatcggaatgcgcaaatcgctggagaccaagctaccgccgaaggcctggtggcctggctcggtggcgagcctcatgttgcctcgtcgatccgtcggtcggccggtgtccgcggggacctcgatcacttcggggcttttggctttctgcaaggcatcctcaccgtgctgcgggactccgggcatcccgggctgctgctggtccttgacgaggtcgagactctccaacgggtcaggaccgacgttcgggagaaggcattaaacgcactccgtcagctcatcgatgaaattgatggcggccggttccccggcctgtatctcctcatcactggaacccctgcattcttcgatggaacgcaaggcatacagcggcttccaccattggcacaacgaatggcaactgactttacgaccgaagcgcgcttcgataatccacgagcggttcagattcgactccccggcttctcgcaagagctacttgagaaggtgggctccactgtgcgcaatttgtatgcggacggagccaattcgagcgaccgagtccgccagctagtggacgacgactacattgcagcactcgctacggctgtcgccggatcgttggggggacaggtgggggttgcaccacgcgtctttctcaagaagctcgtcggcgatgtcctcgaccgcgttgaccagttcgctgacttcgacccgacgcagcattacaagctcacggtgaggctgggcgagcttaacgacgttgagcgaaatgctgcatccagcgcgcccatcagtgtggacgacatcaagctgtga

SEQ ID NO: 5565 - DNA, 1317 bp, Phaeospirillum molischianum
atgctgagcccccgccgcagaaccgagatcatcgatgcccttcgccgaggaaccgtgccgaaatccggcctcgacgttctcgccgtgggcatggaccggttcgagcgcgctctcgatagcgaactggaaacagtttccctgggtggggcggccttcaaagcaattcgaggagaatacggatcgggcaagacattcttcggccgctggttccaggaacgggcacgatcgaaaggctttgccaccagcgaggtgcagatctcggaaaccgagacaccattacatcggatggagacggtctaccggcgcctgattgaacggctggcgacagccgatatggcctctggtgcgctgcattcagtcatcgatggctggttttatcgtttggaggaagatcttctcgctgccgaaccagcgcttggcctcgatgccgagagccttcaccagcgttccgtcgacctgatggaacagcggctgtccgccgtcagccgaaccgcccccgccttttccgcagtgctgcgaacctatcgcgatgcgttgctaaagggcgacgcgcaactggccgaagggctgttggcctggctcggcggtcagcccaacgtcgcagcctcggtcaaacgggcggctggcatcaagggagagatcgatcacttcggggcggtcaatttcctcgccggattgctgaccatcctgcgcgattccggctttgccggcctggtgctggtgctcgatgaggtcgaaacccttcagcggatgcgggcggattccagggaaaagggattgaacgcgctgcgtcagtttatcgacgaactggacgccggacgtttcccaggcctgtacctcgtggcgaccggcacgcccgccttcttcgatggcccccagggtgttcagcggctgccaccactggctcagcgtctgcatgtcgatttcaccactgaccctcgcttcgacaatccccgcgcaccgcaattgcgcctcaagggatttgatctcgatctccttgccgccgtgggaggaaaggtcagggatatcttcagcgatcagtccgtgaaggtgtctcgggtgcgctcggtggtcgatgacgactatatcctggacctaggccgcgctgttgcaggtggcctagggggcaagattggtgtcgctccacggctgttcctgaagaagttggtaggggaggtcctcgatcgtgtcgaccagcatgacgattttgacccgagacagcattacgccctgacgctggccgacaacgagatgaccctggccgaacgcgccagcgcaggggctatgtctgtcgacgatgtcgagctcgagatgtga

SEQ ID NO: 5566 - DNA, 1308 bp, Nitrococcus mobilis
atgacaacgctctctccagcccgcgccgacgaaatcctcgacgcgttgcgacgcggcacggtgccggaatccgcgctggaggcatttgcggtcggattggaccggtaccgcgagactctgcatgcggaacttcagcagtgcacgaccggacgcgggcgtttcaaggcggtgcgcggcgagtacggcaccgggaagaccttcttcgcccgttggtttcaggggctggcccgcagcgagagcttcgccacctccgaggtgcagatctccgagacggaaacgccgctgcatcgcttggaaacagtctatcggcgcctgaccgagcatcttacttcggccgaatcccaacgcggtgccctgcgctcgaccatcgacggctggttttatgcactagaagaggaagtggtcggccggcagggtgactgttccgaacaagcgctgctcgacggcaccgaggcattgatgcgcgaacggttgcgcacgatcgagcgacgggcgcctgcattcggcgcgtgcctgcgcggctaccgcacggctactgcggagggcaacgaggaactggctaccggactaatcgcgtggatgtcagggcaacccaatgtggctgccgcgatcaaacgcgcagccggcatcaaaggtgagatcgaccatttcggcgcgctcggtttcctgcagggcctgctactgatcttgcgcgataacggctttgccggcctggtgctggtgctcgacgaggtggagacgttgcagcgcgtacgcggcgatgtgcgcgagaagagtctcaacgcgctgcgccagttcatggacgaaatcgacgccggacgtttcccgggtctgtatttgatgattaccggaacgcccgcgttcttcgatggcccgcagggtgtgcagcgcctgccgccgctggcgcagcgcctgcatgtggagttcggccggaacgcgcggttcgataatccacgcgcggcgcagatccgtttgcaggcgttcgacttcgaccgtctggtggaggtggggcagaatgtgcggcgggtatttgccgcgcgctgcgccgatccggagcgcctgttgcgcacggccgacgacaccttgctgggcgatctggccgcgacggtcacgggcaagctcggcggcaaggtcggcgtcgcaccacggatcttcctcaagaagctggtcgcggaggtgctggaccgtatcgaccagtttccggacttcgacccgcgccgggattacgacctgagcatcgcagcgaccgagctgacgcgtgacgagcagcgcgtattgtcgcccaacgacatcgagctggatctgtga

SEQ ID NO: 5567 - DNA, 1392 bp, Frankia sp.
atgagcgccgatgtcagcgccgcgcggcggcgggatgtgctcgacgcgctgcggcgaggggcggtaccggcggccggtctggacctgctcgcggtcgggctggaccggttcgagcgcgccgccgccgacgacctggccgccgtcgccgccggcgggtcggtgttcaaggcgatccgcggcgaatacggctccgggaagacgttcttcacccgctggctcgccgaacgggcgaagaaggcggggctggccacggccgaggtgcagatctcggagaacgagacaccactgcaccggctggagaccgtctaccgccggctcaccgagcgcctgaccaccgcgacgttcccgccgagcgccctgcgccaggtcgtcgacggctggttctacgccctcgaggaggacgtcctcgccgccgacgaggcgaccggcgacgacccggtggccttcgacgcggccgtcggcgagctggtcgaccggcggctcgccgacgtcggcaggacggcccccgcgttcgcggcggcgcttcggggctaccggtcggcgctgaccggcggcgacgaggcgtccgcggcggcggtgctcgcctggctcggcgggcagccgcacgtcgccgcgagcgcgcgccgtgccgccggggtccgcggcgacctggaccacttcggggcgctcggcttcctgcagggtctgctggtggtgctgcgtgacagtggcttccgtgggctgctgctcgtcctcgacgaggtcgagaccctgcagcgggtccgctccgacgcccgcgacaaggccctgaacgcgctgcgccagctcatcgacgaggtccacggcggccggttccccgggctgttcctcgtcatcaccgggacgccggcgttctacgagggcgcccagggcgtgccgcggctcgcgcccctcgcgcagcggctcgccaccgacttcaccgccaacccgaggttcgacaacccgcgggccgttcagctgcggctggccgggttcaccgaggcgtcgctcgtcgagctcggcgggcgggtccgtgacctgtacgtcgccggttcggcgggcgatgcggcggggcgggaacgcatcgagcggcttgtcgacgacggctacctcggcgagctggcggcggcggtcgccgggcggctcggcggcaaggtcggcgtcgcgccgcggctgttcctcaagaagctcgtcggggatgtcctcgaccgggtcgaccagttcgacgacttcgacccccgccgcgactacccgctgatgatcgccgcggcggagctgaccgacctggaacgcaacgccgcccgcgccgacgacatcgacctcgaactggacgacgacctcgaactggacgacgacctcgaactggacgacgacctcgacctggaccagccctga

SEQ ID NO: 5568 - DNA, 1320 bp, Pseudomonas stutzeri
atgtcgatcagccaacaacgtcgtcaggatattctggacgctctgcggcgtggaactgtgccgcagtatggtttagatgccttagctgttggcttgttgcccttcgagcgcgccttcgatgatgagctggaaaaggtcagtcgaggtggagcagttttcaaggctattcgtggcgaatacggcagcggtaaaacctttgcgtcacgctggctgcgtgaaaaagcacaccggctgggctttgcctgcgccgaggttcaaatttccgagactgagacaccgctgcaccgcctggagacggtctatcgacgtctgatggagcgtttgactacgccggatatgccctcgggcgcatttcagaatatcgtcgaagcctggttctacacccttgaagaggatgtgctggcccagcatgacatcgatccgaatgactccgaagcgttgatcgatgccactgatttactgatggaaaagcgcttgggcgaagtcgtgcgctctgcacctgcattcgccctaactcttcgtgcgtaccggagagctctcctagaaggccaggaagagatcgccaacgggcttttggcctggatggcaggtcagccgaacatctctgctgcggttaagcgctatgcaatgatcaagggcgacatcgatcatttcggcgcgttgagcttcctgcaaggtgttctaaccatactcaaggactcagggcatcctggtttgctgctggtgctcgacgaggttgaaacactccagcgtatgcggggagatgttcgcgacaagagcctgaacgcgctgcgtcaattgatggatgaggtggactctgggcgattccctggcctttatttggtgattacaggcactccggccttctacgatggccctatgggtgtccagcgactgtctcctctggctcagcgtctggcggtcgacttcaccactgatgctcggttcgataatcctcgtgccgtgcaaattcgtctccgtggtttcagccaggagtctctggaggaggtcggtcgcaaggtacgtaacctgtatgccgataacagcgctacggctgaccgcattttgcggctggcagacgataactacatcactgagctggcaaaggcggtgaccggtaagctgggcggcaaagtcgggattgcaccgcggatcttcctgaaaaaactggtgggtgaggtcctggatcgtattgaccagttcgaagacttcaatccacgacagcactacgcattgaccatttcagataccgagctgacatcggtcgagcgcgctaccagtgcggcaagctcggtagatgatatcaagctcgatctttga

SEQ ID NO: 5569 - DNA, 1305 bp, Dietzia cinnamea
atgaccgtctcccccgcccgccgtaccgcgatcatcgacgcactccgccgaggcaccgtccccgccgacgggctggaccagctcgccgtgggcctcgaccggctcgcgccggtcctgggagaagaactggacaaggtcgccggcggcgccgccgtgttcaaggcagtccgcggcgagtacggatccggcaagaccttcttcgcgcgctggctccagcagcaggccctcgaccgcgggttcgccgtgtccgaggtccagatctccgaactcgagacgcccctgcatcggctcgagaccgtgtaccggagggcctgcgaagaactccgcacccccgccgtctctcgacaggcattccgggcggtcctcgacgactggctcctcggagtggaagacgacgcggcctcctccggagcagacggcgccgaattgctcgaagagcgactgcgctccgtcgccgatgctgcgcccgtgttcccgctggccctgcgcgggtatcgggacgcattgctcaacggtgataccgaggttgccgacgggcttgccgcctggctcggcggtcaacgcaacgttgccgcgtcagctaaacgagcagccggggtgaagggcgaactcgaccacttcctggcgatgggcttctttcaggggctactccaggtgctcgccggctccggacaccgcgggcttctgctggtcctggatgaggtcgagacgctccagcgcatgcgcggcgacgtccgggagaaggcgctcaatgctctgcggcagtggatagacgagctcgattcggggcgctaccccgggatgtacctgctcatcaccgggaccagcgccttcttcgaaggacagcagggcatcaagcgactgcctccgctcgaccaacggatcggcgtgaagttcgacgccgacccccgattcgataacccccggcaaccgcagatccggcttcaggccttcgacttcgaccgactggtcgaggtcgggtcgcgcgtgcgtgacctctacgcggccggcctcgaccccgcagtggcccagcggatcaccaccctcgtcgacgacgcctacctgcgcgtgctcgccgagtccgtggcgggaaagctcggcggtcaggtggggatcgcgccccgtcagtacctgcggatgctcgttgacgtgctggaccgggtcgagatgttcccggacttcctaccgcgacagcacttcaccccgacgctcgacgcgtccgacctcagtcagagcgaacggtccgcagtggcgagctcgtcgtcgtcatccctcatcgatgaccccgacgccatcgagctctag

SEQ ID NO: 5570 - protein, 79 aa, Acidiphilium multivorum
MDLVAAQMPHDPDPLSDIVFIQRTGALFPVYRTFSLLEQLKGRVTVPTILFYPGDLDGAAGLRFMGVLAAEHNYRPKIF

SEQ ID NO: 5571 - protein, 218 aa, Acidithiobacillus ferrivorans
MSLKLRQQPLAARFNHLLKVISSPRFLEMRGLNNDLPFYICEFNAQEAFEMQRTQRQLISQLRNTHVDCLQGRGVRVLDINLYDLSVGLLQAREGGAEGISLWDDILRLEPEIGKDRLLELLQNVLDIKEHLIPAIAQRLAHTDYDVLFLSGIGEVFPYIRSHNVLNNLQSTAKDKPTVMFFPGEYRHSLEQGASLELFGLLHDDKYYRAFNIFEVQV

SEQ ID NO: 5572 - protein, 191 aa, Acinetobacter baumannii
MSQKIHERLNQIPERILSTEFLTGQGLGNEIGFWIFDYAPEDELKVREYLHFLDGMLEKKHSQLKVVNINLLQAVVDYLAERNFIDKAIQMQKDKGDEALLKALKGPLHMDKFAPYLVSKYATNAQDIVLMTGVGSVWPLLRAHHLLNSLHSLLGHKPVVLFYPGYYDGQAMSLFGKIPSNNYYRAFRLVP

SEQ ID NO: 5573 - protein, 181 aa, Alteromonas macleodii
MSDRLSKLLSSFESHISIPWPSAVSADERTIFLVYHKEDELKLRARVEEFEYACTNNNHPWMLLDLTQSFETWMADQDYKETYFEDPEYLKGLFGDFADELVADLIAKVENNQNSNGVVALLGCGTLFGFASVSGLVESLAEKITGRLVVFFPGEVHENNYQLLDAKDGWGYHATAISANT

SEQ ID NO: 5574 - protein, 187 aa, Anaeromyxobacter dehalogenans
MARLEDLADLYGQHIATPWQRTVAGAQRVIMVAYDKELERALRARKGEFETRTRAAGHDWHEVDLTTAFASWIAADEYRDAYFESPEDLQLKLKEEFPEYAAEKIRAVLTSNDVSEASVVAVLGAGSLYGFTYVSEVLKRVERDVRGRLVVFFPGTLEQNNYRLLDARDGWNYMAVPISIYSAGGAA

SEQ ID NO: 5575 - protein, 192 aa, Aromatoleum aromaticum
MTDTFEDRLNQILPRVTSEDFLQNRGLGNEIGFWIFDYPPDAEIAMRNFISSVIEPVLKKHQPPLSFATLDLFELVVNLLEDRKLLDKAIDMQGKQGDDKALESLRRVLKEDKLAERIVQQHNPDALDLLMLTGVGAAYPMLRTHTLLSALHPHMKQTPLLMFYPGRYDGYSLRLFNKLSEDHYYRAFRLVP

SEQ ID NO: 5576 - protein, 199 aa, Arthrobacter sp.
MTAKTLSQQEEHLFRILSSQRFLRMEGLGNEVPFFIYPYDPELALEVADVKKRVKNKLANAGIQVREINLYDLAVALIRERGDWDDVIELETSVGKSEFGEVVRSMLNPEVHLAPAIRERLLDGAFDIFFLTGIGEVFPFIRSHNVLNNLQSVVTNKPMLMFFPGRYEFSATLGSSLVLFGRLKDDQYYRAKNIIDQEA

SEQ ID NO: 5577 - protein, 187 aa, Azospirillum lipoferum
MARIEDLAKVYERHIKLPWQRTVAGAQRIVMLVYEKEAERALRARLKNFEIATAEAGKTWRTVDITDSFAAWMAGEEYRDAYFEMPEDLQLKLDAEFAGFVADRIRLALTDPAVDEDTVVAVIGAGSLFGFTRLSRVLTLVEPDIRGRLLVFFPGQYEDNTYRLLDARDGWNYLAVPITMHGGGAQS

SEQ ID NO: 5578 - protein, 235 aa, Bifidobacterium animalis
MQSYSFSGYDALLSDGSYDATKDFEHVFEVMSQPSFLHMTGLGGEQPFYICDYPAERELEVRRCIDTLAARLRTTKYADGSPAPSILRIDLFDNVCEFLRHRGVLERVIALEPRRHTQISSDPMLDGFLGLLVNMVNATTNNLYDFLAEHYEQAFKNGEADIVFITGIGAVYPYVRGHTLLNNLQGRIEDSPLVMFFPGTYAQSSASGSSMRLYDRIEAENYYRAKNIRDVAIIS

SEQ ID NO: 5579 - protein, 203 aa, Bordetella parapertussis
MTADIARKPMQDRFQHLFAVISGQRFLNKQGLGNEVPFFICPFKPEESVEMERLQRQLVNRLEQAGVRILEINLYDLSIEILKERDIWDQIVEMEDSVSKEQLKELLQGVLDPEAHLVPAIAAKLASTDFEVLFLSGVGEVFPYIRSHNVLNNLQSTAKEKPTVMFFPGAYTHSLESGASLDLFGRLHDDKYYRAFNIFHCEA

SEQ ID NO: 5580 - protein, 187 aa, Burkholderia sp.
MSSKVATLVSAYRQHLTVPWQAGLAAIQRVIFAVYDKADELRLRANVGEFELASQQAGKQWLLLDVTNAFPEWMAAQEYRDAYFEAPEDLAGYQAGELTEFVADLNAKLKARIRSEAGSDTVVALLGVGTLFGLARVSSVVEGIKDAVEGRLLVFFPGEYHPESHTYRLLDARDGWNYLAVPLLARD

SEQ ID NO: 5581 - protein, 192 aa, Burkholderia gladioli
MSASFDDRLNQVLPRLLSADVLENKGAGGEIGFWIFDYPPDREMTMRGWLADVIEPGLRKQQKPIRFAIVDLFECIIGLLEDRRLLEKAFDMQQTKGDEALLTSLRSVLKEDRLAARIVEQTRVEEIDLLIVKGVGASYPMVRTHTLLSALHPHMQHKPLLMFYPGRYDGQSLRLFNTLVDDNYYRAFSLVS

SEQ ID NO: 5582 - protein, 192 aa, Burkholderia vietnamiensis
MSASFDDRLNQVLPRMLSADVLENEGAGGEIGFWIFDYPPDQEMKVRGWVADVIEPGVRKQKPDLRFATVDLFECVIGLLEDRRLLEKAFEMQRTKGNDAVLTSLRSVLKEDRLAARIVEQFSVADLDLLIVKGVGAVYPMLRTHTLLSALHPHMSDTPLLMFYPGRYDGQSLRLFNALVDDNYYRAFSLVP

SEQ ID NO: 5583 - protein, 196 aa, Calditerrivibrio nitroreducens
MGTNLTSKLNCLINILKDENYFRLEHIANEVPFYIFDYDPEAELDVRKTIKIISDSDQLKYRIEVVNIYDFIISYLQEKDFLEKIFEMEQKLSPEKFLTRLKSIIDPELIINKIVQLNDEKNPDVFILTGIGNSYPIIRIHQIINRLQEKVCNKVVIVMYPGTFDVNETEGKLILFNSLESKAFYRAFKICGGSLK

SEQ ID NO: 5584 - protein, 194 aa, Carboxydothermus hydrogenoformans
MKTIYERLDALIPAIQKKSFVENKGLGNEIGFYIFDYEPKYELLVREYIQFLKEKFKNGINGYKIKEFDLYEIMIDILEAKGYLTKNIEMEAIKGSEYVFNATKKALRLTTENDLIVQYIRERVEDKDIIFLTGVGKAWPIIRSHTILNNLHSVIEHVPLIMFFPGTYDGVELVLLDEIKDDNYYRAFRLIERY

SEQ ID NO: 5585 - protein, 196 aa, Chlorobium phaeobacteroides
MPMQDRFQHLFAVISGQRFLGKQGLGNEVPFFICPFKTEESVEMERLQRQLVNRLEQAGVRILEINLYDLSMEILKERDVWNQILEMEDSVSKEQLKELLQGVLDPEAHLVPAIAAKLASTDFEVLFLSGVGEVFPYIRSHNVLNNLQSTAKEKPTVMFFPGAYTHSLESGASLDLFGRLHDDKYYRAFNIFHCEA

SEQ ID NO: 5586 - protein, 194 aa, Clostridium clariflavum
MKTIYQRLDEIIQRITKESFRENTGLGNEIGYYIFDYEPRYEMLVREHVRFLIQKINEGDYGFHIKEFDLYEIMLELLETKGYLEKNFKMEQVKGSEFVFNATKRALRLTEKDDLIIQYIRDRVVKGDVVFITGVGKVWPIIRSHTVLNNLHQVLDEVPVIMFFPGVYDGLELVLFEEIKDDNYYRAFKLVDRY

SEQ ID NO: 5587 - protein, 194 aa, Clostridium clariflavum
MKTINQRLDEIILRITKENFRKNTGLGNEIGYYIFDYEPRYEMLVREHVQFLKQKINEGDYGYNIKEFDLYEIMLEILESKGYLEKNFKMEQVKGSEFVFNATRKALRITEKDDLIIHYIKERVEKDDIVFITGVGKVWPIIRSHTVLNNLHQVLDEVPVIMFFPGIYDGLELVLFEEIKDDNYYRAFRLVDRY

SEQ ID NO: 5588 - protein, 194 aa, Clostridium ljungdahlii
MKTIYQRLDGIIPKITDKSFRENKGLGNEISYYIFDYEPKYELLVRDHIQFIKQKISDEYSNIHIKEFDLYEIILETMDKKGYLQKNIEMEKKKGSKYVFNAIRKSLRLTLKNDMVLDYIVNRVEPNDIVFITGVGKAWPIMRSHTVLNNLHNAIDQVPVVMFFPGEYDGLELILFNEIKDDNYYRAFQLIDKY

SEQ ID NO: 5589 - protein, 194 aa, Clostridium saccharolyticum
MIELENRLNKLEEKIKQPNFRKNKGLGNEVGYYVFDYPAEYELLVRERIEYLASKYENDNHDFRIVVFDLYDIIIDNLIREGFLDICMDFEKAKGFSEITKAVNEMLRMEEDNQSNEILAHIRNNTPSNSIVFLKGVGKCFPMLRSHKILNNLHQFIDDVPVIMFFPGKYDGQSLMLFSEIKDDNYYRAFKLVD

SEQ ID NO: 5590 - protein, 191 aa, Clostridium saccharolyticum
MDLSQRLDEMELAIHKPSFRKGTGRANEVNYWVFDYPPEKELEVRERVEYLKNKNDRGDDDFELVVFDLYDIIIDFLEKKNFMEKCYDFEKKRGIERIVKAVTNSMKVNDDDSLIVQYIKEHTPENAVVFLTGIGKCYPILRSHKVLNNLHQAFVRCPVVMFFPGTYNEQELILFNEIKDDNYYRAFRLVK

SEQ ID NO: 5591 - protein, 193 aa, Clostridium sticklandii
MQNLENRLNQLEDKIKEDSFRKNKGLGNEVGYYVFDYSAEHELQVRNRISYLKSKYSQNSELNIVVYDLYDIIIDILEKEGFLDICMEFEKTKGFTEITKAVNEMLRMEEDNQSNEIIAHIKNNTKSGSIIFLTGIGKCFPILRSHKILNNLHQYIDDVPVVLFFPGKYDGQSLMLFDEIKDDNYYRAFKLVD

SEQ ID NO: 5592 - protein, 192 aa, Clostridium sp.
MASLTERLDQMEAAIRKPSFRQSSGRANEVNYWVFDYPPEKELEVRERIEYLKNKNAKGVDGFELVVFDLYDIIIDYLEKEDFLEQCYRFEKKRGLDRITKAVSNSMKVNDDDSLIVQHIKDNTPENAVVFLTGIGKCYPILRSHKVLNNLHQAFVRVPVVMFFPGTYNEQELILFNEIKDDNYYRAFRLVK

SEQ ID NO: 5593 - protein, 191 aa, Cupriavidus necator
MSSLKADFDELRERIRHGRELGHASFEPIYYLVFSPDQILEAKRQTPAWVAKLHQEGWNVHTFSIAEQIWALLKDDPFWSLCVMEDKSAPLDWPRTNKALADILTADNGLLKRLEDTLQPLEGQQNALLLVTDLEALHPFLRIGAIESQLHGKFHVPTIFLYPGVRTGKTRLKFLGFYPEDGNYRSVHVGG

SEQ ID NO: 5594 - protein, 202 aa, Cyanothece sp.
MSSLETISISQRFEHLLSVMSGERFLKKQGIGNEIPFFICPYPPQDSVEMERLQKQLISQLNHRGICVLEINLYDLCLELLRKRGIFEQILDIEFSISKGELKELLQNVLDSESHLIPAIAQKLQENPFDILFLSGVGEIFPYIRSHNVLNNLQTTTSNQPTVLFFPGAYTYSLESGASLDLFGLLRDDKYYRAFNIDEYKV

SEQ ID NO: 5595 - protein, 190 aa, Dehalogenimonas lykanthroporepellens
MPYLKANFDELIERMRHGRDLGHASFEPVYYLVFPPSQILDVKRSLPAWTSRLRNEGWDVHPFSIAEHITSILSTAAPRKIWLSADRKAPQAWKRTNDALANALSQGSLQQRLEAELTKLQDIPNALLLVTDLEALHPYMRIGAIESQLYGKFHVPTVFLYPGERTGKTRLKFMGFYPEDGNYRSVHVGG

SEQ ID NO: 5596 - protein, 203 aa, Desulfobacula toluolica
MTVDTQTQPIPERFKHLQTLISSDRFLKKQGLGNEVPFFICPYRPSEAVEMERMLKQLTNKLSQTGVQVLEINLYDISVEILKENGDWEWYLEEESKMTKDELKEELQSILDIETVLVPAIAKTITEQDHDVVFMSGAGEVYPYIRSHNVLNNLQSTVKNHPMVMFFPGEYTHSLESGASLDLFGRLHDDKYYRAFNIYHCEI

SEQ ID NO: 5597 - protein, 184 aa, Desulfomicrobium baculatum
MSKVKRLIQSYANFIAVPWREDAAPAQRVIFCVYDENEELRLRAKIEEFELTTRQAGHDWFVFDVTDSFALWLANEDYAEEFFREPSLLGDLLPEEYLRFLISSFNTYIGEATANPNAVIAVLGVGALFGFAKVKDLVDSLAPLVKGRLMIFFPGSYENNNYRLLDGYDGWNYLAVPITADKSF

SEQ ID NO: 5598 - protein, 192 aa, Desulfosporosinus meridiei
MASLEERLDQAERMIKMPSFRQNKGLGNEVGYYVFDYPAEKEMVVRERIEYIKAKNSKGTDGFELVVFDLYDIVIDMLEQEGFMEQCYKFEKKKGLERIVKAVGNLLQINDDASMIVQYIQKRTPQEAVVFLTGIGKCYPLLRSHKVLNNLHQAIDYVPVVMFYPGKYDGQTLILFNEIKDDNYYRAFRLVE

SEQ ID NO: 5599 - protein, 191 aa, Desulfovibrio magneticus
MSTTFESRLNKIIDRLVSKELLSNAGLGNEIGFYVFDYPPANELQVRAFIETIEDQLPKRKSGIRFRHINLFQLLIDYLQERRLLTRAFQLQREKGDAELLKALKGPLHEQKIAQYFVQVTQPEKQELVLMSGVGSSWPMLRTHTLLNSLHPLMGDTPLVIFYPGEFDGQGLRLFGTMKESNYYRAFRLVA

SEQ ID NO: 5600 - protein, 196 aa, Desulfovibrio vulgaris
MPMQDRFQHLFAVISGQRFLNKQGLGNEVPFFICPYKPEESVEMERLQRQLVNRLEQAGIRILEINLYDISIEILKERDIWDQIVEMEDSVSKEQLKELLQGVLDPEAHLVPAIAAKLASIDFEVLFLSGVGEVFPYIRSHNVLNNLQSTAKEKPTVMFFPGAYTHSLESGASLDLFGRLHDDKYYRAFNIFHCEV

SEQ ID NO: 5601 - protein, 203 aa, Desulfovibrio vulgaris
MTADIARMPMQDRFQHLFAVISGQRFLNKQGLGNEVPFFICPYKPEESVEMERLQRQLVNRLEQAGIRILEINLYDISIEILKERDIWDQIVEMEDSVSKEQLKELLQGVLDPEAHLVPAIAAKLASIDFEVLFLSGVGEVFPYIRSHNVLNNLQSTAKEKPTVMFFPGAYTHSLESGASLDLFGRLHDDKYYRAFNIFHCEV

SEQ ID NO: 5602 - protein, 183 aa, Desulfurivibrio alkaliphilus
MSRVKRLVQSYRKYIAVPWRDDAAAPQRVIFCVYHETEELRLRAKIDEFEIATRQAGHEWAAFDLTDTFAAWLTSQRYAASYFQKPHLLATLLPKYRAYIGDQFRAFLAQNRADANTVVALAGVGSLFGLQKVKDVVEELAPLVPGRLLVFFPGSYENNNYRLLDGYDGWNYLAVPLTADKEW

SEQ ID NO: 5603 - protein, 204 aa, Enterobacter cloacae
MRAKLDSKPQLSARLEQIEDRLKSEGFLKNQELGGEIGFYIFDYPPQFELTVREYLRLTLPRLARQGLNFAHLNLFEEVLAILQERKLLDKSFDLERKKGTDELAKALKGPLEQGRIAKHLIDKVLPASPQFVLLSGLGQCWPLLRGHSLLNALHAHMGAIPLVLFYPGSYNGLELYPFDLDSAEVATANYYRAFQLVPHASKY

SEQ ID NO: 5604 - protein, 200 aa, Erwinia sp.
MIDPVLEYRLSQVQSRISEDRFLKNNGSGNEIGFWIFDYPAQNELQVREHLKYLFRNLEKDYTFAHLNIFQIIIDILNQRRLFERVCQQEVKVGTEALKKQLVGLLNQKKIADHIAKEVDLKSQNFVILTGMGNAWPVVRGHELMSALQDVMGFTPLLMFYPGKYSGHNLAPLTDIDSRNYYRAFRLVPESGPSATLNPR

SEQ ID NO: 5605 - protein, 200 aa, Erwinia pyrifoliae; identical to SEQ ID NO: 5604

SEQ ID NO: 5606 - protein, 200 aa, Erwinia pyrifoliae; identical to SEQ ID NO: 5604

SEQ ID NO: 5607 - protein, 135 aa, Erythrobacter litoralis
MLDLNLFDIALDILSERGILEEVLEIEADTSKGEIKELLQGVLDPKAHLVPHIGKAIEAVPHDVIFLSGVGEVYPYIRSHNVLNNLQSTAKEAPTVLFFPGSYTHALATGASLELFGQLHDDKYYRAFNILNYEV

SEQ ID NO: 5608 - protein, 200 aa, Escherichia coli
MIDPVLEYRLSQIQSRINEDRFLKNNGSGNEIGFWIFDYPAQCELQVREHLKYLLRHLEKDHKFACLNVFQIIIDMLNERGLFERVCQQEVKVGTETLKKQLAGPLNQKKIADFIAKKVDLAAQDFVILTGMGNAWPLVRGHELMSALQDVMGFTPLLMFYPGTYSGYNLSPLTDTGSQNYYRAFRLVPDTGPAATLNPQ

SEQ ID NO: 5609 - protein, 200 aa, Escherichia coli; identical to SEQ ID NO: 5608

SEQ ID NO: 5610 - protein, 200 aa, Escherichia coli; identical to SEQ ID NO: 5608

SEQ ID NO: 5611 - protein, 200 aa, Escherichia coli; identical to SEQ ID NO: 5608

SEQ ID NO: 5612 - protein, 197 aa, Escherichia fergusonii
MHNMKALQTRLDLIQERIESPKFLKNDGLGNEIGFWVFDYPAKYELLVREHLKHVDEKLNKRGYRFVHLNIFEVLIDMLEERGLFDRACQRELQVGVDGLRKTLAGPLSQEKVARYIADKYKPSELEFVLLSGLGSAWPLVRGHELLSALQDVMGSTPLVLFYPGEYSGRDLHPFGMIESKNYYRAFKLVPEDGKKN

SEQ ID NO: 5613 - protein, 188 aa, Exiguobacterium sibiricum
MANLNARLDSIIPKIKEEKFIDGRGLGNEISFYVFDYEAKDELIVRDYVKHIKKEFNYEGTDRSIIEFDLYKMLIEITKEKRIFDRVFDMEEHQGKDALFRAMTAFAKPEVFVQKIKEQLDDHNVVFLTGIGKVYPFVRSHNILNNLQEVLDKTPVVMFFPGTYDGQSLQLFSKFKDDNYYRAFRLVD

SEQ ID NO: 5614 - protein, 185 aa, Flavobacterium branchiophilum
MAYIDENKAKFDNLKSILDVKNRSQLSLVANGGYSILFTYPPKEENLYIEKAKKELSSTNFKFIDASKIFVDFIDDYNLDNLIEVYKDLKPNSYKIFIDNTGTDKDFFDAIVNEIIETSKQGLIPVLIRTGVFYGTGIENINITQHSTIDELNMPLVIFYPGEINGDHHHYLNAKQSSNYRCTII

SEQ ID NO: 5615 - protein, 191 aa, Gallionella capsiferriformans
MSVFEERLNQILPRLTSKELLNNEGLSNEIGFWVFDYPPEFELEMRSFLADVIEPALAKHHPPIRFATVNVFDLAIGLLEERKLLDKAFDMQQAQGDDKALESLRRVLKEDKLAERLVSQIDVDNQDLVILTGVGSAYPILRTHTLLSALHPLMKDTPLLMLYPGKYDGYSFRLFNKLSEDHYYRAFRLVS

SEQ ID NO: 5616 - protein, 184 aa, Gallionella capsiferriformans
MSLAQTILEKLKEYLTLPWPQNVSARERVVMVVYPPNDERKLRRLLESGEFSREIATTDHGWTELDLGPEFSKWLAGSEYAERYLQRPERLWDDSGNIRGLREHLIHQVAEKCKAMTSNDVLALVGGGSLFGLFSVSSLVEQIESHIPGRLVIFFPGEHDAKNNSYRLLGAKDGWGYLAVPITC

SEQ ID NO: 5617 - protein, 179 aa, Geobacillus sp.
MEIQKKLDRFFEEIQKDEFLQMRGLGNEVPYFIFDYEPEHELIVRQSIRYFTNRIHLNIKVLNLLKMVIELFDDIGLEGLKQFEEEQGTEALFDALRPTIEEEQLVDKIAEAAEQAQIIFITGIGSVFPLVRAHELLNQLHPKVTNVPIVIFYPGTYTGQGLSLFNRFESNGYYRAFSI

SEQ ID NO: 5618 - protein, 199 aa, Geobacter sulfurreducens
MSSLEQNLDLLRQDLVAEPMRIAAHSDMPFAIFRYSPEEEFQLRKRLRLLAYSLSENHGRKVAFLSISRLVWGIVRRFEGTDYLFKTESIRGFQAAEEHINRLLSSEDYRPIADEVLERIKGFDHDRDIVFLVRAGGFAPFIYRCSSLLDGLHRRTKVPVILFYPGSAEAGTDLKFFDLPSEANLGVYNYRVKIYGVDK

SEQ ID NO: 5619 - protein, 181 aa, Haliscomenobacter hydrossis
MQAKIDQLLAAFDKVVKEPWSTVLSGQERVWFLVYDPAEQRKVELRLGDFETYTLKAGKQWRSISLKQCFPAWMTQHDYQEEYFANPEYIVDQLEAEFIPFAIQFLRKELRKLDQDQHTLVAIKDVSALFGFARLSEVLKGCEKDFSGRMLIFFPGEFQHNQYRLLDARDGWSYLARPITV

SEQ ID NO: 5620 - protein, 182 aa, Halobacillus halophilus
MKSTYERLEQMEKRINQEGFTNPKGIGSDIPHFVLDYPPQDELQVRVYLKNMLKRTKVNIREVNLFEFLLSFFEEDEMEELYEVAEEEGLRGLNDVIEPILNEGNTMIQQFKDMTEEAELIFITGVGTAHPFLRSSQLLKAISSKGYKKPIVLFYPGEFTGLRLKLFSILDYEDDYQLSRIS

SEQ ID NO: 5621 - protein, 193 aa, Halobacteroides halobius
MSRIHDRLDEILPRIQEESFMEGKGLGNEVGYYVFDYEPEDELLVRDHVQFVKEKMNNKEIYPDIIEFNLYHVMLDILEDKGYLRKIMKMEESRGTDKALNGLKSSLRLTSSGSNSLVKYITDKVSDDQIVFITGVGQAWPVIRSHTVLNNLHQVLDSVPVVMFFPGEYSGSELILFGKIKDDNYYRAFRLVE

SEQ ID NO: 5622 - protein, 200 aa, Klebsiella oxytoca
MIDPVLEYRLSQVQSRISEERFLKNNGSGNEIGFWIFDYPAQNELQVREHLKYLFRNLEKDHKFAHLNIFQIIIDMLTERGLFERVCQQEVKVGTEALKKQLVGLLNQKKIADYIAKKVDLQNQEFVILTGMGNAWPLVRGHELMSALQDVMGFTPLLMFYPGTYSGHDLSPLAGIDSRNYYRAFRLVPESGPAATLNPR

SEQ ID NO: 5623 - protein, 199 aa, Lactobacillus amylovorus
MTENIKVRIEHLKEKMDDFKFQHNEGLSNEVGYYVFDYPADQELYMRKQIDKIQESPLAARVNLKVFDIYDIMMHLLKDQEKYTGSDPIPILEDIEKNQGFDVLIEQINNILEMSENNNLIVGYIKERIPEGDGQCIVFLTGLGKVYPIIRAHKILNTMHQVLDNNPVVMFYPGNYDEMSLRAFGEIKDQNYYRAFRID

SEQ ID NO: 5624 - protein, 194 aa, Lactobacillus casei
MTLVSERFDRFRKKIRNPAFQENRGLSNEVGFYIFDYDPKDELFVRNEVEDIAHNSTTASIGANVQVFNLFDVVIRLIDEMGYLQEFIQIEEKDGIDMVIRQINNVLKMGKERNLIVQYILDHLEHRDERNIIFITGVGQVFPLIRAHRVLNTMNQVINQTPVVMFYPGSYNSLSLRAFGKLDDKNYYRAFRVE

SEQ ID NO: 5625 - protein, 199 aa, Lactobacillus helveticus
MNENIKVRIEHLKEKMDDSKFRHNEGLSNEVGYYVFDYPADQELYMRKQIDKIQESPRAARVNLKVFDIYDIMMNLLKDQEKYTGSDPIPILEDIEKNQGFDVLIEQINNILEMSENNNLIVGYIKERIPEGDGQCIVFLTGLGKVYPIIRAHKILNTMHQVLDNNPVVMFYPGNYDEMSLRAFGEIKDQNYYRAFRID

SEQ ID NO: 5626 - protein, 199 aa, Lactobacillus helveticus
MTENIKVRIEHLKEKMDDSKFRHNEGLSNEVGYYVFDYPADQELYMRKQIDKIQESPRAARVNLKVFDIYDIMMHLLKDQEKYTGSDPIPILEDIEKNQGFDVLIEQINNILEMSENNNLIVGYIKERIPEGDGQCIVFLTGLGKVYPIIRAHKILNTMHQVLDNNPVVMFYPGNYDEMSLRAFGEIKDQNYYRAFRID

SEQ ID NO: 5627 - protein, 199 aa, Lactobacillus johnsonii
MTENIKVRIEHLKEKMDDPKFQHNEGLSNEVGYYVFDYPADQELYMRKQIDKIQESPLAARVNLKVFDIYDIMMHLLKDQEKYTGSDPIPILEDIEKNQGFDVLIEQINNILEMSENNNLIVGYIKERIPEGDGQCIVFLTGLGKVYPIIRAHKILNTMHQVLDNNPVVMFYPGNYDEMSLRAFGEIKDQNYYRAFRID

SEQ ID NO: 5628 - protein, 196 aa, Lactobacillus reuteri
MYKEEQVHFEKLIQKIQKPDFQRNQGLSNEVGYYIYPYNVADTPRVRANLDDLTKSKTAMKINLKVFDLYDIMLDSIHKLKGIADDDPFRILAEMEKQSGIDQVAQQINSLMRMDENNNDVVMYVQDHVDNQHCVIFITGVGKVYPLIRAHKVLNTMHQVLDKNPVVMFYPGKYNEQNLQIFGEANDQNYYRAFLI

SEQ ID NO: 5629 - protein, 194 aa, Lactobacillus rhamnosus
MTQLSDRFDRFRKKIRDPAFQENRGLSNEVGFYIFDYDPEDELYVRNEVEDIAHDSTTASIGANVQMFNLFDVVIDLIDQMGYLQQFIEIEKDDGIDMVIRQINNVLKMGDERNLIVSYILDHLEHPEERNIIFITGIGQVFPLIRAHRVLNTMNQVIDKTPVVMFYPGSYNSLSLRAFGKLDDKNYYRAFRIE

SEQ ID NO: 5630 - protein, 194 aa, Lactobacillus rhamnosus; identical to SEQ ID NO: 5629

SEQ ID NO: 5631 - protein, 192 aa, Leuconostoc kimchii
MSELTEKFENLRHRLKVDGLTAHHGLSGEVPYFILDYRPQDELYVRDETNQIVNGGPYGEHQMNIKLFNLFDIMMDTLNEFGYTEIIYQFEKEQGMDFVIEQINNLMATNEENNRFVEYIKSRVNPDEDIIFIEGIGQIFPLVRTHKILNTMTQVIDYMPVVLFYPGKFDNIKLSMFGELNDDNYYRATQIN

SEQ ID NO: 5632 - protein, 192 aa, Methanobrevibacter smithii
MNIDEKLSKIEPKIKEPSFLENKGLSNEVGYYIFDYDPKYELKVREEVSRIKNKINNSSYAFTIKEFDLYEIIIDILNERGYLEKVFNFEEKKGIEFTTKAIISLLKLNSDNNNVIVNYILERTPDNCVVFLTGVGKAYPILRSHNVLNNLHQKLDEVPVVLFFPGQYSGRELVLFNTIEGSNYYRAFPLIR

SEQ ID NO: 5633 - protein, 181 aa, Methanoculleus bourgensis
MVMSKIDDLLEVYRTQVSLQWNEMLSGQEKVWFCVYDPSYERRIRARLSEFKIVTVQSGHTWQEVDITGLFENWLAGNEYREDFFTDPSLLRYDLDDFVARLADHLTEKIRSAENSTVVAVIGIGSLYGIVRASAVIDRLVRSTDIPGRLMFFFPGDRDRRNYRLLKARDGWSYLATPIEA

SEQ ID NO: 5634 - protein, 193 aa, Methanolobus psychrophilus
MKLEERLELLKEELQKEDFLKSRGLGNEVPFWIFDYPPEKELLVRDTITKITANLEKRSIPVLEINLYDVCLEIIEAKISAEKITAFEESKGSDELLKKLKLMLKPDILKSAIQQKMNENGGFQLIFLTGVGKAWPMVRSHTILNNVQPLLGNIPLVTFYPGKYSGFDLSLFGKFRDANYYRAFRLINTDRVS

SEQ ID NO: 5635 - protein, 196 aa, Methanomethylovorans hollandica
MLPMKLEERLEQLKEQVQSDDFLKSKGLGNEVPFWIFDYPPDKELLIRDTILKINSSLEKRSINVLMLDLYEICLELIENKIKIEQVDQFEKKKGSDELLKKLKLMLKPEILKNAIQAKMEKNGNFQMIFLTGIGKAWPIVRSHSILNNLQPVSGNLPLIAFYPGKYSGFDLSLFGKFKDANYYRAFRLINDGTDP

SEQ ID NO: 5636 - protein, 196 aa, Methanosarcina acetivorans
MLYSKFMKLEEHLELFKEKIKTKDFLVCKGLGNEIPYWIFDYEPEKELLVRDTIEKMVTSFETKYSLKIIEINLYDLCLKILSQKLSDEKIIQFEKKKGSDALLEKIRLILNQEATKKEISEILQGDYDIIFLTGVGNAWPIVRAHSVLNNLHSVTGKKPLVMFYPGKFSGLDLSLFGEFKSKNYYRAFRLMPEAM

SEQ ID NO: 5637 - protein, 190 aa, Methanosarcina mazei
MKLEERLELFKEKIKTTDFLECKGLGNEIPYWIFDYEPDKELLVRDTIEKMVTGFETKYSLKIIEINLYDLCLKILSQKLSDEKITQFERKKGSDALLEKIRLILNQDATKKEISEILQGNYDIIFLTGVGNAWPMVRAHSVLNNLHSVTGKKPLVMFYPGKFSGLDLSLFGEFKSKNYYRAFRLMPEAM

SEQ ID NO: 5638 - protein, 184 aa, Methanospirillum hungatei
MTNIEKLLDVFGKQVSIPWDPRAAPEEKVWFCVYDPSDERRLLRRIDEFGLATERAGHSWLLIDMFTFFDEWCTVHPYREEFFKNPTRLKSAEKMFLQFIIERLSHQWDKDDNSKIIAISGTGALFGIIRLSKLIEEIVKKLPIPGRLLVFFPGSHRGYCYQFMNDHDGWNYKAFPIEVKDEDE

SEQ ID NO: 5639 - protein, 192 aa, Methanospirillum hungatei
MNTEARMELLKGKIVREDFLKARGLGNEIPFWIFDYPPEDEHFVRYSIRKIQEKLTSRSIHYMEIDLYELCLEIIESKISSDKINEFEKNKGSDKLLKKLQIILKPENLKNEIQQRVVSEDAFELILLTGIGKAWPLIRLHSILNNLQPVLGNIPLLAFYPGEYTNSELSLFRKFKDANYYRAFRMIDEGTA

SEQ ID NO: 5640 - protein, 199 aa, Microlunatus phosphovorus
MTVHDLTRQEEHLFAVLSGERFLKMEGLSNEVPFFIYPYEPEHALDVAKAKKRVKNRLASRGIEVREVNLYDLSVEILKERGDWDEVLEVEPELDKAEFTEMLQSMLNPQHHLAPAIRDRLADGGFDIVFLTGIGEVFPYIRSHNVLNNLQSVVVGRPMLMFFPGRYEQSDTLGSSLVLFGRLKDDQYYRAKNILEQEP

SEQ ID NO: 5641 - protein, 186 aa, Moorella thermoacetica
MSRIEELANRYRNHIAAPWQHNLAGEQKTIFVVYPPVDERKLRARLELFEMATIASGHKWKSFDFTPTFAQWMSKLEYREVYFEEPESLALPLETEFLYFAADELRKVLAGEDVDSDTVVAVYGVASLYGFASVSAILKEVVRDIRGRLVVFFPGEYENNNYRLLNARDGWNYLAIPITLHNGVND

SEQ ID NO: 5642 - protein, 200 aa, Parvularcula bermudensis
MTAKMNQKERIDHLFSVVTSERFLSKQGLGNEVPFFICPYPAREGLTMHRDREGLAKRVIHAGVRVLDLSLYDLSLEILAERRVLEEVLAIESNAEKDELRELLQGVLDPQAHLIPRIGEAIASQAHDVIFISGVGEVYPYIRSHNVLNNLQSTAKDKPTVMFFPGEYTHGLATGASLDLFGLLHDDKYYRAFNIMNYEV

SEQ ID NO: 5643 - protein, 200 aa, Pectobacterium carotovorum
MIDPVLEYRLSQVQSRISEERFLKNNGSGNEIGFWIFDYPAQNELQVREHLKYLFRNLEKDHKFAHLNIFQIIIDMLTERGLFERVCQQEVKVGTEALKKQLVGLLNQKKIADYIAKKVDLLNQEFVILTGMGNAWPLVRGHELMSALQDVMGFTPLLMFYPGTYSGHDLSPLAGIDSRNYYRAFRLVPESGPAATLNPR

SEQ ID NO: 5644 - protein, 191 aa, Pelobacter propionicus
MNEALKERLNKILDRITSPEFLSNAGLGNEIGFYIFDYPSEAELEVRQHVEFVMDKASKRKPELRIAHVNLFQLLVDYLKERGLLEKALAMQKDKGDEAMFKALRGPLHEEKIAKEFAKAAQPESHDFVFMTGVGNAYPLLRSHTLLNNLHPLMGGTPLVVFYPGSYDGQGLSLFGKMKDNNYYRAFRLVV

SEQ ID NO: 5645 - protein, 197 aa, Pelodictyon phaeoclathratiforme
MPFLTEQKQKFDDLRVVLHEDNRTQLKRTANGGNTVLFVYPPAEEEEYIAKARELYPDGYFIDIAELFVKSIDLLGDEYNSVNGTDKERKALEGFKAFYRENSSTSFKVFTNEYPNCLFSLIVTEICQASRVEKTAFLIHTGALEGTGIENVNIMEHKTVMMQGIPLVIFYPASYMNNELLFLNHKQASNYRCHLVK

SEQ ID NO: 5646 - protein, 200 aa, Photorhabdus asymbiotica
MIDKVLEYRLAQIESRIEMEGIPRNTRPGNEISFWIFDYPAEKEIRVREFLRYLVKRLEKKRTFVHLNIFKILIDMLEARNLFERVCEREKQMGTEAMKKQLSGLLSQKKIAEHIANTTSLKDQELAIISGLGNAWPFVRGHELMSALQDVMGFTPLLMFYPGTYSGYDLTPLTGIDSRNYYRAFRLVPETGPTVLLNNP

SEQ ID NO: 5647 - protein, 193 aa, Polaromonas sp.
MTLSFDERLNQILPRVTSRDFLDSKGLGNEIGFWIFDYPPDHEMAVRDFISGILLPALVKRQPPINAGTVDLLQLVTGLLEERKLLDKAIEMQQSKGDDSTLAALRSVLKEDKLAQKISTQFDIRGLDLMIISGVGSVYPMLRTHTLLSALHPIMGNTPLLMFFPGRYDGHSLRLFNTLAEDHYYRAFRLVPE

SEQ ID NO: 5648 - protein, 190 aa, Pseudomonas brassicacearum
MSSLKADFNELMERIKQGREFGHASFEPIFYLVFPPNQILNVKRETPAWMHRLRNEGWEVETFSIAEHVADIIEKAPLRKIWLAADQKAPLAWDKTNASLANAISNGALQARIEAKLAELEGKPKAILLVTDLEALHPYTRIGVIEGKLQGKFHVPTVFFYPGVRTGKTRLKFLGFYPDDGNYRSVHVGG

SEQ ID NO: 5649 - protein, 196 aa, Pseudomonas stutzeri
MPMQDRFQHLFAVISGQRFLNKQGLGNEVPFFICPFKPEESVEMERLQRQLINRLEQAGVRILEINLYDLSIAILKERDIWDQIVEMEDSVSKEQLKELLQGVLDPEAHLVPAIAAKLASTDFEVLFLSGVGEVFPYIRSHNVLNNLQSTAKEKPTVMFFPGAYTHSLESGASLDLFGRLHDDKYYRAFNIFHCEA

SEQ ID NO: 5650 - protein, 203 aa, Psychrobacter cryohalolentis
MTMSNVQACDKKSYDHLFSVISSEHFLKMQGLGNEVPFFICPFRPEESNEMLRLEDQLTKQLQKNGINILAINLYDLSIELLKEREIFDQILEVEQQIDKEQLKELLQGVLDPESHLAPAIASKLSSTEYDVLFLSGVGEVFPYIRSHNVLNNLQSTAKEKPTVIFFPGAYTHSLESGASLDLFGRLHDDKYYRAFNIYHCEA

SEQ ID NO: 5651 - protein, 199 aa, Rhodococcus erythropolis
MTPTEFSRQEEHVFAVLRGKRFLQMEGLSNEVPFFIYPYSPENALAVAGSTRRIQNRLRNEGVEVLEINLYDLSVEVLKERGVWDRLLALEPEQDKDDFRELLQGMLDPQLHLAPAIRAKLAESDFDIFFLTGIGEVFPYIRSHNVLNNLQSVVTGKPMLMYFPGRYEQSDTLGSSLVLFGRLKDDQYYRAKNILEQEA

SEQ ID NO: 5652 - protein, 191 aa, Rhodopseudomonas palustris
MTDFERRLRSDLEPHLAAEDPRAKISAYHDMPYALFRYDPEQEFALRRELTMLATRLTQKGKRITRISLAECLSEAMTSQRPLEDWYVAERSGTVEETVQTITNILEEYAPLVDLVAARMPEDPDPKKDIVLISRTGALFPVYRTFSLLEQLKGRVHVPTILFYPGDLDGAAGLRFMGELDAEHNYRPKIF

SEQ ID NO: 5653 - protein, 182 aa, Saccharophagus degradans
MSKLKRLVENYGNYIATPWSEAAAAQRVIFCVYNENDELRLRVSIDEFELATKAKGHQWCHFDLTNTFADWLASQKYAKSYFQKPQLINTLLPKYAEYIAAQFKEHIASAGADNSTVVAVSGVGSLFGFQKVKDIVDKLAPMVPGRLLVFFPGSYENNNYRLLDGYDGWNYLAVPITAEKIY

SEQ ID NO: 5654 - protein, 200 aa, Salmonella enterica
MIDPVLEYRLSQVQSRISEERFLKNNGSGNEIGFWIFDYPAQNELQVREHLKYLLRNLEKDHKFAHLNIFQIIVDMLTERGLFDRVCQQEVKVGTEALKKQLVGLLNQKKIADYIAKKVDLQNQEFVILTGMGNAWPLVRGHELMSALQDVMGFTPLLMFYPGTYSGHDLSPLAGIDSRNYYRAFRLVPESGPAATLNPR

SEQ ID NO: 5655 - protein, 200 aa, Salmonella enterica; identical to SEQ ID NO: 5654

SEQ ID NO: 5656 - protein, 200 aa, Salmonella enterica; identical to SEQ ID NO: 5654

SEQ ID NO: 5657 - protein, 200 aa, Salmonella enterica; identical to SEQ ID NO: 5654

SEQ ID NO: 5658 - protein, 200 aa, Salmonella enterica; identical to SEQ ID NO: 5654

SEQ ID NO: 5659 - protein, 200 aa, Salmonella enterica; identical to SEQ ID NO: 5654

SEQ ID NO: 5660 - protein, 200 aa, Salmonella enterica; identical to SEQ ID NO: 5654

SEQ ID NO: 5661 - protein, 200 aa, Salmonella enterica; identical to SEQ ID NO: 5654

SEQ ID NO: 5662 - protein, 185 aa, Selenomonas sputigena
MSKLNERLDALRKLVQSQDFLNGKGLSNEVNIRIFCYHPKDEMAVRHFTEKLTEGVGTGCRIIEYNLYKVFLAICEDKRIADKIPDLENKKGHKFVLGHLARIANNLAFIEKMKAEPHNVGDVILITGVGEAFPFIRVHALLDAMQPHFCDVPILVMYPGTFDGRYVRLFDKLTPNPYYRAFNVV

SEQ ID NO: 5663 - protein, 180 aa, Shewanella sp.
MSDRLTKLLNSFSNHISVPWSNTISAEEKAIFVVYDKADELKLRARLTEFEQASIEAQHPWLLLDLTNAFANWMAEQDYKEGYFEDPEYLEGSYDYFADELVKLLSAEINNQQTADTVVALMGCGALFGFLSVSALVKSLAAQVNGRLVVFFPGEYHDNNYKLLDAKDGWGYQATAITAV

SEQ ID NO: 5664 - protein, 180 aa, Shewanella sp.
MSDRLTKLLNSFSNHISVPWSNTISAEEKAIFVVYDKADELKLRARLTEFEQASIEAQHPWLLLDLTNAFANWMAEQDYKEGYFEDPEYLEGSYDYFADELVKLLSAEINNQQTADTVVALMGCGALFGFLSVSALVKSLAAQVNGRLVVFFPGEYHDNNYKLLDAKDGWGYQATAITAF

SEQ ID NO: 5665 - protein, 200 aa, Slackia heliotrinireducens
MSAEFEHINDARSFIVEKLSENSLLGRGGYMMRNALYVLDYKPEQEPYARDLVRAICESDLPARSVRPLVVNLYDIVLAFLDEQGMWEPLVEAEPDASREELIMMLQDTVSVRDVIAPAVNAAIEDNPDADIVFITGVGETYPYVRTHTLLQEMSATKPVVLVFPGRFERRSDGSTSLNILNLDQGTTGGYYRATRVFDL

SEQ ID NO: 5666 - protein, 202 aa, Spirosoma linguale
MTGQFDQLYHKLTEVTFQDPATGNLFFPVYLFTYTPTEEYSVREQISALGERLLRPYGQNEVLVLNLFDAFLDYLRADDYGDETLLDILLDKERQEGYLGDIDELLRKKAGEEEFISFVAHRIRTYLNLPSQFPRVFVLLHGFGSLFPLLRVSTFLNKFERHVVGFKLIVFYPGTYQHQRYVLFNQLHDEHLYRAIHLNALL

SEQ ID NO: 5667 - protein, 199 aa, Sulfuricurvum kujiense
MSPDVIKKKFDHIYAQVSTPQFLRMEALGGEVPFFITSYDQRNADVIDQEIGRLASRMRMEGISVALIDLFDVVIAILEEKELLGPILETEADLAKDELFDLFSGALDVHTYLVPKIEELIREKGDAQIVFLTGIGAVYPYIRSHIILNNLQNAIKHIPTLMFFPGVYNTVSLSLFGRLKDDNYYRAFNLDTLNLKERK

SEQ ID NO: 5668 - protein, 199 aa, Synechococcus sp.
MSSLKDSIAPLESDFKSDPPRINVYHDLPFAIFRYNPTDEWELRREIKLLATRLEAFGKTVHTISMSELFWTAMERVNQKDEDEGLDAIFSLEKDRGYVEAQQQVTTYLSNKVWIPLWDLLAEQLTPINPDNSVVFLTRIAVMSPGIFHMSTLLDKMHGKTRVPTILFYPGSIDGTTGLRFMELKDHDALGNYRVKIYG

SEQ ID NO: 5669 - protein, 185 aa, Syntrophomonas wolfei
MNLVNPENMVLTTIRLVESDEKSHIRLSANGGNSILLVCEPDREIDYIRAIRKLMPEDKYQIIDLSDLLCQFVEQNKSNLEEMFNLLQGSLHQIFKTPAGEEGSDYLGLILQAVDSSLKADKIPVLINTGTLYGSGIGSIHIVENDLVMRAKSPLIILYPATWVQDMLMFLGKRPASKYRCMVLK

SEQ ID NO: 5670 - protein, 188 aa, Syntrophomonas wolfei
MNSTSKRLEQIIPRIQSESFIQNKGLGNEIGFYIFDYDPADEMLVRDYIKHIKSKFNYEGSNRRIIEYDLYEILLDITREKKIFEPILLMEEKRGQAQLADAIMQAAGFEDYINKMTFEQKPGNVLFLTGVGKVYPFMRSHKILNNLHHVFDQLPVVLFFPGSYDGQSLKLFNRFQDENYYRAFQLVK

SEQ ID NO: 5671 - protein, 186 aa, Syntrophus aciditrophicus
MGRIEELATRYRGHIGAPWQRNLAGDQKAIFVVYPKTDERKLRARLELFEMATTSTGHGWRLLDIGDTFAGWMANTDYREAYFEDPEALAMKLRSDFVQDAAGRIREILTAEGTDEDTVVAVQGVGCLFGFTRVSLVLKEVVKDIRGRLLVFFPGEYEENKYRLLDARDGWNYLAVPITLHNGVND

SEQ ID NO: 5672 - protein, 195 aa, Tepidanaerobacter acetatoxydans
MATTKERLDKILPAITKKSFRENKGLGNEIGYYIFDYEPQHEMLVRDYINFLKDKVNSGNYGFKIKEFDLYEIMLEILDSKGYLEKKFRNGTKKGSEYVFNAAKKALRLTTANDLIIKYIKDRVEEDDIIFLTGVGKAWPIIRSHTILNNLHPVVDEIPLVMFFPGTYDGGSLVLLDEVKDDNYYRAFRFIDEYQ

SEQ ID NO: 5673 - protein, 195 aa, Tepidanaerobacter acetatoxydans
MATTKERLDKILPAITKKSFRENKGLGNEIGYYIFDYEPQHEMLVRDYINFLKDKVNSGNYGFKIKEFDLYEIMLEILDSKGYLEKNFEMERKKGSEYVFNAAKKALRLTTANDLIIKYIKDRVEEDDIIFLTGVGKAWPIIRSHTILNNLHPVVDEIPLVMFFPGTYDGGSLVLLDEVKDDNYYRAFRFIDEYQ

SEQ ID NO: 5674 - protein, 194 aa, Thauera sp.
MTMTQTFEERLNQILPRITSEDFLQNRGLGNEIGFWIFEYPPEQEMAVRSFLSEVVEPALRRRQPPLRYVCVNLLELVVDVLEHRKLFDKVIKMQAEKGDDAVFASLQGVLNQEKLAQRIVGLHNPDELDMMIFTGVGAAYPLVRSHTLLNALHPLMKNTPLLMFFPGRYDGYSLRLFNKLTDKHYYRAFRLVP

SEQ ID NO: 5675 - protein, 187 aa, Thermacetogenium phaeum
MSRIEELANRYRSHIAAPWQHNLAGEQRMIFVVYPPVDERKLRARLELFEMATIESGHKWKSFDFTQTFARWMSNLEYKEIYFEEPDSLTIPLEGEFPHFAAAELRKVLTAEDVDSNTVIAVYGIASLYGFTKVSQVLKEVARDVRGRLVVFFPGEFENNNYRLLGARDGWNYLAIPITLHNGVSDR

SEQ ID NO: 5676 - protein, 194 aa, Thermoanaerobacterium thermosaccharolyticum
MKTIYDRLDEIMQRITKESFRENTGLGNEVGYYIFDYEPKYEMLVRDYVQFLKQKINGGNYGFTIKEFDLYEIMLELLETKGYLEKNFKMEQDKGSEFVFNATKKALRLTEKNDLIIQYIRDRVKKGDVVFITGVGKVWPIIRSHTVLNNLHQVLDEVPVVMFFPGVYDGLELVLFEEIKDDNYYRAFKLVERY

SEQ ID NO: 5677 - protein, 212 aa, Thiocystis violascens
MTLPLFMPSPLKDGFSALRCDLIHEDGPRISTMRNYRFAILQYDPAEEFKLRAEVQRLSADLIASGWMVLSISLQRLLLERIRRQGPEWVDRVIQMERQMAHIAPERGLNYLKSKLTPLIEGPDGLAADCSRLISAHADQHPETLDQTLALIGRAGALYPFFRSSALLRHLDGRTRGVPVVLLYPGKKQGSKGLSFMGMLNPDSDYRPRIYP

SEQ ID NO: 5678 - protein, 190 aa, Thioflavicoccus mobilis
MPSLDASFKELQLRLRDGSSLRNTGGDPVYYLVYPPSEMLRVKRRLKVWEKQLRIDGWEPRILSLAKVIGDYFETHPLRPFWLSGEAANPDLDAANETLRAALIDSGHVEEQILKSLAAIETKPGALLIVTDIEAIHPYLRIGAVEQRLQGKVPVPIIILYPGVRSGQTSLSFLGIYPDDGNYRSVHVGG

SEQ ID NO: 5679 - protein, 197 aa, Vibrio cholerae
MHNMKALQTRLDLILERIESPKFLKNDGLGNEIGFWVFDYPAKYELLVREHLKHVDEKLNKRGYRFVHLNIFEVLIDMLEERGLFDRACQRELQVGVDGLRKTLAGPLSQEKVARYIADKYKPSELEFVLLSGLGSAWPLVRGHELLSALQDVMGSTPLVLFYPGEYSGRDLHPFGMIESKNYYRAFKLVPEDGKKN

SEQ ID NO: 5680 - protein, 182 aa, Vibrio cholerae
MPFIADHKQKFADLDFNIENQDQLRRQANGGNSILFSYCPGEENLYIDKARDIYEEKAEFIDISQLLVRFIDSDGWDAFSEYYRDFINTPHVVFKSDDPEQDLFDMIISAIKQACEKDKIPFLIRSGCLYGTGIENVNIMEHKDVMQLKHPLVIFYPSKISEDNILFLNFRPASKYRCTLVK

SEQ ID NO: 5681 - protein, 200 aa, Zymomonas mobilis
MDTKTDRRARAEHLFRVVSSDRFLQKQGLGNEVPFFICAFDAEDGLSLGEDREDLIARLSHAGVRVLDIDLYDLSLRILEDRGIFEQILEVEAETEKAELKELLQGVLDPQAHLIPEIARRIEEVPHEVIFLSGVGEVYPYLRSHNVLNNLQSTAKDRPTVMFFPGKYTHALATGASLELFGLLHDDKYYRAFNIMNYEV

SEQ ID NO: 5682 - protein, 190 aa, Magnetospirillum magneticum
MSILDDRLNKVLDRLISDDLLSGRGLGNEIGFYIFDYPAENELTVREHIGFLLEQLPKKRPGLRVKHINLFDMVLGHLGDRKLFDKAIEQTRKKGDAFLVKALKEPLHGSKLAPVFEAACDLPNHDLVLVSGIGTVYPLLRTHSLLNNLHHVMRDKPLVMFFPGIYDGQILRLFGKLKDDNYYRAFKLVP

SEQ ID NO: 5683 - protein, 196 aa, Marinobacter aquaeolei
MPMQERLQHLFSVVSGQRFLNKQGLGNEVPFFICPYRPEEAVEMERLQRQLVNRLEQAGIRILSINLYDLAVDILKERDIWEQVLELEPTVSKDQLKELLQGVLDPEAHLVPAIAAKLQSVEFDVLFLSGVGEVFPYIRSHNVLNNLQSTAKDQPTVMFFPGSYTHSLETGASLDLFGRLHDDKYYRAFNIFHYEA

SEQ ID NO: 5684 - protein, 215 aa, Nostoc punctiforme
MPTLTINQRLDALLPKLQDARLLSNRGIGNEIGFYIFDYDAEYEPLVQRYVDRLKLQLTSSPSGFASPSLSEQQDRAGSPIQLILLEIDLYKTILDILSERGVLKKAFELEATKGNAALAKTVAPLVRPDQVIAYIQKKLRGDEQLVIMTGVGASWPLLRSHSILNNLHPVLDKIPLVMFFPGSYDGHELRLFDTFKDDNYYRAFPLIPHQQHHL

SEQ ID NO: 5685 - protein, 200 aa, Rhodobacter sphaeroides
MRQPTTRKERAEHLFKVVTSQRFLTKQGLGNEVPFFICPYPAEEGLSMVEDRSDLVTRIRHAGIDVLDLSLYDISLDILEERGILDQILEIEPETDKGEIRELLQSVLDPKANLIPRIGEAIEAAPHDVIFLSGVGEVYPYIRSHNVLNNLQSTAKDKPTVLFFPGSYTHALATGASLDLFGRLHDDKYYRAFNILNYEV

SEQ ID NO: 5686 - protein, 197 aa, Runella slithyformis
MLQPQHYSTAHHFDNLFNIFSNARFLNKEGLGGELPFFIHSFPVAKQPEVETGIHSLLRRLQMNGIEVVEINLYSVCIDILKRENLFEQILNRETALPKQRLLRVLSGPLNIDTSVIPEIHQRLEKQSAKIVFLTGIGAVYPVIRSHTILNNLQTLVGDLPLVMFFPGTYNNHSLTLFDQLKDDNYYRAHNLNDYKL

SEQ ID NO: 5687 - protein, 193 aa, Halopiger xanaduensis
MTTKRPFHDFTERLAQFADGRRGIRNPFVIVPVQPKYERRVAERLTEWATNPHRTEEFPDDGTVQVLRLDELFVETDVFELAVDLGENSQPATITETMQDRLAEELVAVMVEKIDAPAQQRHVVLLTHLGSLYPFTRASELLDELDRRNVQSTIGIPFPGDIVGGKLSFFGEESRNYYPAHQIEGRVEGVHLQ

SEQ ID NO: 5688 - protein, 193 aa, Halorhabdus utahensis
MTSKRPLHDFTERLARFADGRRGIRNPFVIVPVQPKYERRVADRLVEWADDAHDTEGFPADGTVQVLRLDELLVETDVFDLAVDLGEEADPATIEDTMQDRLAEELVEVMVEEISAPDQQRHVVILTHLGSLYPFTRASELLDELDRRNVQSTIGIPFPGDIVGGKLSFFGEESRNYYPAHQIDGRIEEVHLQ

SEQ ID NO: 5689 - protein, 193 aa, Halobacterium salinarum
MTTKRPFHDFTERLAQFADGRRGIRNPFVIVPVQPKYERRVAERLTEWATNPHRTEEFPDDGTVQLLRLDELFVETDVFELAVDLGENSQPATITETMQDRLAEELVAIMVEKIDAPAQQRHVVLLTHLGSLYPFTRASELLDELDRRNVQSTIGIPFPGNIYGGKLNFFGEESRNYYPAHQIEGRVEGVHLQ

SEQ ID NO: 5690 - protein, 196 aa, Halorubrum lacusprofundi
MTDSPYRAFKEKLCTFADGQAGIRNPFVIAAVDPAVEHQTADRLSSWATGAGELPPIDDGVTVQPIWLDELLPQTKVYKLSVALGGETSPERIEGTMQDRLAEELVQEMIEQEIGEEKLETQSHVVLLLNLGSLYPFTRASELLDELDRRNVRSTIGIPFPGDDVGGKLSFFDGDSRHYYPAHQIDGQIREVHLQQ

SEQ ID NO: 5691 - protein, 193 aa, Haloarcula hispanica
MTTKRPFRDFTDRIAQFADGRRGIRNPFVIVPVQPKYERRVAERLTEWATNPHRTEEFPDDGTVQILRLDEVFVETEVFELAVDLGKHSQPATITETMQDRLAEELVGIMLDRIEAPGEQRHVVLLTHLGSLYPFTRASELLDELDRRNVQSTIGIPFPGDIVGGKLSFFGEESRNYYPAHQIEGRVEGVHLQ

SEQ ID NO: 5692 - protein, 196 aa, halophilic archaeon
MTDSPYRAFKEKLCTFADGQAGIRNPFVIVAVEPAIEHRTVDRLSGWATGSDEPPVIDEDISIQPIWLDELLPQTKVYNLCVALGSETSPERIEGTMQDRLAEELVQEMIENEIDEEHLKQQSHVVLLLNVGSLYPFTRASELFDELDRRNVRSTIGIPYPGDDVGGKLSFFDGDSRHYYPAHQIPGPITERHLQQ

SEQ ID NO: 5693 - protein, 206 aa, Natrinema pellirubrum
MSQTSSSPYREFKEKLRTFAQGQHGIRNPFVIAAVDPAVEHRVADRLATWSDGRKEAPEIPDNVTVQPIWLDELLPRTDVYKLLVDLGEPLAELEGDTSPGERIEETMQDRLAEELVQQMIEHELSEAQLETQSHVVLLLNLGSLYPFTRASELLDELDRRNVKSTIGIPFPGDVVGGKLSFFGGESRHYYPAHQIDGQIQGVHLQ

SEQ ID NO: 5694 - protein, 211 aa, Planctomyces limnophilus
MTADLFSQTPLQEAIHALRSDLIQEDGPRISTMRNYRFAIVQYDPKDEFRLRREVRRLNTELVSEGWMVLTINLQKLLLDRVRSQGEDFIQRLVEREKRTSQKSIERGIQDLQTRLAPLIEGPEGIAADCSRIICDYADQNAETIDRTVAIVGRAGALYPFFRSSALLRHLDGRTRNVPVVLLYPGERRGEKGLSFMGVVDPDSDYRPRIY

SEQ ID NO: 5695 - protein, 211 aa, Anaeromyxobacter dehalogenans
MTEPLFQQSTLDDAVQALRRDLLADGGPRISTMRNYRFAILPYKPAEEFKLRKLMRRLADDLKGEGWGVLAISLQKLLLDRIRATGTSNVEALIAREKSLHGRDPERALEHLRQKIGPLIEGPGGIAADVARLIDGFAAANPDADRTLVLVGRSGALYPFFRTSALLKHIDGKTRNIPVVLLYPGERRGTTELSFMGELKPDRDYRPRIYP

SEQ ID NO: 5696 - protein, 205 aa, Haliangium ochraceum
MSKPKQAFAALRRDLIDDNGPRISTMRNYRFAIVQYKPHEEYAVRAETQRLSSELCASGWSVIPIDLHRLLMERVRAQGDDWMTRVVDMERRLAQTDPRRGLNYLIQKLTPLVEGPDGIAADCSRIITEHAEAHPERVERTLALIGRTGALYPFFRSSALLRHLDGRTKNVPVVLLYPGERPAATGLSFMGELAPDHDYRPRIYP

SEQ ID NO: 5697 - protein, 205 aa, Haliangium ochraceum; identical to SEQ ID NO: 5696

SEQ ID NO: 5698 - protein, 185 aa, Bacteroides xylanisolvens
MGQYDDKIEKALQYLKNPSRITPTGYSPIVYVVYQPEDMLMVRSIIDTFLCAKADFYGFKAHIISMGELLDKYINNHDYREIWTDPSVNEDEMYNSIKQEIVSDGYLEKSILQIHDELLADGNALLVIKDVEMLHPFYMMGVIENKIYNKIKVPILVFYPGETQGTARSFLGLYNQDGNYRSINF

SEQ ID NO: 5699 - protein, 185 aa, Bacteroides sp.; identical to SEQ ID NO: 5698

SEQ ID NO: 5700 - protein, 186 aa, Bacteroides coprophilus
MQLYEQKFEEALAYLSRPDILNPTGDRPICYVNYDVEDAMEVYRMIPLHLIPKAKFHGFADVKVLSIGKMLQDYIHNHEYYDEVWVDEENEFDLYESIRQEIQDNSVIARAILAVQQEMMTTAHPLLILKDLELLHPYDKIGRIEQLIYNKIDLPILILYPGNAQGIARTFLNIYPMDGSYRSKNF

SEQ ID NO: 5701 - protein, 198 aa, Thiorhodovibrio sp.
MSSLPLSSIKADFDELMHRIKAGRDFAHASFEPIFYLVFSPQALLEVKRQMPAWEARLVNDGWEVHRFSITQAIQAILDEQPEFIRNLWKNQDAKAPLEWSKTNNALAGALTKNAALPARLEQKLASIEGNKNAILLVTDLEALHPYLRIGSIEGHLLGRFTVPTIFFYPGVRTGKTRLKFLGFYPEDGNYRSVHVGG

SEQ ID NO: 5702 - protein, 210 aa, Rhodopirellula sp.
MSMPRFEQSSLSDVMADLKSDLIQKDGPRISTMRNYRFAIVCYDPADEFQLRREVVRLNDDLRDHGWYVLSINLQKLLLDRIAAQGEEWSDAMMRMETALQKVDPDRGLQYLKDQVGPLIEGPEGIAADCSRIIDEFIKENPEKKDRTVAMIGRAGALYPFYRSSALLKHLDGHTQNIPVVLLYPGVRNGPTGLSFMGVISADSDYRPRI

SEQ ID NO: 5703 - protein, 215 aa, Actinomyces sp.
MSKRGAYLDSLRETFDCAFRVLTSERFKKMEGLGNEVPFFVLRYKPEWEPTVDEEFSRLRRRLREERYHLADVDVFGLAVNIWKRSPFFDQMLAMEKTLPPETFRDALSKVIDVEGLLAPAIKKAVDEAGGEDSVDAVLLSGVHHLFPLVRTHLLLNCLQPLLGRVPLVVTFPGSYHQSPSTHSALVLFDQISQDNYYRAFDLVDFSLTLEPSAN

SEQ ID NO: 5704 - protein, 194 aa, Vibrio cholerae
MKALQTRLDLILERIESPKFLKNDGLGNEIGFWVFDYPAKYELLVREHLKHVDEKLNKRGYRFVHLNIFEVLIDMLEERGLFDRACQRELQVGVDGLRKTLAGPLSQEKVARYIADKYKPSELEFVLLSGLGSAWPLVRGHELLSALQDVMGSTPLVLFYPGEYSGRDLHPFGMIESKNYYRAFKLVPEDGKKN

SEQ ID NO: 5705 - protein, 195 aa, Vibrio harveyi
MQTVQQLQQRLEKVQDRLESDEFLTNKELGGEIGFYIFDYPAEHEIIVREHIDFLTKKLASRSEITGKRFASINLYEMVVELLKSRKLLDRAYKMQFEKGDDALFKALKGPLEQNRFAEFIVKQANVLECDFIILHGLGSVWPIIRGHGLLNALHAKVGNVPTVMFYPGEYDGATLKPFGRIESNNYYRAFKLVP

SEQ ID NO: 5706 - protein, 186 aa, Lachnospiraceae bacterium
MSEIKERLDKVRALIQESEFLEGKGLSNEVNIRIFCYEPENEMVVRHFVNQLETDQFLDCHLIVCNLYKIFLSICDDMDITDAIPDMEEADGSAYLLEQLNSAIGNGEFIDKIQYEPHEPGDVLMLTGVGEVFPFMRIHTLLEALQPYFSDVPILVMYPGEFDGRHVKLFNRLTPNDYYRAFNVID

SEQ ID NO: 5707 - protein, 200 aa, Escherichia coli
MIDPVLEYRLSQIQSRINEDRFLKNNGSGNEIGFWIFDYPAQCELQVREHLKYLLRHLEKDHKFACLNVFQIIINMLNERGLFERVCQQEVKVGTETLKKQLAGPLNQKKIADFIAKKVDLAAQDFVILTGMGNAWPLVRGHELMSALQDVMGFTPLLMFYPGTYSGYNLSPLTDTGSQNYYRAFRLVPDTGPAATLNPQ

SEQ ID NO: 5708 - protein, 185 aa, Coprobacillus sp.
MSDIKERLDKIRALIQEPEFLEGKGLSNEVNIRIFCYKPEDEMVVRHFVNQLETDQSLTCHLKVYNLYKTFLSICDDMDITDAIPDMEEADGSIFLLEQLSSAIGNGEFIDKIQYEPHELGDVLMLTGVGEVFPFMRIHTLLEALQPYFSDVPILVMYPGEFDGHHVKLFNRLKPNDYYRAFNVI

SEQ ID NO: 5709 - protein, 191 aa, Enterococcus faecium
MSLSIQEHLEKLNEVIQKEDFLLNRGLGNEVGYYIFDYDPKDELIVRDYINDISGTSVGDNYEVKVYNLYVIMLEYLEKRGFTEKAIKMEERRGLQKLVESIGRLLKMDLPEEENVFFEYVDAHTPEKSVVFLTGIGELYPLIRAHSILNKMHQVFDRVPVVMMYPGEYDELSLTILNTNKDDNYYRAFRI

SEQ ID NO: 5710 - protein, 200 aa, Escherichia coli; identical to SEQ ID NO: 5608

SEQ ID NO: 5711 - protein, 193 aa, Lachnospiraceae oral
MMADLAARLDEMEAEIKKPKFRKNSGRANEVNYWVFDYPAEKEMEVRERINYLKNKNQKGGDDFELVVFDLYDIIIDFLEDKKFMEKCFDFEKKKGFERITKAVSNSMKFNDDDSIIVKHIKDNTPDNAIVFLTGIGKCYPILRSHKVLNNLHQAFVKAPVVMFFPGTYNEQELILFNEIKDDNYYRAFKLVK

SEQ ID NO: 5712 - protein, 200 aa, Salmonella enterica; identical to SEQ ID NO: 5654

SEQ ID NO: 5713 - protein, 200 aa, Pectobacterium wasabiae
MNDPTLEYRLKQLEERIGDDRFLKNQGSGNEIGFWIFDYPAKQELQVREYLHFLFKKLDKNYTYKTLNIFQVIIDMLEERKLFDRICQREPELGLETLKKHLAAPLSQKKIAEYIARTVDLPAQQFVILTGLGNAWPLVRGHELMSALQDVMGFTPLLMFYPGTYSGYDLSPLAGINSRNYYRAFRLVPETGPAATLTPR

SEQ ID NO: 5714 - protein, 200 aa, Escherichia coli; identical to SEQ ID NO: 5608

SEQ ID NO: 5715 - protein, 184 aa, Ruminococcaceae bacterium
MIKQELDRIKERISNKDFLENKGLSNEVGIHVFCYKAEDELIVQDYIRRLKSEVNTPYRIIECDLYEVFLSLLEDKRILKSVAGLEEKRGKKYLLDQLQKIATPEALLAKMDYSPHIKGQDVLFMTGIGKIHPFMRSHKMLDSMQHLFEDIPIVMFYPGTFNGQTLNLFDEFKEGNYYRAFNLL

SEQ ID NO: 5716 - protein, 191 aa, Holophaga foetida
MTSNLDERLDQILPKILSEDFLAGKGLGNEIGFWVFDYLPKDELAIRRHLDFLMTQIPKQRPHLRIAHVNLFDLMLGYLKERKLLDKAIEMQQAKGDEALQKALAAPLHGKHIAAFLAKQFPPQELDLMLMSGVGSAFPLLRSHNLLNNLHPVMGDTPLVVFYPGTYDGQSLSLFGQIKQDNYYRAFKLVP

SEQ ID NO: 5717 - protein, 200 aa, Escherichia coli; identical to SEQ ID NO: 5707

SEQ ID NO: 5718 - protein, 193 aa, Oribacterium sp.
MMAGLEERLDKMELAIRKQTFRENSGRANEVNFWVFDYDPKKELEVRERIEYMKKKNEKGTEGFQLIVFDLYDMIMEYLEEKDFVNSYGRFEKRRGFDYIIRAVSTSMKMNEDDSILIRKIVEQTPENAVVFLTGVGKCYPLLRSHKILNNLHQSVLKASVVLFFPGTYTEQELILFNEIKDDNYYRAFKLVK

SEQ ID NO: 5719 - protein, 200 aa, Escherichia coli; identical to SEQ ID NO: 5608

SEQ ID NO: 5720 - protein, 191 aa, Acinetobacter johnsonii
MSQTIHERLNQIPERILSTEFLTGQGLGNEIGFWIFDYAPEDELKVREYLHFLDGMLEKKHSQLKVVNINLLQAVVDYLAERNFIDKAIQMQKAKGDEALLKALKGPLHMDKFAPYLVSKYATNAQDIVLMTGVGSVWPLLRAHHLLNSLHSLLGHKPVVLFYPGYYDGQAMSLFGKIPSNNYYRAFRLVP

SEQ ID NO: 5721 - protein, 185 aa, Selenomonas sputigena; identical to SEQ ID NO: 5662

SEQ ID NO: 5722 - protein, 191 aa, Acinetobacter junii
MSQTIHERLNQIPERILSTEFLTGQGLGNEIGFWIFDYAPEDELKVREYLHFLEGMLEKKHSQLKVVNINLLQAVVDYLAERNFIDKAIQMQKAKGDEALLKALKGPLHMDKFAPYLVSKYATNAQDIVLMTGVGSVWPLLRAHHLLNSLHSLLGHKPVVLFYPGYYDGQAMSLFGKIPSNNYYRAFRLVP

SEQ ID NO: 5723 - protein, 200 aa, Shewanella baltica
MKALQTRLDLILERIESPKFLKNDGLGNEIGFWVFDYSAKFELLVREHLKHVDEKLNKRGYRFVHLNIFEVLIEMLEERGLFDRACQREMQVGVDDLRKTLAGPLSQEKVAKYIAEKYQPSELEFVLLSGLGSAWPLVRGHELLSALQDVMDCTPLVLFYPGEYSGMDLHPFGMIESKNYYRAFKLVPEDGKKLSFSDKK

SEQ ID NO: 5724 - protein, 200 aa, Escherichia coli; identical to SEQ ID NO: 5608

SEQ ID NO: 5725 - protein, 207 aa, Halomonas sp.
MSHNEQHLPPTSVMFHEDDQLRARLNQVAEKITRPDFLAGQGLGNEIGFWIFDYAPEHELQVRAYLNFLPSLMARQYGHFKVAQVNLLHVLKDYLTERGFLDKAIAMQKNKGDAALLKALRGPLHMDKFAPYLIRHSLSHDPDIVLLTGVGSLWPMVRAHSLLNALHGPLGHKPLVLFYPGRYDGQTLTLFNQIKSNNYYRAFALVP

SEQ ID NO: 5726 - protein, 239 aa, Bifidobacterium angulatum
MGDSMTDFIAGVEAADEHRDIDADFAHLREIMESRSFRTNSGLAGEQPYYIYDYPPRQELEVAEHIRQLVSQLQTMTPKYDGDYAPQVLTLDLFDVVLEILGNRGILDRVLNREAKRHRKVSSDAHTDKFLGLLDNVLGADTAQLPDTIRDHYEQAKSEGGANIVFITGIGKVYPYIRAHTLLNALQGRIDDRPLVLFYPGTFTRSATSGSVMSLFNCLPGDNYYRAQNLREMSVRLEE

SEQ ID NO: 5727 - protein, 203 aa, Alcanivorax pacificus
MRKDIAKMPMQERLQHLFSVVSGQRFLNRQGLGNEVPFFICPYGPKEAVEMDRLQRQLVNRLEQAGIRILSINLYDLTVDILKERDIWEQVFELEPTVSKDQLKELLQGVLDPEAHLVPAIAAKLQSVEFDVLFLSGVGEVFPYIRSHNVLNNLQSTAKDQPTVMFFPGSYTHSLETGASLDLFGRLHDDKYYRAFNIFHYEA

SEQ ID NO: 5728 - protein, 212 aa, gamma proteobacterium
MNQVSNSPTRLNTVSAKNLADSQAHLLTVVSSQRFLRNEGLNNEVPFHICPFEPEISEDMNHAIKQLRNELDDKGIGVLEVNLYDLVVEILKEEGDWEWLIENELTLSREELKEELQGILDTENVLIPAIVKKMKGSAFDVMFITGVGEVFPYIRSHNILNNLQRVAKEQPTLMFFPGKYQHSLASGASLRLFNKLQDDKYYRAFNILDRAN

SEQ ID NO: 5729 - protein, 200 aa, Escherichia coli; identical to SEQ ID NO: 5608

SEQ ID NO: 5730 - protein, 196 aa, Enterococcus faecalis
MKKKTIEERFDVLERLLKSDDFLANRGLGNEIGYYIFDYSPKNELLVREYINHLEAKNYPANDGYTLQVFNLYEIMMELLESKRYIDIIAQWEKKHGIMFVATRINRLLKMEEFDDAEMYFTDYIRQRVKDNSVVILTGIGEIYPLVRAHSVLNKMHLVYTKRPVIMMYPGEYDRLRLTILDTNRDANYYRAFRID

SEQ ID NO: 5731 - protein, 191 aa, Pseudomonas syringae
MNQQLQDRLNQIPEKILTEEFLKSQGLGNEIGFWIFDYAPEDELQVRQYLDFLKSFLDKKHSQMKVVNINLLHAMKDYLDQRNFTDKAIQMQTTKGDLALLKALAGPLHMDKFAPYLMEHYRATEHDVVLITGVGSVWPVLRAHNLLNKLHALLGHKPLVLFYPGHYSGQSLALFNRITSNNYYRAFKLVP

SEQ ID NO: 5732 - protein, 200 aa, Escherichia coli; identical to SEQ ID NO: 5608

SEQ ID NO: 5733 - protein, 202 aa, Pseudanabaena biceps
MVKQNFKSVAERLEHLYKVISSQRFLKMQGLNNEVPFFICAYQPEDAVEIEQLQSQLVSRLEQSGVRVLQINIYDLAIALLQERGIWQQIMDIETSVSKEQLKELLQGVLDPDTHLVPAIAQKMQDADFDVIFLNGVGEVFPYIRTHSILNNLQSTATQIPTLIFFPGEYTHSLESGASLELFGRLRDDRYYRAFNIADYEV

SEQ ID NO: 5734 - protein, 200 aa, Escherichia coli; identical to SEQ ID NO: 5608

SEQ ID NO: 5735 - protein, 216 aa, Actinomyces sp.
MRRTYARSLDDTFDIAYQVMTSERFIEMEGLGNEVPYFVLRYRPEWEPGVDKAVRRLTSRVRQHYPLTVVDVFDLAHRLWRESGYLETIIEAEGSMPEQDFRDGLKGLIDPEDLLAPAIDREIARDADARAVLVTGVHHLFPLVRAHRLLNCLQPLASRRPLVLAFPGSYNQSPERASSLVLFDRVGEDNYYRAFDLLDQRYALDGAGGATERTGE

SEQ ID NO: 5736 - protein, 77 aa, Fusobacterium necrophorum
MEVILRYISQKSKGKNFMILTGVGKVFPIVRTHTILNNLQNILEDTKVLLFFPGEYTSTDLRLFGFEDNNYYRAFRI

SEQ ID NO: 5737 - protein, 110 aa, Fusobacterium necrophorum
MKELDIRFQNLIQKVKSDEFYYNKGLANEVPFYIFDYNPKEELEVREYIHSLFLPEIQKEDRLQVVEIDMFELLLESMKNDNILEKAFLMEEQKGTQFLYEKLKKALMWK

SEQ ID NO: 5738 - protein, 191 aa, Acinetobacter radioresistens; identical to SEQ ID NO: 5720

SEQ ID NO: 5739 - protein, 235 aa, Bifidobacterium bifidum
MADSIAGIGFVDERRDIDADFAHLYEIMESRSFRTNSGLAGEQPYYIYDYPPMQELEVAEHIKQLANRLQTMTPKDDGDYAPQVLTLDLYDIALEILEKRGILDRIFKREEKRHKKVSSDVHTDNFLRLLDNILGADANHLPDTIRDHYEQTKSEGGADIVFITGIGKVYPYIRAHTLLNALQGRIDDRPLVLFYPGTFTRSATSGSVMSLFNCLPGDNYYRAQNLREMSVQLEA

SEQ ID NO: 5740 - protein, 203 aa, Bacteroides ovatus
MTIKELDDKLNSPGFQDTENGDLFYNFFIYQYPAEKEYDIRKQIQEFKANLIRPTNYVDVLTLNLFDEFCSFLDQKKFLRHPSMLKYLMEKEQSAPSKVKSTQDTLARNAHSPEFVQFIHQRIIDHITIKDQYRRPYVFMYGIGSMYPYLRVNEFLALYEDYNETDKYKIIVFYPGHRDQNSFRLFDTLPDNHTYRATLLINE

SEQ ID NO: 5741 - protein, 203 aa, Parabacteroides sp.
MTIKELDDKLNSPGFQDTENGDLFYNFFIYQYPAEKEYDIRKQIQEFKANLIRPTNYVDVLTLNLFDEFCSFLDQKKFLRHPSMLKYLMEKEQSDPSKAKSTQDTLARNAHSPEFVQFIHQRIIDHITIKDQYRRPYVFMYGIGSMYPYLRVNEFLALYEDYNETDKYKIIVFYPGHRDQNSFRLFDTLPDNHTYRATLLINE

SEQ ID NO: 5742 - protein, 200 aa, Escherichia coli
MNDPILEYRLKQLEERIGDDRFLKNQGSGNEIGFWIFDYPAKQELQVREYLHFLFKKLDKKYTYKTLNIFQIIIDMLEERKLFERICQREPELGLETLKKHLAAPLSQKKIAEYIARTVDLPAQQFVILTGLGNAWPLVRGHELMSALQDVMGFTPLLMFYPGTYSGYDLSPLAGINSRNYYRAFRLVPETRPAATLTPR

SEQ ID NO: 5743 - protein, 186 aa, Lachnospiraceae bacterium; identical to SEQ ID NO: 5706

SEQ ID NO: 5744 - protein, 203 aa, Bacteroides ovatus
MTIKELDDKLNSPGFQDTENGDLFYNFFIYQYPAEKEYDIRKQIQEFKQNLIRPTNYVDVLTLDLFEEFCNYLNGQKFLKFDSMLQYLLEKEQEQPDTSDKIFSTLERHAHSEKFVKYLHERIVAHITIDDEYRRPYVFMYGIGTMYPYLRANELLAKYEDYNETGRYKIILFYPGHREQSSFKLFDTLNDHHTYRATFLINE

SEQ ID NO: 5745 - protein, 191 aa, Enterococcus faecium; identical to SEQ ID NO: 5709

SEQ ID NO: 5746 - protein, 134 aa, Yersinia ruckeri
MNIFQVIIDMLEERKLFERICQREPELGLEALKKHLAAPLSQKKIAEYIARTVDLPAQQFVILTGLGNAWPLVRGHELMSALQDVMGFTPLLMFYPGNYSGYDLSPLAGINSRNYYRAFRLVPETGPAATLNPR

SEQ ID NO: 5747 - protein, 200 aa, Pantoea sp.
MSDPVLTYRLKQLEERISDDRFLKNQGSGNEIGFWIFDYPAQQELQVRDYLTFLFKKLEKKYTFTKLNIFQVIIDMLEERKLFERICQREPELGLETLKKHLAAPLSQKKIAEYIARTVDLPSQQFVVLTGLGNAWPLVRGHELMSALQDVMGFTPLLMFYPGNYSGYDLSPLAGINSRNYYRAFRLVPETGPAATLNPR

SEQ ID NO: 5748 - protein, 200 aa, Escherichia coli; identical to SEQ ID NO: 5608

SEQ ID NO: 5749 - protein, 200 aa, Escherichia coli; identical to SEQ ID NO: 5608

SEQ ID NO: 5750 - protein, 200 aa, Collinsella intestinalis
MNAIDSPTLTQSFEVIRSKLRDPEFLACHGLGNEVPFHVFPYDAGSELEVRALLRDLLSEDPAGLAPGRITHIDLWELICDLCEQRGLMEKLPAFERKRGSDALLVRLQTIASPAKLVEHMRERFAAAHGDPQPGRDVLLISGVGRAYPITRAHQILECAQPIFSHIPVVLFYPGVYDGQTLRLFGSINDGNYYRAFNIL

SEQ ID NO: 5751 - protein, 200 aa, Salmonella enterica; identical to SEQ ID NO: 5654

SEQ ID NO: 5752 - protein, 200 aa, Escherichia coli; identical to SEQ ID NO: 5608

SEQ ID NO: 5753 - protein, 200 aa, Nitratireductor indicus
MGTKTDRRARAEHLFKVISSERFLQKRGLGNEVPFFICAFDAEDGLSLGEDREDLIARLGHAGVRVLDIDLYDLSLGILEDRGILEQILEVEAETEKAELKELLQGVLDPQDHLIPEIARRIKETPHDVIFLSGVGEVYPYLRSHNVLNNLQSTAKDRPTVLFFPGKYTHALATGASLELFGLLQDDKYYRAFNIMNYEV

SEQ ID NO: 5754 - protein, 200 aa, Escherichia coli; identical to SEQ ID NO: 5608

SEQ ID NO: 5755 - protein, 201 aa, Acinetobacter baumannii
MDAVVVEGAAMSQTIHERLNQIPERILSTEFLTGQGLGNEIGFWIFDYAPEDELKVREYLHFLDGMLEKKHSQLKVVNINLLQAVVDYLAERNFIDKAIQMQKAKGDEALLKALKGPLHMDKFAPYLVSKYATNAQDIVLMTGVGSVWPLLRAHHLLNSLHSLLGHKPVVLFYPGYYDGQAMSLFGKIPSNNYYRAFRLVP

SEQ ID NO: 5756 - protein, 200 aa, Escherichia coli; identical to SEQ ID NO: 5608

SEQ ID NO: 5757 - protein, 191 aa, Enterococcus faecium; identical to SEQ ID NO: 5709

SEQ ID NO: 5758 - protein, 190 aa, Alcanivorax sp.
MNRLDERLNKILPTLTSTKFRENQGLGNEVPFYAFDYPAESEVQVREHVDFLVAQLAKSKPLLKVARVHLFQVLVDMLEERNFYDKAVKLQAAKGGEALLKQLKGPLKAEKVADFITAKWPVDDYDAYLIDGVGSAYPIIRTHKLLNVLQPYTGLTPLVLFFPGEYDGQSLRLFGQLSDTPYYRAFRLVD

SEQ ID NO: 5759 - protein, 194 aa, Escherichia coli
MKALQTRLDLILERIESPKFLKNDGLGNEIGFWVFDYPAKYELLVREHLKHVDEKLNKRGYRFVHLNIFEVLIDMLEERGLFDRACQRELQVGVDGLRKTLAGPLSQEKVARYIADKYKPSELEFVLLSGLGSAWPLVRGHELLSALQDVMGSTPLVLFYPGEYSGRDLHPFGMIESKNYYRAFKLVPEDGKKI

SEQ ID NO: 5760 - protein, 225 aa, Bifidobacterium bifidum
MDERRDIDADFAHLYEIMESRSFRTNSGLAGEQPYYIYDYPPMQELEVAEHIKQLANRLQTMTPKDDGDYAPQVLTLDLYDIALEILEKRGILDRIFKREEKRHKKVSSDVHTDNFLRLLDNILGADANHLPDTIRDHYEQTKSEGGADIVFITGIGKVYPYIRAHTLLNALQGRIDDRPLVLFYPGTFTRSATSGSVMSLFNCLPGDNYYRAQNLREMSVQLEA

SEQ ID NO: 5761 - protein, 200 aa, Escherichia coli; identical to SEQ ID NO: 5742

SEQ ID NO: 5762 - protein, 200 aa, Salmonella enterica; identical to SEQ ID NO: 5654

SEQ ID NO: 5763 - protein, 194 aa, Vibrio cholerae; identical to SEQ ID NO: 5704

SEQ ID NO: 5764 - protein, 191 aa, gamma proteobacterium
MDAALNERLNQIPAKILADEFLKGQGLGNEIGFWIFDYQPESELQVREYVTFLEEMLAKKHAHLKVAHINLLSALIDYLGDRGFLDKAISLQQAKGDDALLSALKGPLHMDKFVPYLNDRYSADKANLVLMSGVGSVWPMIRAHNILNRLHSVLGHVPLVLFYPGFYDGQSMSLFGRIPSNNYYRAFKLVP

SEQ ID NO: 5765 - protein, 190 aa, Pseudomonas psychrotolerans
MSSVKADFNELIERIRQGREFGHASFEPIFYLVFHPEQILEVKRQQPAWEARLRNEGWDVHTFSIAEEIADILGKAPLRKIWLAADQRAPHAWEKTNASLANAIANGALQDRLEAKLTTLEGKPKGILLVSDLEALHPFMRIGVIEGKLQGKFHVPTVFFYPGVRTGKTRLKFLGFYPEDGNYRSVHVGG

SEQ ID NO: 5766 - protein, 190 aa, Acetivibrio cellulolyticus
MASINARLDQIIPKIKEQKFIDGRGLGNEISFYIFDYNPEDELLVRDYIKHIKKEFAIEGSTRSIVEFDLYKMLLELAKDMGIFEEIFKMEQQDGKDAVLQALTEFAEPQIFLDKMQSEIGGHNLVFITGIGKVFPFVRSHNILNRLQEVIDKIPVILFFPGVYDGQSLSLFRKIKDDNYYRAFPLIDRK

SEQ ID NO: 5767 - protein, 185 aa, Fusobacterium sp.
MKELDIRFQNLIQKVKSDEFYYNKGLANEVPFYIFDYNPKEELEVREYIHSLFLPEIQKEDRLEVVEIDMFELLLESMKNDNILEKAFLMEEKKGTRFLYEKLKKSFNVEVILRYISEKSEGKNFIILTGVGRVFPIVRTHTILNNLQNILGDTKVLLFFPGEYTSTDLRLFGFEDNNYYRAFRI

SEQ ID NO: 5768 - protein, 191 aa, Enterococcus faecium; identical to SEQ ID NO: 5709

SEQ ID NO: 5769 - protein, 200 aa, Salmonella enterica; identical to SEQ ID NO: 5654

SEQ ID NO: 5770 - protein, 186 aa, Fusobacterium nucleatum
MVKMMKDRFKELIKKIKSDEFYNNRGLANEVPFYIFDYNPKYELEIRDFVKNKLLASLEDDDRLKAVEIDIFELLLESMRNDNILEMAFEIEEKKGTKFLYEKLKKSFNTEIIMKYISEKTKDKNFLILTGVGKIFPIVRTHTILNNLQNIFDHTKVLLFFPGEYTSTDLRLFGFEDNNYYRAFKI

SEQ ID NO: 5771 - protein, 186 aa, Fusobacterium sp.
MVKMMKDRFKELIKKIKSDEFYNNRGLANEVPFYIFDYNPKYELEIRDFVKNKLLPSLEDDDRLKAVEIDIFELLLESMRNDNILDTAFEIEEKKGTKFLYEKLKKSFNTEIIMKFISQKTKGKNFLILTGVGKIFPIVRTHTILNNLQNIFDHTKVLLFFPGEYTSTDLRLFGFEDNNYYRAFKI

SEQ ID NO: 5772 - protein, 191 aa, Acinetobacter lwoffii
MSQKIHERLNQIPERILSTEFLTGQGLGNEIGFWIFDYAPEDELKVREYLHFLDGMLEKKHSQLKVVNINLLQAVVDYLAERNFIDKAIQMQKAKGDEALLKALKGPLHMDKFAPYLVSKYATNAQDIVLMTGVGSVWPLLRAHHLLNSLHSLLGHKPVVLFYPGYYDGQAMSLFGKIPSNNYYRAFRLVP

SEQ ID NO: 5773 - protein, 194 aa, Lactobacillus casei
MTLVSERFDRFRKKIRNPAFQENRGLSNEVGFYIFDYDPKDELFVRNEVEDIAHNSTTASIGANVQMFNLFDVVIRLIDEMGYLQEFIQIEEKDGIDMVIRQINNVLKMGKERNLIVQYILDHLEHRDERNIIFLTGVGQIFPLIRAHRVLNTMNQVINQTPVVMFYPGSYNSLSLRAFGKLDDKNYYRAFRVE

SEQ ID NO: 5774 - protein, 200 aa, Escherichia coli; identical to SEQ ID NO: 5608

SEQ ID NO: 5775 - protein, 191 aa, Acinetobacter sp.; identical to SEQ ID NO: 5572

SEQ ID NO: 5776 - protein, 185 aa, Holdemania filiformis
MSDLNERLDKVRELLKDPDFLESRGLSNEVNIRIFCYHPQDEMIIQHFVRQIMTDQTLPCHLLERNLYKIFLKACEEKRILDKIPAMEEKKGKGQLALQLEKGIPVQSYVNLICGDSLETDDVLLLTGVGDVFPFMRIHKLLEALQPKVGNVPILVMYPGDFDGRHVKLFEILPANPYYRAFNVV

SEQ ID NO: 5777 - protein, 191 aa, Enterococcus faecium
MSLSIQEHLEKLGEVIQKEDFLLNRGLGNEVGYYIFDYDPKDELIVRDYINDISGTSVGDNYEVKVYNLYVIMLEYLEKRGFTEKAIKMEERRGLQKLVESIGRLLKMDLPEEENVFFEYVDAHTPEKSVVFLTGIGELYPLIRAHSILNKMHQVFDRVPVVMMYPGEYDELSLTILNTNKDDNYYRAFRI

SEQ ID NO: 5778 - protein, 186 aa, Fusobacterium sp.
MVKIMKDRFKELIKKIKSDEFYNNRGLANEVPFYIFDYNSKYELEIRDFVKNKLLPSLEDDDRLKAVEIDIFELLLESMRNDNILDAAFEIEEKKGTKFLYEKLKKSFNTEIIMRYISQKAKDKNFLILTGVGKIFPIVRTHTILNNLQNIFDHTKVLLFFPGEYTSTDLRLFGFEDNNYYRAFKI

SEQ ID NO: 5779 - protein, 193 aa, Clostridium butyricum
MKNIYQRIDEILPKIVEPNFRKNKGLGNEIGFYIFDYNPEDELLVRDRVTFIKEKAKNAHGLNIKEFDLYEIILELLESKGYLQKNFQMEEKRGSEQVFNATKKALRLTLDNDLVVNYIKDRLDSSDIVFLTGVGKAWPIVRSHTILNNLHRIVEEQPLIMFFPGNYDGGSLMLFNYLKDDNYYRAFQLIDKY

SEQ ID NO: 5780 - protein, 191 aa, Acinetobacter baumannii; identical to SEQ ID NO: 5720

SEQ ID NO: 5781 - protein, 191 aa, Cellvibrio sp.
MNQQLQDRLNQIPEKILSSEFLNSQGLGNEIGFWIFDYDPAAELEVREYIKFLENMLTKKHSKVSYVHINLLELLVQYLNSRGFVEKAIALQQQKGDDALLKALSGPLHMDKFAPYLVETTQAAAKNIVFISGVGSVWPLLRAHNLLNSLHSLLGQTPMVLFYPGHYDGQSMRLFGKIPSDNYYRAFKLIP

SEQ ID NO: 5782 - protein, 191 aa, Faecalibacterium prausnitzii; identical to SEQ ID NO: 5590

SEQ ID NO: 5783 - protein, 196 aa, Fulvimarina pelagi
MSDLEKRLGAIQAKITSEEFLTGRRLGGDIPYWIFDYPPADELRVRDHVDRLLRRLSGDASPVSPCHVDLLDLVKTMLEGRRLLDKAIEMQRTKGDAAVSRALAAEMDPERIAEAFVKSVTIETCSFVLVTGVGASYPLVRTHNLMNALHSRTGHVPIVFFYPGRYDGQYLRLFDTMPESAYYRAFRLISDSEGSR

SEQ ID NO: 5784 - protein, 200 aa, Escherichia coli; identical to SEQ ID NO: 5608

SEQ ID NO: 5785 - protein, 191 aa, Enterococcus faecium; identical to SEQ ID NO: 5709

SEQ ID NO: 5786 - protein, 196 aa, Lactobacillus johnsonii
MTEDINLRFEHLKEKMIDPKFQKNKGLSNEVGYWIFDYPANQELEVRKKIAKIKDSALASRVNLKVFDIYNVMMTLLKDQKKYTGTDPIPILEEIEKNQGFDVLIAQINNILEMSENNNLIVQYIKDRLPEKCIVFIVGLGKTYPIIRAHKILNTMHQVLDKNPVVLFYPGNYDEKSLRAFGEVKDQNYYRAFRLD

SEQ ID NO: 5787 - protein, 200 aa, Thiothrix nivea
MHNLTYLHNRLDLILKRLEDPRFLRNDGLGNEIGFWLFDYPAEYEIQVRQHVALLTDKLQKRNRQFVCMNIFQVLVEMLASRNLLERTFERERQVGADALRKTLAGPLSQDKVARYMADQIKPENQEFVILWGLGSAWPLVRGHELLSALQDVMGKTPLLLFYPGTYSGQDLHPFGLVESRNYYRAFKLVPEDGKTTLSA

SEQ ID NO: 5788 - protein, 200 aa, Escherichia coli; identical to SEQ ID NO: 5608

SEQ ID NO: 5789 - protein, 199 aa, Brevibacterium mcbrellneri
MTLHELSRQEEHLFAVLSGERFLKMEGLSNEVPFFIYPYEPEHALDVAKAKKRVKNRLASKGIEVREINLYDLSVDVLKERGDWDEVLEVEPELEKAEFTEMLQSMLNPQQHLAPAIRERLADGEFDIVFLTGIGEVFPYIRSHNVLNNLQSVVVGRPMLMFFPGRYEQSDTLGSSLVLFGKLKDDQYYRAKNILEQEP

SEQ ID NO: 5790 - protein, 200 aa, Escherichia coli; identical to SEQ ID NO: 5608

SEQ ID NO: 5791 - protein, 181 aa, Geobacillus thermoglucosidans
MSQTYERLKEMEKRINEEGFTDPKGIGSEIPHYVFDYPAEDELQVRAYIHRLLQQTSLNIVEINLFRFLLSLFEDELDELIEISEEGGYEELVKTFQTILEDQNYIVKAFVERVGDAELIFITGVGNAFPFLRSSQLLIKLSDSAFRKPIVLFYPGYFTGIELRLFGILRNEDRYQLSRIS

SEQ ID NO: 5792 - protein, 191 aa, Enterococcus faecium; identical to SEQ ID NO: 5709

SEQ ID NO: 5793 - protein, 191 aa, Enterococcus faecium; identical to SEQ ID NO: 5709

SEQ ID NO: 5794 - protein, 197 aa, Vibrio cholerae; identical to SEQ ID NO: 5679

SEQ ID NO: 5795 - protein, 188 aa, Sporosarcina newyorkensis
MATLKERLKKISNRIKEDKFIEGRGLGNEISFYIFDYDPKDELEVRDFIKIIHKEFNNGLYNRRIIEFDLYKMLIEITKEKRIFDRIFDMEERQGKDALFKAMTTFAKPEIFLQKIKEQMGEHNVVFLTGVGKVYPFVRSHNILNNLQEVLDKIPVILFYPGQYSGQDLQLFGKFKDDNYYRAFRLVD

SEQ ID NO: 5796 - protein, 192 aa, Desulfotomaculum gibsoniae
MRSLEEKLDGAERKIKTESFRQNKGLGNEVGYYVFDYPADKELMVRERIAYMKAKNAKGTDGFELVVYDLYDIIIDLLEKEGFMEQCFKFEKKKGLERVVKAVGNLLQFNDENNLIVQYIQEHTPGDAVIFLVGIGKCYPLLRSHKVLNNLHQVIDRVPVVLFYPGKYDGQELVLFSEIKDGNYYRAFRLVD

SEQ ID NO: 5797 - protein, 191 aa, Enterococcus faecium; identical to SEQ ID NO: 5709

SEQ ID NO: 5798 - protein, 195 aa, Vibrio shilonii
MQTVQQLQQRLEQVQDRLESDEFLTNKELGGEIGFYIFDYPAEHEIIVREHIDFLTKKLASRSEITGKRFASINLYEMVVELLKSRKLLDRAYKMQFEKGDDALFKALKGPLEQNRFAEFILKQANVLECDFIILHGLGSVWPIIRGHGLLNALHAKVGNVPTVMFYPGEYDGATLKPFGRIESNNYYRAFKLVP

SEQ ID NO: 5799 - protein, 203 aa, Brachybacterium paraconglomeratum
MLLHSKPTLPQQEEHLFKVLSSERFLRMEGLGNEVAHFIYDYDPSWALDVAQAKKRIKTKLDTELGIKVLEINLYDLCVELLKKRNVWERVLAAEPTMDKPDFLKMLQNMLDPHIHLAPAIKERIADESFQILFLTGIGEVFPFVRSHTVLNNLQTVVSDKPMLMFFPGRYEVSATQGSALVLFGQLKDDSFYRAKRIIDQEA

SEQ ID NO: 5800 - protein, 200 aa, Salmonella enterica; identical to SEQ ID NO: 5654

SEQ ID NO: 5801 - protein, 191 aa, Eubacterium cellulosolvens
MEFSERLDKIWDRISDQDFLANRGVANEVRYYVFDYEARDELIIRDKIKALKKQNNPDSDGFQIIEFDLYEMVISILEEKGYLDKCIKFEEQKGMEYLYTAVTKMLRLTNDDNLIVNRILRDTTENAVVFLTGVGKVFPFVRSHNVLNNLHQVLDSVPVVMFYPGTWNGQSLSLFGTITDGNYYRAFPLIV

SEQ ID NO: 5802 - protein, 202 aa, Pseudoalteromonas luteoviolacea
MTTLSTTKQHKNLNDRLDQILPKIESEDFLKNQGLGNEIGFYVFDYPAESELTVRDHLAFITDKLTKRGRNFASINLFEAILELLDARNLTERAFKVQKERGDDALFNALKGPLEQNRVAEFIASKIDLGADNQAQTEFILLHGLGSAWPIIRGHGLLNALHAKVGNVPTVLFYPGEYDGTALKPFGRIESNNYYRAFKLVP

SEQ ID NO: 5803 - protein, 193 aa, Clostridium perfringens
MKNIYDRVDEILPKITEPNFRENKGLGNEIGFYVFDYEPEYELLVRERVKSIKERAKRVYDLNIVEFDLYEVILEILDSKGYLKKNFDMEIKRGSEQVFNATKKALRLTLDNDLVVKYISERLEGADIVFLTGIGKAWPIIRSHTILNNLHRIVEKQPLVMFFPGNYDGGTLMLFNQLKDDNYYRAFQLVDKY

SEQ ID NO: 5804 - protein, 191 aa, Enterococcus faecium; identical to SEQ ID NO: 5709

SEQ ID NO: 5805 - protein, 194 aa, Vibrio cholerae; identical to SEQ ID NO: 5704

SEQ ID NO: 5806 - protein, 200 aa, Escherichia coli; identical to SEQ ID NO: 5608

SEQ ID NO: 5807 - protein, 185 aa, Fusobacterium ulcerans
MENINEKFKRLIKKVKSEEFYNNKGLANEVPFYIFDYSPETELEVRDLIKNEFLPSLENNERLRTVEIDIFELLLESMKNDDILDVSFKIEEKKGTRFLYEKLKKSFNSEVIVKYIEQKSENKNFIILTGVGKIFPIVRTHTILNNLQNIFDHTKVLLFFPGEYTNIDLRLFGFKDNNYYRAFRI

SEQ ID NO: 5808 - protein, 200 aa, Roseobacter sp.
MSLQLTRKERAEHLYRVITSERFLTKQGLGNEVPFFICPFPAEEGLTMIEDRLDLVERIGHAGVTALDLSLYDISLGLLEERGILEDVLAAEPDMEKSELRELLQGVLDVHEHLIPKIAEAIAAQPHDVIFLSGVGEVYPYIRSHNVLNNLQSTAKDKPTVLFFPGSYTHSTATGGSLDLFGLLHDDKYYRAFNILNYEV

SEQ ID NO: 5809 - protein, 200 aa, Escherichia coli; identical to SEQ ID NO: 5608

SEQ ID NO: 5810 - protein, 188 aa, Paenibacillus elgii
MANLNSRLDKIIPKIREDKFIEGRGLGNEISFYVFDYEPEKELVVRDYIPHIFKEFSHEGSGRRLIEFDLYKMLIEIAKEKRIFDRIPQMEEKQGKDALFKAMANFAKPEIFLQKIKEKLGEHNVVLITGVGKVYPFVRSHNILNNLQEVLDKTPVIMFFPGKYDGLSLRLFDRFKDDNYYRAFRLVD

SEQ ID NO: 5811 - protein, 125 aa, Escherichia coli
MLNERGLFERVCQQEVKVGTETLKKQLAGPLNQKKIADFIAKKVDLAAQDFVILTGMGNAWPLVRGHELMSALQDVMGFTPLLMFYPGTYSGYNLSPLTDTGSQNYYRAFRLVPDTGPAATLNPQ

SEQ ID NO: 5812 - protein, 97 aa, Escherichia coli
MIDPVLEYRLSQIQSRINEDRFLKNNGSGNEIGFWIFDYPAQCELQVREHLKYLLRHLEKVHKFACLNVFQIIIDMNRPGFPGECFICELRLPDHRF

SEQ ID NO: 5813 - protein, 218 aa, Pseudomonas mandelii
MSQKISQQPLAVRFEHLLNVMSGQRFLEMKGLNNDLPFYICEFKAAEAFEIQRMQRQLVNTLAGLRVDCLQGRGVKVLEVSLYDLTIDLLKAREGSDEGVSLWEQIRAVEPDVEKEGLLELLQGVLDIKEHLVPAIGERIAQTDYDVLFLSGIGEVFPYIRSHNVLNNLQSTAKDKPTVMFFPGEYRHSLEQGASLELFGLLHDDKYYRAFNIFESQV

SEQ ID NO: 5814 - protein, 194 aa, Vibrio cholerae; identical to SEQ ID NO: 5704

SEQ ID NO: 5815 - protein, 181 aa, Geobacillus sp.
MSTYDRLNKMEKRINEEGFTTPTGIGSEIPHYVFDYPAEDELIVRSYIEGLLKRTSLKIKEINLFKFLLSFYEEDELEELIEISEEEGYDEIVRIFQTIIEHPHIMAQSFIEKAKDAELIFITGVGNAYPFLRSSQLLKKISDHAFRKPIILFYPGHFTGLDLRLFGILHNEDQYQLTRIS

SEQ ID NO: 5816 - protein, 200 aa, Escherichia coli; identical to SEQ ID NO: 5742

SEQ ID NO: 5817 - protein, 200 aa, Salmonella enterica; identical to SEQ ID NO: 5654

SEQ ID NO: 5818 - protein, 200 aa, Collinsella stercoris
MNATNSPTLAQSFEVIRSKLRDPEFLACRGLGNEVPFHVFPYDAADEPEVRARLRDLLSEDPARLEPVRIIHVDLWELICDLCERRGLMEKLPAFERKRGSDALLARLQAIASPAKLVDHMRERLAAEYGEPQPGRDVLLISGVGRAYPITRAHQILECAQPIFSHIPVVLFYPGVYDGQTLRLFGSINDGNYYRAFNIL

SEQ ID NO: 5819 - protein, 207 aa, Glaciecola punicea
MAGKFNSVLTKANLRDAYAHLTDVLASDPFRKMEGLNGDIPFHICPFEPSLQNDVNLLVKQIKNYLIDAQVSVLEINLYDLVIELCKEEDDWDWLLENEATMSKQEFKEEIQGIIDTKAILIPAIVNKMSENKFDILIITGVGEVYPYIRSSNLLENLQIKAKEKPTLMFYPGQYKHSAEKGTSLVLFGTLEDDKYYRAFNILDRAI

SEQ ID NO: 5820 - protein, 196 aa, Enterococcus faecalis; identical to SEQ ID NO: 5730

SEQ ID NO: 5821 - protein, 207 aa, Pseudoalteromonas flavipulchra
MAGKFNSVLTKLNFNEAYTHLTDVLSSQAFTNMEGLNGDIPFHICPFEPSLQSQVNLLVKQVRNYLTDAQVKTLEVNLYDIVVEILKEEGDWEWLLENESTMTKQELKEEIQGIIDTKTVLIPAIVKKMSEVDFDILIITGVGEVYPYIRSSNLLENLQIKAKDKPTLMFYPGQYKHSVEKGTSLILFGTLEDDKYYRAFNILDRAI

SEQ ID NO: 5822 - protein, 200 aa, Escherichia coli; identical to SEQ ID NO: 5608

SEQ ID NO: 5823 - protein, 191 aa, Johnsonella ignava
MDLSQRLDEMELAIHKPSFRKGTGRANEVNYWVFDYTPEKELEVRERIEYMKNKNDRGDDDFEFVVFDLYDIIIDFLKKKSFMEKCYDFEKKRGIERIVKAVSNSMKVNDDDSLIVRYIKEHTPENAVVFLTGIGKCYPILRSHKVLNNLHQAFVRCPVVMFFPGTYNEQELILFNEIKDDNYYRAFRLAK

SEQ ID NO: 5824 - protein, 200 aa, Enterobacter sp.
MIDPVLEYRLSQVQSRIREERFLKNNGSGNEIGFWIFDYPAENELQVREHLKYLFRNLEKDHKFTHLNIFQIIIGMLTERGLFERVCQQEVKVGTEALKKQLVGLLNQKKIADYIAKKVDLQNQEFVILTGMGNAWPLVRGHELMSALQDVMGFTPLLMFYPGTYSGHDLSPLAGIDSRNYYRAFRLVPESGPAATLNPR

SEQ ID NO: 5825 - protein, 191 aa, Enterococcus faecium; identical to SEQ ID NO: 5709

SEQ ID NO: 5826 - protein, 192 aa, Bacillus cereus
MRNISERLDGILPKITDTSFRENKGLGNEIGFYIFDYDPKYEMLVRKHIVYMQERLKDDSSLHIREFDLYEIMLEILEEKGYLQKNIDMEQKKGSDFILNATRKALRLTSNNDLVVQYIIDRVQPNDIIFLTGVGKVFPIIRSHTILNNLHKAIDTVPLVMFFPGTYDGLELVLFGEIKDDNYYRAFQLIDK

SEQ ID NO: 5827 - protein, 191 aa, Enterococcus faecium; identical to SEQ ID NO: 5709

SEQ ID NO: 5828 - protein, 200 aa, Salmonella enterica; identical to SEQ ID NO: 5654

SEQ ID NO: 5829 - protein, 200 aa, Escherichia coli; identical to SEQ ID NO: 5608

SEQ ID NO: 5830 - protein, 200 aa, Salmonella enterica; identical to SEQ ID NO: 5654

SEQ ID NO: 5831 - protein, 185 aa, Bacillus cereus
MVIEVEIIQKKLDRFFKEIQKEDFVKMRGLGNEVPYFVFDYNPEYELMVRNSVKYFADKMQVNVKVLNLFDMIIDLFEDIGGIEGLKQFEEEQGTEELFEAILPTLEEEQLVERIGEEAADAQIVFVTGVGSAFQLVSTHELLNQLHARVTNTPIIIFYPGEYTGQGLSLFNRFESNGYYRAFSI

SEQ ID NO: 5832 - protein, 194 aa, Lactobacillus rhamnosus
MTQLSDRFDRFRKKIRDHAFQENRGLSNEVGFYIFDYDPKDELYVRNEVEDIAHDSTTASIGANVQMFNLFDVVIDLIDQMGYLQQFIEIEKDDGIDMVIRQINNVLKMGDERNLIVRYILDHLEHPEERNIIFITGIGQVFPLIRAHRVLNTMNQVIDKTPVVMFYPGSYNSLSLRAFGKLDDKNYYRAFRIE

SEQ ID NO: 5833 - protein, 189 aa, Haloarcula japonica
MLSDFQTRLEEVERLVREDREEVGKRAGVPFIVFTYDPADEIEVDEEIRSLIEKLEYHDQTVAAIDMRDLVFSVLEERGILDNVIDLERRDREQLLSGLKSSLLDDGEMGQLASAIATQAEDADTVIVYRMGILYPFASASTLMGQLETNTPDETPIVFCYPATVDDKSLRFLDESEGTYYRAKVIGHE

SEQ ID NO: 5834 - protein, 194 aa, Lactobacillus rhamnosus; identical to SEQ ID NO: 5832

SEQ ID NO: 5835 - protein, 200 aa, Salmonella enterica; identical to SEQ ID NO: 5654

SEQ ID NO: 5836 - protein, 201 aa, Vibrio tubiashii
MDAISALGATMDQRLHDRLNQIPDKILSPEFLSGQGLGNEIGFWIFDYEPEQELGVREYIEFLEVMLAKKHSHLKVVNINLLKCLVGYLADRNFVDKAIEMQKIKGDEALMKALKGPLHMDKFAPYLTEKHSATEQDIIFITGVGSVWPLLRAHNLLNSLHSLLGHKPVVLFYPGQYNGQAMSLFGRIPSNNYYRAFRLVP

SEQ ID NO: 5837 - protein, 200 aa, Salmonella enterica; identical to SEQ ID NO: 5654

SEQ ID NO: 5838 - protein, 200 aa, Escherichia coli; identical to SEQ ID NO: 5608

SEQ ID NO: 5839 - protein, 196 aa, Lactobacillus reuteri; identical to SEQ ID NO: 5628

SEQ ID NO: 5840 - protein, 200 aa, Escherichia coli; identical to SEQ ID NO: 5608

SEQ ID NO: 5841 - protein, 191 aa, Enterococcus faecium; identical to SEQ ID NO: 5709

SEQ ID NO: 5842 - protein, 200 aa, Escherichia coli
MIDPVLEYRLSQIQSRINEDRFLKNNGSGNEIGFWIFDYPAQCELQVREHLKYLLRHLEKVHKFACLNVFQIIIDMLNERGLFERVCQQEVKVGTETLKKQLAGPLNQKKIADFIAKKVDLAAQDFVILTGMGNAWPLVRGHELMSALQDVMGFTPLLMFYPGTYSGYNLSPLTDTGSQNYYRAFRLVPDTGPAATLNPQ

SEQ ID NO: 5843 - protein, 203 aa, Sphingobium indicum
MTRDTNMMTPRERQDHLLEVVSSQRFLKKLGLGNEVPFFICPFPASDAVDMEQVRGQLVRQLANRGVTALDINLYDLAIDILRERGIWDELIAAEPSVTKDELKELLQNVLDPETHLIPEIGKRLASQSFDVLFLSGVGEVFPYIRSHNVLNNLQSTAKEKPTVMFFPGIYTHALASGASLDLFGILHDDKYYRAFNIFNYEV

SEQ ID NO: 5844 - protein, 200 aa, Escherichia coli; identical to SEQ ID NO: 5608

SEQ ID NO: 5845 - protein, 194 aa, Sporolactobacillus vineae
MRTLQDRLDDLLPKIQSADFLKGHGLANQANYYIFSYDPKYEMLVRDHVRYLVHRINDDPANSQHVVECDLYEIMLKILEEKGYLEKSFAMEKKYGSGRIFEATRRTLRLTQDDDQVIEYIREHVSPGDIILITGVGKAFPLIRSHTVLNNIFKASDHSPVILFFPGAYTGQELVLFNAIQDENFYRAVPIVQD

SEQ ID NO: 5846 - protein, 199 aa, Streptomyces sp.
MTPIELSNQEEHLFQVLSGKRFLQMEGLSNEVPFFIYPYEPEDALVVAGAKKRIKNRLANKGIEVREINLYDLSVEMLKERGVWDRLLALEPDQDKADFRELLQGMLDPQDHISPAIRAKLAEGDFDIFFLTGIGEVFPYIRSHNVLNNLQSVVTGKPMLLFFPGRYEQSDTLGSSLVLFGRLKDDQYYRAKNILEQEA

SEQ ID NO: 5847 - protein, 200 aa, Salmonella enterica; identical to SEQ ID NO: 5654

SEQ ID NO: 5848 - protein, 191 aa, Enterococcus faecium; identical to SEQ ID NO: 5709

SEQ ID NO: 5849 - protein, 200 aa, Escherichia coli; identical to SEQ ID NO: 5608

SEQ ID NO: 5850 - protein, 200 aa, Escherichia coli
MIDPVLEYRLSQIQSRINEDRFLKNNGSGNEIGFWIFDYPAQCELQVREHLKYLLRHLEKDHKFACLNVFQIIIDMLNERGLFERVCQQEVKVGTETLKKQLAGPLNQKKIADFIAKKVDLAAQDFVILTGMGNAWPLVRGHELMSALQDVMGFTPLLMFYPGTYSGYNLSPLTDTGSQNYYRAFKLVPDTGPAATLNPQ

SEQ ID NO: 5851 - protein, 201 aa, Bacteroides sp.
MTVEQLFQKLSSKEFKDTENGDLFYNFFIFQYPANKEYEIRQQIQEFKVKLIRPCNYIDVLTLNLFDEFCKFLDGQSFGKKHPSYLKYLLEKDESTPDAVTSSLTNKANSEAFYQYIHQRIIDHITIDDDKIRPYVFLYGIGNMFPYMRTNVFLANYEQYNRSSRYKIIVFYPGHREDNNFNLFDRLDDQHTYRATLLIND

SEQ ID NO: 5852 - protein, 200 aa, Escherichia coli; identical to SEQ ID NO: 5850

SEQ ID NO: 5853 - protein, 200 aa, Escherichia coli; identical to SEQ ID NO: 5850

SEQ ID NO: 5854 - protein, 200 aa, Escherichia coli; identical to SEQ ID NO: 5608

SEQ ID NO: 5855 - protein, 203 aa, Cylindrospermopsis raciborskii
MALDIETQPIQERFQHLLKVISGDRFLKKQGLGNEVPFFICPYRPEESVEMEHIQQQLTKSLNQAGLGVLEINLYNLSIELLQKRGVWEQILDIEPSVSKEQLRELLQGVLDPEKHLVPAIAEKMAQREFAVMFISGVGEVFPYIRSHNVLNNLQSTAKEHPTVMFFPGAYTHSLETGPSLDLFGRLRDDKYYRAFNIFHYEP

SEQ ID NO: 5856 - protein, 207 aa, Microcystis aeruginosa
MGEIWMSSLETIAINQRFEYLLSVLSAERFLKKQGIGNEVPFFICPYPPQDSVEMERLQKQLVSQLHQKGIRILEINLYDLCLELLRERQIFEQILDIESSISKGELKELLQNVLDSESHLIPALGEKIAENPFDILFLWGVGQIFPYIRSHNVLNNLQTTNNNQPTVMFFPGAYTYSLESGASLNLFGLLGDDKYYRAFNIYEYQV

SEQ ID NO: 5857 - protein, 182 aa, Vibrio cholerae; identical to SEQ ID NO: 5680

SEQ ID NO: 5858 - protein, 182 aa, Vibrio cholerae; identical to SEQ ID NO: 5680

SEQ ID NO: 5859 - protein, 200 aa, Enterobacter hormaechei
MNDPILDYRLKQLEERIGDDRFLKNQGSGNEIGFWIFDYPAQQELQVREYLAFLFKKLEKKYTFTQLNIFQVIIDMLEERKLFERICQREPELGLETLKKHLAAPLSQKKIAEYIARTVDLPSQQFVILTGLGNAWPLVRGHELMSALQDVMGFTPLLMFYPGNYSGYDLSPLAGINSRNYYRAFRLVPETGPAATLNPR

SEQ ID NO: 5860 - protein, 203 aa, Marinobacter sp.
MSKDIARMPMQDRFQHLYSVISGQRFLNKQGLGNEVPFFICPFRIEEAVEMERLQSQLVNRLEQKGIKVLSINLYDLAVELLKERELWSQVIDLEPTVSKGELTDLLQGVLDPDAHLVPAIAKKLHAVEFDVLFLSGVGEVFPFIRSHNVLNNLQSTAKDKPTVMFFPGTYTHSLETGSSLDLFGRLHDDKYYRAFNIFHYEA

SEQ ID NO: 5861 - protein, 200 aa, Escherichia coli; identical to SEQ ID NO: 5707

SEQ ID NO: 5862 - protein, 200 aa, Salmonella enterica
MIDPVLEYRLSQVQSRISEERFLKNNGSGNEIGFWIFDYPAQNELQVREHLKYLFRNLEKDHKFAHLNIFQIIIDMLTERGLFERVCQQEVKVGTEALKKQLVGLLNQKKIADYIAKKVDLQNQEFVILTGMGNAWPLVRGHELMSALQDVMGFTPLLMFYPGTYSGHDLSPLAGIDSRNYYRAFRLVPENGPAATLNPR

SEQ ID NO: 5863 - protein, 193 aa, Lactobacillus casei
MVPLKKKFQDLREKIQTQSFQENRGLSNEVGYYIFDYDPEKELYVRGEIGDIIRQEKAAPTGVTIQVFNLFTIMLTIVDQFGYREAFIDLEKSNGITQVIDWMHNIMEMNEEHNLVVQYISDHLNKDGPTIVFITGVGQVYPIIRAHKVLNTMTQVIDQIPVMMFYPGNYNSVRLQAFGELQEDNYYRAFHFE

SEQ ID NO: 5864 - protein, 191 aa, Enterococcus faecium; identical to SEQ ID NO: 5709

SEQ ID NO: 5865 - protein, 182 aa, Glaciecola lipolytica; identical to SEQ ID NO: 5680

SEQ ID NO: 5866 - protein, 192 aa, Oribacterium sp.
MADLAARLDEMEIEIKKPKFRQSSGRANEVNYWVFDYPPEKEMEVRDRIKYLKNKNKNSSDDFELVVFDLYDIIIDFLEKKNYMEKCFDFEKKKGLERITKAVSNSMKFNDDDSIIMQYIKDNTPDNAIVFLTGIGKCYPILRSHKVLNNLHQAFVKTPVVMFFPGTYNEQELILFNEIKDDNYYRAFKLVK

SEQ ID NO: 5867 - protein, 182 aa, Vibrio cholerae; identical to SEQ ID NO: 5680

SEQ ID NO: 5868 - protein, 200 aa, Escherichia coli; identical to SEQ ID NO: 5608

SEQ ID NO: 5869 - protein, 200 aa, Escherichia coli; identical to SEQ ID NO: 5608

SEQ ID NO: 5870 - protein, 192 aa, Methanoplanus limicola
MNIESRIELLKKEIIKDDFLQGRGLGNEVPFWIFDYPPESELLIRHSMEKIGDILDNNSIGYIEIDLYEMCLETINKKIRPEKLIDFEAKKGSDELLKKLKIILKPDTVKQILKERIESDGNVKIIFLTGIGKAWPLIRSHSILNNLQPVTGNIPLVAFYPGEYRNYELSLFGRFKDANYYRAFRMINENTA

SEQ ID NO: 5871 - protein, 182 aa, Methanoplanus limicola
MTKLQNLSKKYKDHVELEWQRNISGPEKVWFCIYDPNSERKIRAGIKEFEIYTIQSGHKWTEIDLSPFFEEWLSANEYREEYFSEPEYLLDDLTELKEFLVGKIREKTTDSDEDTVIAVLGIASMFGILRASQIVELIIDKIKISGRLLVFFPGERDKNNYRLLKARDGWNYLAYPIEAEED

SEQ ID NO: 5872 - protein, 182 aa, Vibrio cholerae; identical to SEQ ID NO: 5680

SEQ ID NO: 5873 - protein, 200 aa, Escherichia coli; identical to SEQ ID NO: 5608

SEQ ID NO: 5874 - protein, 182 aa, Vibrio cholerae; identical to SEQ ID NO: 5680

SEQ ID NO: 5875 - protein, 192 aa, Bacillus cereus
MRRINERLDEILPKITDASFRENKGLGNEIGFYIFDYDPKYEMLVREHIVYMQERLKNDSSLHIREFDLYEVMLEILEEKGYLQKNIDMEQKKGSDFILNATRKALRLTSNNDLVVQYITDRVQPNDIVFLTGVGKVFPIIRSHTILNNLHKAVDNVPLVMFFPGTYDGLELVLFGEIKDDNYYRAFQLIDK

SEQ ID NO: 5876 - protein, 182 aa, Vibrio cholerae; identical to SEQ ID NO: 5680

SEQ ID NO: 5877 - protein, 204 aa, Salmonella enterica
MRAKLDSKPQLSARLEQIEDRLKSEGFLKNQELGGEIGFYIFDYPPQFELTVREYLRLTLPRLARQGLNFAHLNLFEEVLAILQERKLLDKAFDLERKKGTDELAKALKGPLEQGRIAKHLIDKVLPASPQFVLLSGLGQCWPLLRGHSLLNALHAHMGAIPLVLFYPGSYNGLELYPFDLDSAEVATANYYRAFQLVPHASKY

SEQ ID NO: 5878 - protein, 123 aa, Collinsella aerofaciens
MNLYDAVLAILEKRRVLKAIPHQEERRGTQRVLEDVAKFASPEKVAAYILEQTEPHAPGDVVLLTGAGEVFPFFRIHTLLHCMLADFDEVPVVAAYPGSFNGSSFQLFNRLPADNYYRAIDIS

SEQ ID NO: 5879 - protein, 191 aa, Enterococcus faecium; identical to SEQ ID NO: 5709

SEQ ID NO: 5880 - protein, 182 aa, Vibrio cholerae; identical to SEQ ID NO: 5680

SEQ ID NO: 5881 - protein, 203 aa, Bacteroides sp.; identical to SEQ ID NO: 5741

SEQ ID NO: 5882 - protein, 180 aa, Vibrio cholerae
MKNDGLGNEIGFWVFDYPAKYELLVREHLKHVDEKLNKRGYRFVHLNIFEVLIDMLEERGLFDRACQRELQVGVDGLRKTLAGPLSQEKVARYIADKYKPSELEFVLLSGLGSAWPLVRGHELLSALQDVMGSTPLVLFYPGEYSGRDLHPFGMIESKNYYRAFKLVPEDGKKPFADNKK

SEQ ID NO: 5883 - protein, 194 aa, Vibrio cholerae; identical to SEQ ID NO: 5704

SEQ ID NO: 5884 - protein, 43 aa, Vibrio cholerae
MEHKDVMQLKHPLVIFYPSKISEDNILFLNFRPASKYRCTLVK

SEQ ID NO: 5885 - protein, 191 aa, Enterococcus faecium; identical to SEQ ID NO: 5709

SEQ ID NO: 5886 - protein, 185 aa, Fusobacterium sp.
MEIMKDRLKELIKKVNSDEFFNNRGLANEVPFYIFDYNPKYELEIRDFVKNSLLINLENNTRLKAVEIDLFELLLESMKNDNILESAFELEEKKGTKFLYEKLKKSFNTEIIMKYIAEKTKDKNFLILTGVGKVFPIVRTHTILNNLQNIFDHTKVLLFFPGEYTSTDLRLFGFQDNNYYRAFKI

SEQ ID NO: 5887 - protein, 43 aa, Vibrio cholerae; identical to SEQ ID NO: 5884

SEQ ID NO: 5888 - protein, 196 aa, Aurantimonas manganoxydans
MNNLEQRLGAIQAKITSKEFLTGRQLGGDIPYWIFDYPPADELRVREHVNHLLRRLNSDASTVKACHVDLLDLVKTMLEGRRLLDRAIEMQKNKGNAAVSKALAAEMDPERIADAFIKSISIESCSFVLVTGVGASYPLVRTHSLMNTLHSRTGHVPIVFFYPGRYDGQYLRLFDATPHSAYYRAFRLVSDSEGSE

SEQ ID NO: 5889 - protein, 200 aa, Sinorhizobium meliloti
MSKTTNPKDRFDHLLKVIASERFLKKQGLGNEVPFFIFPYPAEEAVGIDAMRASLVKQLENRGVRVVEINLYDLSISLLRDRGIWDDVLVAEPSIGKDELKELLQGVLDPETHLIPAIGAILASQQFDVFFLSGVGEVYPYIRSHNVLNNLQSTAKEKPTVMFFPGKYTHSLASGASLDLFGIMHDDKYYRAFDITHYEI

SEQ ID NO: 5890 - protein, 201 aa, Sphingobium yanoikuyae
MVGTKTDRRARAEHLFRVVSSDRFLQKQGLGNEVPFFICAFDAEDGLSLGEDREDLIARLSHAGVRVLDIDLYDLSIRILEDRGIFEQILEVEAETEKAELKELLQGVLDPQAHLIPEIARHIEEVPHDVIFLSGVGEVYPYLRSHNVLNNLQSTAKDRPTVMFFPGKYTHALATGASLELFGLLHDDKYYRAFNIMNYEV

SEQ ID NO: 5891 - protein, 191 aa, Pseudomonas fragi
MNQQLQDRLNQIPDKILTEEFLRSQGLGNELGFWIFDYAPEDELQVREYLSFLQGFLAKKHSQLKVAHINLLQAMREYLDQRSFTEKAIRMQQTKGDLALLKALSGPLHMDKFAPFLMEHSDADQHDVVLISGVGSVWPVLRAHNLLNKLHALLGHKPLVLFYPGHYSGQSLALFDRIPSNNYYRAFKLVP

SEQ ID NO: 5892 - protein, 184 aa, Lactobacillus helveticus
MDDSKFRHNEGLSNEVGYYVFDYPADQELYMRKQIDKIQESPRAARVNIKVFDIYDIMMHLLKDQEKYTGSDPIPILEDIEKNQGFDVLIEQINNILEMSENNNLIVGYIKERIPERDGQCIVFLTGLGKVYPIIRAHKILNTMHQVLDNNPVVMFYPGNYDEMSLRAFGEIKDQNYYRAFRID

SEQ ID NO: 5893 - protein, 182 aa, Vibrio cholerae; identical to SEQ ID NO: 5680

SEQ ID NO: 5894 - protein, 183 aa, Faecalibacterium prausnitzii
MGDIQKRLDNVRQMIQIQDFLEGKGLSNEVNIRIFCYEPRDEMAVRHFIEQLSTDLTLECQLRICNLYQIFLEICEDMDILDAIPDMEEEDGHDYLLEQLQSTIGVDEIVQEIQSEPFQPGEVLVLTGVGEAFPFMRIHTLLEASLFAERPVLVFYPGTFNDQQLRLFNCLKPNNYYRAFNVV

SEQ ID NO: 5895 - protein, 191 aa, Acinetobacter sp.; identical to SEQ ID NO: 5720

SEQ ID NO: 5896 - protein, 203 aa, Bacteroides sp.
MTIKELDDKLNSPGFQDTENGDLFYNFFIYQYPAEKEYDIRKQIQEFKQNLIRPTNYVDVLTLDLFEEFCNYLNGQKFLKFDSMLQYLLEKEQEQPDTSDKIFSTLERHAHSEKFVKYLHERIVAHITIDDEYRRPYVFIYGIGTMYPYLRANELLAKYEDYNETGRYKIILFYPGHREQSSFKLFDTLNDHHTYRATFLINE

SEQ ID NO: 5897 - protein, 194 aa, Proteus mirabilis
MKALQTRLDLIQERIESPKFLKNDGLGNEIGFWVFDYPAKYELLVREHLKHVDEKLNKRGYRFVHLNIFEVLIDMLEERGLFDRACQRELQVGVDGLRKTLAGPLSQEKVARYIADKYKPSELEFVLLSGLGSAWPLVRGHELLSALQDVMGSTPLVLFYPGEYSGRDLHPFGMIESKNYYRAFKLVPEDGKKI

SEQ ID NO: 5898 - protein, 184 aa, Bacteroides sp.
MSSTFQIEHNRLFGELREVLKTDIVRITGKANGGRSILFVYPPEDDDAYIAYARENFNSDEYSFIDLRTLFTEFISEQGIEQFQENYKEFGNEVFFSDNFYEETFFYYIIKAIENSYQMNKIPVLVHTGTIYGMGFSNINIMEHRIVMSAQLPLIAFYPATVDKDNINFLGRQIASKYRCIVIK

SEQ ID NO: 5899 - protein, 200 aa, Salmonella enterica; identical to SEQ ID NO: 5654

SEQ ID NO: 5900 - protein, 191 aa, Pseudomonas fuscovaginae
MNQQLQDRLNQIPEKILTEEFLKSQGLGNEIGFWIFDYAPEDELQVREYLDFLKGLLAKKHSHLKVAHINLLQAMREYLDLRSFTDKAILMQQSKGDQALLKALSGPLHMDKFAPFLMEHSGAAERDVVLISGVGSVWPVLRAHNLLNKLHALLGHKPLVLFYPGHYSGQSLSLFKRIPSNNYYRAFKLVP

SEQ ID NO: 5901 - protein, 192 aa, Lachnospiraceae bacterium
MTDLTERLDMMEAAIKKPGFRKSAGRANEVNYWLFDYPPENELEVRERIAHLKAENESGANDFTLAVFDLYDIIIDFLENKNFIEKCFDFEKKKGLERITKAVSNSMKFNDDDSVIVQYIKDNTPDNAVVFLCGIGKCYPILRSHKVLNNLHQAFVKAPVVMFFPGKYNEQELILFDEIKDDNYYRAFKLVK

SEQ ID NO: 5902 - protein, 182 aa, Vibrio cholerae; identical to SEQ ID NO: 5680

SEQ ID NO: 5903 - protein, 191 aa, Roseburia inulinivorans; identical to SEQ ID NO: 5590

SEQ ID NO: 5904 - protein, 200 aa, Salmonella enterica; identical to SEQ ID NO: 5654

SEQ ID NO: 5905 - protein, 195 aa, Acidovorax sp.
MTLSLEERLNQILPRITSREFLDSKGLGNEIGFWIFDYPPDREMEVRDFLSGTVVPALGKQLPAIRCAVVNLLALVTDLLEERNLLDKAIAMQHDKGDDSALVALRSVLKEDKLAQKIATRHDIAALDLLVLTGVGAVYPMLRTHTLLSALHPIMGNTPLLMFFPGRYDGHSLRLFNTQAEDHYYRAFRLVPEAT

SEQ ID NO: 5906 - protein, 184 aa, Desulfonatronospira thiodismutans
MSRTKQLIEVYSNYISIPWRRDEAPAQRIIFCVYNEAEELKIRARIDEFELATRQAGHDWYLFDLTESFACWMLSQKYAGKYFQNPDLLKTLLPENYQQHITRSFAEFYEKNNIDDNSVVTLMGVGSLFGFSKVRDVVDSLSSIVAGRLVVLFPGSYENNNYRLLDGYDGWNYLAVPLTADASL

SEQ ID NO: 5907 - protein, 193 aa, Oribacterium sp.; identical to SEQ ID NO: 5718

SEQ ID NO: 5908 - protein, 190 aa, Magnetospirillum sp.
MSNLDDRLNMVLDRLVSDDLISGRGLGNEIGFYIFDYPAEDELAIRDHLGFLMEQLPKKRPGLRVKHINLFDMVLDHLADRKLLDKAIEQTRKKGDAFLLKALSEPLKGSKLAPVFEAACDLSNHDLVLVSGVGTIYPLLRTHSLLNNLHHVMRDKPLVMFFPGRYDGQTLRLFGTLKDDNYYRAFKLVP

SEQ ID NO: 5909 - protein, 200 aa, Escherichia coli; identical to SEQ ID NO: 5608

SEQ ID NO: 5910 - protein, 182 aa, Vibrio cholerae; identical to SEQ ID NO: 5680

SEQ ID NO: 5911 - protein, 191 aa, Acinetobacter baumannii
MSKAIHERLNQIPERILSTEFLTGQGLGNEIGFWIFDYAPEDELKVREYLHFLDGMLEKKYSQLKVVNINLLQAVVDYLSERNFIDKAIQMQKAKGDEALLKALKGPLHMDKFAPYLVSKYATNAQDIVLMTGVGSVWPLLRAHHLLNSLHSLLGHKPVVLFYPGYYDGQAMSLFGKIPSNNYYRAFRLVP

SEQ ID NO: 5912 - protein, 191 aa, Acinetobacter baumannii; identical to SEQ ID NO: 5572

SEQ ID NO: 5913 - protein, 190 aa, Magnetospirillum sp.
MSILDDRLNKVLDRLISDDLLSGRGLGNEIGFYIFDYPAEDELTVREHIGFLLEQLPKKRPGLRVKHINLFDMVLGHLGDRKLLDKAIEQTRKKGDAFLVKALKEPLHGSKLAPVFEAACDLPNHDLVLVSGIGTVYPLLRTHSLLNNLHHVMRDKPLVMFFPGIYDGQILRLFGKLKDDNYYRAFKLVP

SEQ ID NO: 5914 - protein, 200 aa, Escherichia coli; identical to SEQ ID NO: 5608

SEQ ID NO: 5915 - protein, 43 aa, Vibrio cholerae; identical to SEQ ID NO: 5884

SEQ ID NO: 5916 - protein, 185 aa, Bacteroides sp.; identical to SEQ ID NO: 5698

SEQ ID NO: 5917 - protein, 182 aa, Vibrio cholerae; identical to SEQ ID NO: 5680

SEQ ID NO: 5918 - protein, 200 aa, Escherichia coli; identical to SEQ ID NO: 5608

SEQ ID NO: 5919 - protein, 182 aa, Vibrio cholerae; identical to SEQ ID NO: 5680

SEQ ID NO: 5920 - protein, 203 aa, Methylophaga aminisulfidivorans
MSTPVTRKNIDDNYEHIFNVVSGKRFRNKQSLNNEIPFFICPYDPAIAVEMERLQARLTKRLEKAGVSILEINLYDQAIEILKERGIWEQIFEVEPTVSKDELIELFQNVLDPAANLIPAIAEKLANSEFDVLFISGVGEVFPYIRSHNVLNNLQSTAKDKPTLMFFPGMYTHSLETGASLDLFGRLHDDKYYRAFNILDVEP

SEQ ID NO: 5921 - protein, 200 aa, Escherichia coli; identical to SEQ ID NO: 5608

SEQ ID NO: 5922 - protein, 182 aa, Vibrio cholerae; identical to SEQ ID NO: 5680

SEQ ID NO: 5923 - protein, 207 aa, Photobacterium sp.
MAGKFNSVLTKSSLKDAYAHLTDVLASDPFIKMEGLNGDIPFHICPFDPALQNDINLLIRQIKNYLIDAQVKVLEINLYDLVIEIAKEEGDWEWLLENEVTMAKDVFKEQLQGIIDTKPVLIPAIVDKMAEAEFDLLLITGVGEVFPYVRSSNLLENLQIKAKEKPTLMFYPGQYKHSVEKGTSLVLFGTLEDDKYYRAFNILDRAI

SEQ ID NO: 5924 - protein, 182 aa, Vibrio cholerae; identical to SEQ ID NO: 5680

SEQ ID NO: 5925 - protein, 186 aa, Fusobacterium sp.; identical to SEQ ID NO: 5778

SEQ ID NO: 5926 - protein, 193 aa, Clostridium perfringens
MKNIYDRVDEILPKITEPNFRENKGLGNEIGFYVFDYEPEYELLVRERVKSIKERAKRVYDLNIVEFDLYEVILEILDSKGYLKKNFDMEIKRGSEQVFNATKKALRLTLDNDLVVKYISERLEGSDIVFLTGIGKAWPIIRSHTILNNLHRIVEKQPLVMFFPGNYDGGTLMLFNQLKDDNYYRAFQLVDKY

SEQ ID NO: 5927 - protein, 222 aa, Actinomyces neuii
MSKQSHTASFRRSQQYPPSLQETLDIALRVMTSKRFLNREGLGNEVPYYVLRYRIEWDRSFDQSLRQMLSHLNESVPTLHIDVYQLAIQIWRDCGYWDQILAQEAGMDRQDFADGLAQILDAERVLAPAIAERIQAAPDSRVVILSGVHHLFPIMRAHRLLNCLQPLTGDVPVVLTFPGSYRQSPTVGSALVLFDQVSEDNYYRAFDLLDQQYALETIKDES

SEQ ID NO: 5928 - protein, 191 aa, Enterococcus faecium; identical to SEQ ID NO: 5709

SEQ ID NO: 5929 - protein, 200 aa, Escherichia coli; identical to SEQ ID NO: 5608

SEQ ID NO: 5930 - protein, 182 aa, Vibrio cholerae; identical to SEQ ID NO: 5680

SEQ ID NO: 5931 - protein, 182 aa, Vibrio cholerae; identical to SEQ ID NO: 5680

SEQ ID NO: 5932 - protein, 185 aa, Fusobacterium necrophorum
MKELDIRFQNLIQKVKSDEFYYNKGLANEVPFYIFDYNPKEELEVREYIHSLFLPEIQKEDRLQVVEIDMFELLLESMKNDNILEKAFLMEEQKGTQFLYEKLKKSFNVEVILRYISQKSKGKNFMILTGVGKVFPIVRTHTILNNLQNILEDTKVLLFFPGEYTSTDLRLFGFEDNNYYRAFRI

SEQ ID NO: 5933 - protein, 43 aa, Vibrio cholerae; identical to SEQ ID NO: 5884

SEQ ID NO: 5934 - protein, 167 aa, Xanthomonas vesicatoria
MPWRKDAAAAQRVIFCVYHETEELRLRAKVDEFEIATRAAGHDWAEFDLTDSFPNWLASQRYAKSYFQRPNLLTTLLPKYLGYIETEFDAFLQEKNVSDHFVVALQGVGSLFGFLKVKEVVDKLAPKVKGRLLVFFPGSYEENNYRLLDGYDGWNYLAIPITADKEF

SEQ ID NO: 5935 - protein, 192 aa, Lactobacillus zeae
MTALDKRFERFREKLKDPAFQQNRGLSNEVGFYIFDYDPKDELRVRNEVENIANTSTPATIKANVQVFNLLNIVMTIFEQMGYSLSEAEKKDGISVVIRQVNNVLKMGHEHNLIVQYIEEHLIRNDSPTIIFLTGVGQVFPLIRSHRVLNTLNQVIDKQPVVMFFPGKYNSLNLNIFGKLSDNNYYRAFRIG

SEQ ID NO: 5936 - protein, 185 aa, Bacteroides ovatus; identical to SEQ ID NO: 5698

SEQ ID NO: 5937 - protein, 200 aa, Escherichia coli; identical to SEQ ID NO: 5850

SEQ ID NO: 5938 - protein, 200 aa, Escherichia coli; identical to SEQ ID NO: 5850

SEQ ID NO: 5939 - protein, 184 aa, Coprobacillus sp.
MDNVKERLDQIKDLIQQTDFLEGKGLSNEVNIRIFCYNPKEEMIIRHFIKQIEHEDLNCHLIHHDLYEVFLNICEDKRILSRIPNLEEKKGKDFVRKQFEKSCDAKTFANMMQYDNHQAGDVIILSGVGKVFPFMRVHALLEAMQLLFNSVPILVFYPGEFDGHYVKLFNKLKANEYYRAFKSI

SEQ ID NO: 5940 - protein, 208 aa, Natronorubrum tibetense
MTSTRNPLKRFTEELVDFASGERRGIRNPFVMVPVEPSVEHRVTERLVQWADPETPDTLTNWAGIENQAGNELTVECVRLDHLMPETRVFETTLDLGPLERTTTNAVTETLETSLADELIGKLVEGQLKGENAQQHILLLVNLGSLYPFTRASELLDEMDRRNVNTTIGIPFPGSIRGGKLSFFNEDARHYYPAHRIDEKITEVYLDD

SEQ ID NO: 5941 - protein, 193 aa, Haloarcula argentinensis
MTTNRPFQDFTDRVAQFADGRRGIRNPFVIVPVQPKYERRVAEQLTEWATDPHRTKDFPDDGTVQVLRLDELFVETAVFELAVDLGKHSQPATITETMQDRLAEELVESMLDRIESPSEQRHVVLLTHLGSLYPFTRASELLDELDRCNVQSTIGIPFPGDIVGGKLSFFGEESRNYYPAHQIEGRVEGVHLQ

SEQ ID NO: 5942 - protein, 195 aa, Halosimplex carlsbadense
MTDSPYLAFKEKLCTFADGQAGIRNPFVIAAVEPAVEHRVAERLSAWAVDADEAPAVETEVSVQPIWLDELLPKTKVYNLSVALGSETTAERIEETLQDRLAEELVEEMIANEIGDDRLQSQQHVVLLLNLGSLYPFTRASELLDELDRRNVRSTIGIPFPGDVVGGKLSFFGGDSRHYYPAHQIDGQIREVHLQ

SEQ ID NO: 5943 - protein, 210 aa, Pseudanabaena biceps
MTNRSSANNVIDRVVSALKTDLMAEGGAKISTMRNYQFAIAVYPPDREFEMRRKLKQMQDELQAVGWNVLSISLLQLFIERLKSKSPPSLERLIAMEKRLADKTSDRGLNYLKEKLTPEVEGADGIAQDIIRKINEFMPNATPDKKLILLSRVGGLYPFFRSSGLLRHLDGKTSNLPIVLLYPGDRQDVSSLSFMGEQTTDRDYRPRIYS

SEQ ID NO: 5944 - protein, 206 aa, Eubacterium saburreum
MDKVNFSAGEREGGLGHLSQRLDEMELAIHKPSFRKGTGRANEVNYWVFDYPPEKELEVRERVEYLKNKNDRGDDDFELVVFDLYDIIIDFLEKKNFMEKCYDFEKKRGIERIVKAVTNSMKVNDDDSLIVQYIKEHTPENAVVFLTGIGKCYPILRSHKVLNNLHQAFVRCPIVMFFPGTYNEQELILFNEIKDDNYYRAFRLVK

SEQ ID NO: 5945 - protein, 206 aa, Eubacterium saburreum; identical to SEQ ID NO: 5944

SEQ ID NO: 5946 - protein, 191 aa, Stomatobaculum longum
MDLSQRLDEMELAIHKPSFRKGTGRANEVNYWVFDYPPEKELEVRERVAYLKTKNDRGDDDFVLVVFDLYDIIIDFLEEKNFLEKCYDFEKKRGIERIIKAVTNSMKVNDDDSLIVQYITEHTPENAVVFLTGIGKCYPILRSHKVLNNLHQAFVRCPVVMFFPGTYNEQELILFNEIKDDNYYRAFRLVK

SEQ ID NO: 5947 - protein, 186 aa, Stomatobaculum longum
MNNLNGRLDKLRQLVQDRDFLEGKGLSNEVNIRIFCYDPQDEMTVTHFLNQIITDQSLDCNLIECNLYKLFIEICKDLDILDSIPDMEESEGSEYLLEQLHSAIGENEFIDKMREKYQPKIDDIMLLTGVGDVFPFMRVHKMLEAMQPFFSEIPILVMYPGVFDGNYLRLFDKLQPNPYYRAFNVV

SEQ ID NO: 5948 - DNA, 477 bp, Acetohalobium arabaticum
atggtcaatcttgatgatctcataagagtaagcagagataatcactataagttattgactttagttggtgataatccggctaaagttgatgagattactgcttatttggaagataaagattgggaagtctatgatgttgaagagaatgtattggatttaatcgaagatattccagaaggtaagatatatttaaggattggagataagataaaaaagtgggtaaatactttaggtgatagaatagttttaactaataccagtatactatgttctccggaactggataagattactccgcttggagcatttaaatatctgatgagaggtagtagagaagcggtattattcttagatgctagaataagggataataaagctatttattcccgtccgggacgtgatgattactgtgaaatggatttatcggaggttattagtgagcagatagataatgtaattattggaggcgatgattaa

SEQ ID NO: 5949 - DNA, 477 bp, Acidothermus cellulolyticus
gtggcggaaccgttggcggatcaggtcctgcgcgaagtcgatagggcgcgcgagctgtatcatcgcctgatccttatggtaggaccgtcgggaagcgggaagacgcacgcactgcagcaggtatcggcctcgacctccgcaccgctcgtcaacgtcaatcttgagctgtctcgccggatgctggacctaaccgaacgccaacgggctctgcaggctccaaggctcttgggcgaaatcgtgggcgaagccacaggcgagctggttttgcttgacaacatcgagattcttttcgatgtccacctgaagcaggatcctttgcgtctgcttcagggattgtcccggaacaagacggtcgtggccgcctggaacggatccatcgtggatggtcacatgacctacgccgtcccggaccaccccgaataccgccgctacccgattcgggattttctggtggtaagtctctcggtaacaacatga

SEQ ID NO: 5950 - DNA, 465 bp, Anaerobaculum mobile
atagaatcaataacgagtcaaatcctatcaaagattgacgaagttcatcagctctattatcgcttaatcctattagtaggtcccgcaggtagtggcaagacaaatattatgaaacaaatttctataaataaatcctccccgcttataaatgtaaactttagcctatctcgccggttacttgatctctccgaacgaaagcgtatcctcaaattaccggattttattagtgaaataatagatctaactaacggagatttagttttgcttgataatatagagcttctctttgatgttcgcttgaagcatgaccctctacgtttacttcaagggatatctcgaaatgtcactgttgtgtccacatggaatggatcgattacaagtggtcatctgatttatgctagccctggccatccggaatatcatcgttatcctattgaaagctttctagtagtcagtatgagataa

SEQ ID NO: 5951 - DNA, 465 bp, Caldicellulosiruptor kristjanssonii
attctatccaagtgggaatctatacttggtgaacttgataaatattactacaaacttgctcttattataagtgaagatacatatcaaacgagcaaaattttgaaggaattatcaacaacttttgggataaggtatataaatcttaatcttgagttagcaaattatttggttgaaattccattttccgaaaggtggttacacgtaaatagggcactcgatgaaataatattaaaaaataaagaacagtgccttattattgataatactgacatactgtttgaagagcatctaaaaattgatccagttggagttttaaagaatgcaagcaagtataaaaaattaattgcttctctcagagcacgaattgaaaataattatattatctacgcaaacccgcaggctaaggaatataaaaagtataaaattgataatcttgggtgttatgtagtaaatcttgaggagtga

SEQ ID NO: 5952 - DNA, 471 bp, Chloroflexus aggregans
atggtggaacccgtgacagatcaggtgctgcgagcaattgatcaggctcgcgcacgctactaccgcttgatcgtgattgtggggccggcgggaagtgggaagacagccgcgttgcaggcggtttcggcattgacctcggcaccgattatcaacgtcaatcttgagttgtcgcgccaattgctgaccctgaccgaacgccaacgagcgatccaactctcacgcatcgtgggcgacatcgtgaagaaaacggcagacgaactggttttgctcgataataccgagattctttttgatgtccatctgcacgtggatccgttgcgtctgctccagggattggcgcgcaaccggacggtcgtggcgacctggaacggtaccgtcgggccgaacgggctgacctacgccgttccgggtcatcccgaataccgccggtatcctaccggcgacctcgttatcgtggaggcgaaaccgtga

SEQ ID NO: 5953 - DNA, 516 bp, Desulfovibrio aespoeensis
atggccgagccgattcacgacaagataaaacgatccctccaggcagccgaaggcttgtatcaccgtctggtgttgctggtgggtgagaccggttccggcaagaccggcgttcttcgggatattgccgaggaattcggctcatctgtcgtcaacgtcaatctggcgctttcaggcgaactgcttgaactgacggcaaagcagcggtcgcttcggttgccgggcatcctcgatcagatcgcggaccaggctcaagcacccgtggtgctggataatctcgagatccttttcgacaaggatctccagcaggaccccttgcgcctgctgcagggcatttcaagaaaccgggccgtggtggcttcgtggaacggaatcatgaattccgggaggcttttgtacgccgaaaccggccatcccgagtaccgcagctatgactcggtcgatgcgctgattgtgggcatggatggcacggccactgtcgattcggcaaaaaacaatagagaggcaggacaagcatga

SEQ ID NO: 5954 - DNA, 516 bp, Dichelobacter nodosus
atggccgagccgattcacgacaagataaaacgatccctccaggcagccgaaggcttgtatcaccgtctggtgttgctggtgggtgagaccggttccggtaagaccggcgttcttcgggatattgccgaggaattcggctcatctgtcgtcaacgtcaatcttgcgctttcaggcgaactgcttgagctgacggcaaagcagcggtcgcttcggttgccgggcatcctcgatcagatcgcggaccaggctcaagcaccggtggtgatggataatctcgagatcctcttcgacaaggatctccagcaggaccccttgcgcctgctgcagtccatttcgagaaatcgggccgtggtggcttcgtggaacggaatcatgaattccgggaggcttttgtacgccgaaaccggccatcccgagtaccgcagctatgactcggtcgatgcgctgattgtgggcatggatggcacggccactgtcgattcggcaaaaaacaatagagaggcaggacaagcatga

SEQ ID NO: 5955 - DNA, 540 bp, Methanocaldococcus sp.
atggataacacatataaatatttagatagtgaatatttaaaaaaacttcttgaggtagtttctaagaatcattatcagatgctattaatttcagaacctgagaatcttgatcttaatcctaaatctaaaaaattaaaggaagaaataatagactggataacaaaaaatggtggaaaatattatgacatctcacaaattgttgtagaattgcttgaagaagatatatcttcagtagaaattgggctgaaacttaatgatataatttatgacattatatcaaaaaatagtggtattcctgaaccaataatatttgataatgttggattactgttttcaaaagattttgggggattagagccaataagaacatttaaataccactcaagaactcatccaatagttttatttgtcccattaaaattaaataaacttagacaaactgcaacattcggaaatcctggagatgaggattatagaagcgacatagatatctcagaaattatatgtgtagagttaaaggagatgatggccgatggttaa

SEQ ID NO: 5956 - DNA, 402 bp, Methanosalsum zhilinae
atggcacataagattcaaaataagttaaaacaataccttaaagatacagatgatctttattacaagcttattctgttagtagggaaacaaggctcaggtaaaacagctgttattaaagatgttgcagatgaacttagtgtaccagtcattaacgtaaatgtaagtatttcggagcaattaatagagttaacatcaaaacaacgttctctccatatttctcaaattttagaggatattattgataataatttttcaattaaatttttggacaatgttgagatgctttttgatagaaaattaaagttagatcctctcagaatcttgcaaaaaaatctcaagaaatcacgctgtcgttgcatcttggaatggttatgtagaggatggaaagctgatatatgctga

SEQ ID NO: 5957 - DNA, 576 bp, Methylacidiphilum infernorum
gtgccagaagatttgcccccattgacgctttcggaaggaagccatcgaccgctggttggaagagacacacgacgatacgaaagacggaggaaacgagtaatggctgagccattggtggatcaggtcctgcggaagatccgcgaggctcgcgaactctatcaccgcctgatactggtggtgtgcccggcgggaagcgggaagacgggtgccctctgggaggtgtcggcctcgacctccgcaccgctcgtcaacgtcaatctcgagctgtctcgccggatgctggacctcgccaaaagccaacgggctcggaagctacagcggatcttgggcgaaatcatgggtgaagccacaggcgagctggttttgctcgacaacatcgagatccttttcgatgtccacctggagcatgatcctttgcgtctgcttcagagattgtcccggaacaagacgatcgtggccgcctggaacggatccatcgtggatggttatgtgaactacgccgtcccagaccaccgcgaataccgtcgatacccgattcgcgattttatggtggcctgtccggagatgacgacatga

SEQ ID NO: 5958 - DNA, 456 bp, Moorella thermoacetica
gtgaagctacgagacctgatcaagcagatgcagactaactactacaagatgctggtaatcgtggacaacgggcgccagccggaaaaaatcatcaggcctttacaacaagagggatggaccgctgttgatgtaaccgatgccgtgctcaagcttattgagagcatccccgaaaataaggtaaaggtgcgaatcggcggcaagctgaaagaatggtttcattccctgcccgaccggctcattctttacaataccaccattctgtactctccggaactaggcaggcttaatccagtaggtgcgttcaaatataagtccagggaaaaggagattatcgtgctcttagagggtcgtctggccggtaaccgtattcaatattcccactacgggcggcccgactacgcggagatggatgtaagcgaggtaatccatgccagaatggaggatatcgatggctaa

SEQ ID NO: 5959 - DNA, 498 bp, Nitrosococcus oceani
atggccgagccagttcacgatacgataaagagttctctccaagcagccgaaggtctgtatcaccggctggtattgctagtcggtgaggctggttccgacaaaacggaagcctttcatgacgtcgcggatgagcttggcaccgaggttgttaatgtcaatctggtgctctcgagcgagttgctggagttgacagctaagcaacgggcactgcgcctgccggagatactggatcgtatcgtagataaagttcaatcgaccgtggtgctcgataacctcgaaatcctgttcgacaaggaattgaaacaagatcctttacggctcttacagagtatttctaggaatcgcccggtagtggcgtcttggaatggggtaattaaagaaggcaagctcatttatgctgaaataggccatcctgaatatcggcgctatgacatggctgacacattgatcgtgagcatggatggaacggcgacaatcgacttagaaaaaaataattag

SEQ ID NO: 5960 - DNA, 498 bp, Nitrosococcus watsonii
atggccgagtcaattcacgatacgataaagagttctctccaagcagccgaaggtctgtatcaccgactggtattgctagtcggtgaggctggttccgacaaaacgaaagcccttcatgacgtcgcggatgagcttggcaccgaggttattaatgtcaatctggtgctctcgagcgagttgctggagctgacagctaagcaatgggcactgcgcctgccggagatactggatcgtatcgtagataaagttcaatcgaccgtggtgcttgataacctcgaaattctgttcgacaaggaattgaaacaagatcctttacggctcttacagagtatttctaggaatcgcccgatagtagcgtcttggaatgggataataaaagaaggcaagctcatctatgctgaaataggccatcctgaatatcggcgctatgacatggctgacacattgatcgtgagcatggatggaacggcgacaatcgacttagaaaaaaataattag

SEQ ID NO: 5961 - DNA, 498 bp, Parvibaculum lavamentivorans
atgacccatgcgttcgcactatcggcagaggtggccaagctccctgcgcttgaacggctcatcgaggaaatcaacgatctccagagcaagctgatcctgctcgtcggcagcagcggcaaaacgcgccttctgcgcgctttggcgcgccggttgaacgccaagcctctcaatgtcggcgtgacgctcggacgtcgcttagcggtcacgcccgtctctgatcgcggtttctcgacgaacgaactgctccgcgaaatcactgatggcgtgagcggtgacgctccgctgctgctcgacaacctcgaagtgctctttgagcctagtctgaaggtcaatccactcaacgtcatcaaactgctggcgcactcacgtccggtcatcgcggtatggccaggtgaaatacacaacgatcggctgatttacaccggcatgggacatcccgagcaccgcgactacagccgcgacggcgtcgtcgtctttgaaacggcgcaacgtcaataa

SEQ ID NO: 5962 - DNA, 498 bp, Parvibaculum lavamentivorans; identical to SEQ ID NO: 5961

SEQ ID NO: 5963 - DNA, 489 bp, Planctomyces brasiliensis
atgagtgccgccacgaagacaactttgagcgatgcaattgcgcaggtccagcgctcgtttcaccgcttggtcctcgtcgtcggcccgactcgttccggcaagactccgcttcttcgtgaggttgccgaggagcaaagctgtccgattctgaacgtcaatctcgaattcagccaacggatgctggacctgccaagaacccgaagggcgatgaaggccgggacgatcttcaaggaactcgtcgctgagaaccggggcgacctgctgattctcgacaacctcgaagtcctgttcgacccgatcctgcaacttgacccattgcgactgctcaagtcggtcagccgtaaccagtcgttggttgcgtcgtggaatggggcgtggcaaaacggcgctttgaactacgccgaaccggaccaccccgagtacaggttgtaccggaacgtggatgtcatggtcgtgccggtgggccaagaatcgacaacgagccattga

SEQ ID NO: 5964 - DNA, 459 bp, Syntrophothermus lipocalidus
atgaaaacagatgagctcaaaaaacaaatagcagcagcccggtcgaggtattatcgactggtattactggttgggtcagctgcaaccggaaaaaccgaaatccttgttcaaacagccagagatgagggttatccctatattaatctgaacctcgcgctgagtcagaaactcctggaataccccgcaagaatgcgagcgttacgcctgccgagaatagtggagacgatcataggcgaaacgggaaagaatacggtccttctcgataacacagaaatactttttgatcctgtacttcaacaggaccctttacgtttgcttcaacaagtcagccgcaatcgaactatcgttgccgcatggaacggcaagttcgagggcggtgcgctggtctatgcggagccagatcacccggagtaccgaaaatattatgaagtcgatgcccttatttgtcctctggagtga

SEQ ID NO: 5965 - DNA, 486 bp, Tepidanaerobacter acetatoxydans
atggggttaacagacgagataacaaatgcacttatgattttttcacataagttctaccaactacttctaattgccggtgacgattcgcataaaaaaagccttcttttaaagcagatagctgaaagcggcaactatgcttatgtaaaccttaacctcgccctgtcagaacgcttgatgatgattccaagccatgaacacagcctatttgtgaatcagtgcattgatgaaatcataaatggcatcagtgctgaaacagttatttttgaccacatcgaaatactgtttgaaaaaccgctgaatacagaccccatggtacttctaaaaaatatctcgcggcacagaaaactcatatctgattggccaggcatcatcaaagatgatattctgatttatgctaaacccggccatagagaatatgtaaaataccctgttgaggtcgattatacaattattgatatagaccagaactataaggctagtttttaa

SEQ ID NO: 5966 - DNA, 486 bp, Tepidanaerobacter sp.; identical to SEQ ID NO: 5965

SEQ ID NO: 5967 - DNA, 477 bp, Thermanaerovibrio acidaminovorans
atggcggagcccttggcggatcaggtcctgcgaaagatcggcgaggctcgcgagctctatcaccgcctgatcctgatggtgggcccggcgggaagcgggaagacgtccgcgttgcaggaggtgtcggcctcgacctccgcaccgctcgtcaacgtcaatctcgagctgtctcgccggatgctggacctgaccgaacgccaacgggctctgcagctaccgcggctcttgggcgaaatcgtgggtgaagccacaggcgagctggttttgctcgacaacatcgagatccttttcgatgtccacctgaagcaggatcctttgcgtctgcttcagggattgtcccggaacaagacggtcgtggccgcctggaacggatccatcgtggatggtcacatgacctacgccgtcccggaccaccccgaataccgccgctacccgattcgcgattttctggtggccagtccggaggtgacgacatga

SEQ ID NO: 5968 - DNA, 477 bp, Thermoanaerobacter brockii
atgtccatttataaagatatacaggatgcttttattttgctaccgtataaatattacaagttaattttattagtaggaccaattgggagtggaaaaacgcaaattctcaagaaaatttcttctgattataactatgattacataaacttaaatttgaagctgtcagaaaaattaattaatataccttttgaagaacgttgctactatgtagatgattttatggaagaaattttgtttcaaagtaaaacagatgttacaatattagataacatagagattttattttctaatcatttaaagatagaccctttaaaattgcttaaaaatataagcagatacagaaaaataattgcttcatggggaggtatttatgtaaatggtatattgacatatgctgaaatagggcattcagagcatagaaaatataaaaagaatgatttggatgttattgttataagtatagaaggaggaaggtag

SEQ ID NO: 5969 - DNA, 477 bp, Thermoanaerobacter italicus
atgtccatttataaagatatacaggatgcttttattttgctaccgtctaaatattacaagttaattttattagtaggaccaattgggagcggaaaaacgcaaattctcaagaaaatttcttctgattataactatgattacataaacttaaatttgaagctgtcagaaaaattaattaatataccttttgaagaacgttgctactatgtagatgactttatggaagaaattttgtctcaaagtaaaacagatgttacaatattagataatatagagattttatttgctcctcatttgaaaatagaccctttaaaaatgcttaagaacatgagcaaatataaaaaaataattacatcctggggaggctcttatataaatggtatattgacatacgctgaacctggttatccagaatataggagatacaaaaaagatgacttggatataattgtaataaatgttgagggaggaagatag

SEQ ID NO: 5970 - DNA, 477 bp, Thermoanaerobacter pseudethanolicus; identical to SEQ ID NO: 5968

SEQ ID NO: 5971 - DNA, 471 bp, Thermoanaerobacterium saccharolyticum
atgttactatgtgagaatattagagacgcattggctattttgcaaaatgaatatcataaattgatactagttttgactctattagatgataaggcagaagttgtagagaaaatatctaataagtatgcatatgatgttttgaatgtaaatcttagattatcagaaaagttgattagcgttcctatatctgaacgctggctacatgttgatgaatttttttcaagattacttaatgactataagacggatgtgattgtattaaatagcatagagatgctatttgaaacccatttaaaggttgatccattgcggctactgaaaagtgtgagtaggtacagaaagattatagcaatctggacaggcgattatacagacggtgtgttgacgtatgcagagccttcacatccagaatatagaagatataaaaatgatgatcttgatttcataatggtacgcagcaactgcatatag

SEQ ID NO: 5972 - DNA, 471 bp, Thermoanaerobacterium thermosaccharolyticum
atgttactatgtgagaatattagagacgcattggctattttgccaaatgaatatcataaattgatactagttttgactcaattagatgacaaggcagaagttgtagagaaaatatttaataagtatgtatatgatgttttgaatgtaaatcttagattatcagaaaagttgattagcgttcctatatctgaacgctggagatatgttgatgaatattttaaaaaattacttaatgagtataagacagacgtgattgtattaaataacatagagatgctatttgaaccacatttaaaggttgatccattgcgattactgaaaagtgcaagtaggtacagaaagatcatagtgatttggacaggtgattatacaggcggtgcattgacgtatgcagagccttcacatccagaatatagaaaatataaaaatgatgatcttgatttcataatgatacgcagcaactgcatatag

SEQ ID NO: 5973 - DNA, 471 bp, Thermoanaerobacterium xylanolyticum
atgttactatgtgagaatattagagacgcattggctattttgtcaaatgaatatcataaattgataatagttttgactcaattagatgataaggcagaagctgtagagaaaatatctaataagtatgcatatgatgttttgaatgtaaatcttagattatcagaaaagttgattagcgttcctatatctgaacgctggatatatgttgatgaatattttaaaaaattacttaatgactataagacagacgtgattgtgttaaacaacatagagatcttatttgagccacatttaaaggttgatccattgcggttactgaaaagtgtgagtaggtacagaaagattatagcaatctggacaggcaattatacagatggtgtgttgacgtatgcagagccttcacatccagaatatagaagatataaaaatgatgatcttgatttcataatggtatgcagcaactgcatatag

SEQ ID NO: 5974 - DNA, 486 bp, Planctomycete KSU-1
ttgtcagaacaaatcataaaagggatagagcaggtaaccgggctttattacaggctgattttggtagtagctccgtcaggtaagggtaaaacattagccttacaagaggtccgcaaacgattagcattgcctttactgaatgttaatattgagctttcccgatgcctgctggaccttaccgaaaagcagcgggcaattcatgcatcaacaatcttaagagatattattgaaaaacataacgaaagagttatattgctggacaatacagaactcctctttgacgtatcactcaaactggatccacttcggcttcttcaggggatttctcgtaataaaactattgctgcctcctggaatggtaaaattgagaatggttatctgatatatgcagaaccaaatcacccggagtacagacgttatcccgtaaaagactttcttgtagtaagtccggaagaagactacttacctatttcaaataagatatga

SEQ ID NO: 5975 - DNA, 441 bp, Bacillus cereus
atggattttcatcttttaaaaaatgagatagaaaacatgagttcttggtggcataagttgatttttgtatgtaatgttgaatctatagtggacgaaatagttagtttaaattcagatatagaagtattgaatgtaaatctaataataagtgaatcattagtgagtgtatccaaaaataaatatcctctttatgttgaagacgttatgcaatataagattaataatccatctaaaatatatttacttcaatatattgatattttatttgatccggttttacaaatcaatccaattcgtttgttagaaaacataagtaaacggaataacctcattgtaatatggccgggagtatataaaaagggacagttgatttatgctgagaatggacatccagaatattattcaaatagtaattttgaagggaaagcaattacgaattaa

SEQ ID NO: 5976 - DNA, 423 bp, Lachnospiraceae bacterium
atgggtataattattagtagaaaaaaattttcttcgatgaattgcgaaggtttgttaaagccaattatctactgctctaattatgaagatattacatgtttagcactgtcattaaataaagagctcgcacaagggttggctttatttggacataagcaacgaacaatgcaaatagagaagtgctttgcgaaaatactcgcaaagttcccggataatgtagtgctgaaggattttgatgtgctatttaatccggattataaaatagatgtgctaaaaattatgataaacacatgcaaggtaaagccgtttagtattatttggccaggtatacttgatggtagaagactgatttacgcagaagaaggatttcaagattacaagacttatgacgtggatgcttatgacatcacgtgcatcgtataa

SEQ ID NO: 5977 - DNA, 447 bp, Enterococcus faecium
atggatgatatatggatgtttatttctcatttgaaaaaacaataccagaagttaggagtggtagtatctagccaagataaagaaattaatatggatagagtggaattcgtaaatttgaatctacctttaagtgaattacttctgaaaaagagtcggcgaagttggtatctgactgcttctgattttatcaaaggaataatagaacaatcttcagaagaagttgttctgtttgataactttgaattgataatgaatccagaattaggtgtcaattttatggatctattgctagaattaagtaagataaaagttgttttgattgcatggcattatgatattgaagggacaactctcatatatgcacaacctgggcacaaggaataccgccgtattgaaatgagagaagatcaattatttttttggataggagaagaaaatgctgtataa

SEQ ID NO: 5978 - DNA, 462 bp, Caloramator australicus
ttgtttgaggagactttgttacaaaaattaaataatatcaatcaaaattattataagttgatattaattatcaccaaagattttcaaaaaataaatagtttgttagtaaattttgctgaaaaaaatagcattccttatataaaccttaatttagaattatcaaaacgacttatttatgttccttttaacgaaagatggatatatgcagataaagagcttaaaaatattctgcttaaaaaggaacatgataccataattgttgacaatacagaaatcttattcgaagagcatttaaaattaaatccaatcgaagaactcaaaaatataagcaaatataaaaatataattgcatcagtaagaggaaattataaaaataatattttaacttatgctaaaataggagaaaaagaatttaaaaaatatatattggatgatttgttaaataatttaattacagtgtag

SEQ ID NO: 5979 - protein, 158 aa, Acetohalobium arabaticum
MVNLDDLIRVSRDNHYKLLTLVGDNPAKVDEITAYLEDKDWEVYDVEENVLDLIEDIPEGKIYLRIGDKIKKWVNTLGDRIVLTNTSILCSPELDKITPLGAFKYLMRGSREAVLFLDARIRDNKAIYSRPGRDDYCEMDLSEVISEQIDNVIIGGDD

SEQ ID NO: 5980 - protein, 158 aa, Acidothermus cellulolyticus
MAEPLADQVLREVDRARELYHRLILMVGPSGSGKTHALQQVSASTSAPLVNVNLELSRRMLDLTERQRALQAPRLLGEIVGEATGELVLLDNIEILFDVHLKQDPLRLLQGLSRNKTVVAAWNGSIVDGHMTYAVPDHPEYRRYPIRDFLVVSLSVTT

SEQ ID NO: 5981 - protein, 154 aa, Anaerobaculum mobile
MESITSQILSKIDEVHQLYYRLILLVGPAGSGKTNIMKQISINKSSPLINVNFSLSRRLLDLSERKRILKLPDFISEIIDLTNGDLVLLDNIELLFDVRLKHDPLRLLQGISRNVTVVSTWNGSITSGHLIYASPGHPEYHRYPIESFLVVSMR

SEQ ID NO: 5982 - protein, 154 aa, Caldicellulosiruptor kristjanssonii
MLSKWESILGELDKYYYKLALIISEDTYQTSKILKELSTTFGIRYINLNLELANYLVEIPFSERWLHVNRALDEIILKNKEQCLIIDNTDILFEEHLKIDPVGVLKNASKYKKLIASLRARIENNYIIYANPQAKEYKKYKIDNLGCYVVNLEE

SEQ ID NO: 5983 - protein, 156 aa, Chloroflexus aggregans
MVEPVTDQVLRAIDQARARYYRLIVIVGPAGSGKTAALQAVSALTSAPIINVNLELSRQLLTLTERQRAIQLSRIVGDIVKKTADELVLLDNTEILFDVHLHVDPLRLLQGLARNRTVVATWNGTVGPNGLTYAVPGHPEYRRYPTGDLVIVEAKP

SEQ ID NO: 5984 - protein, 171 aa, Desulfovibrio aespoeensis
MAEPIHDKIKRSLQAAEGLYHRLVLLVGETGSGKTGVLRDIAEEFGSSVVNVNLALSGELLELTAKQRSLRLPGILDQIADQAQAPVVLDNLEILFDKDLQQDPLRLLQGISRNRAVVASWNGIMNSGRLLYAETGHPEYRSYDSVDALIVGMDGTATVDSAKNNREAGQA

SEQ ID NO: 5985 - protein, 171 aa, Dichelobacter nodosus
MAEPIHDKIKRSLQAAEGLYHRLVLLVGETGSGKTGVLRDIAEEFGSSVVNVNLALSGELLELTAKQRSLRLPGILDQIADQAQAPVVMDNLEILFDKDLQQDPLRLLQSISRNRAVVASWNGIMNSGRLLYAETGHPEYRSYDSVDALIVGMDGTATVDSAKNNREAGQA

SEQ ID NO: 5986 - protein, 179 aa, Methanocaldococcus sp.
MDNTYKYLDSEYLKKLLEVVSKNHYQMLLISEPENLDLNPKSKKLKEEIIDWITKNGGKYYDISQIVVELLEEDISSVEIGLKLNDIIYDIISKNSGIPEPIIFDNVGLLFSKDFGGLEPIRTFKYHSRTHPIVLFVPLKLNKLRQTATFGNPGDEDYRSDIDISEIICVELKEMMADG

SEQ ID NO: 5987 - protein, 133 aa, Methanosalsum zhilinae
MAHKIQNKLKQYLKDTDDLYYKLILLVGKQGSGKTAVIKDVADELSVPVINVNVSISEQLIELTSKQRSLHISQILEDIIDNNFSIKFLDNVEMLFDRKLKLDPLRILQKNLKKSRCRCILEWLCRGWKADIC

SEQ ID NO: 5988 - protein, 191 aa, Methylacidiphilum infernorum
MPEDLPPLTLSEGSHRPLVGRDTRRYERRRKRVMAEPLVDQVLRKIREARELYHRLILVVCPAGSGKTGALWEVSASTSAPLVNVNLELSRRMLDLAKSQRARKLQRILGEIMGEATGELVLLDNIEILFDVHLEHDPLRLLQRLSRNKTIVAAWNGSIVDGYVNYAVPDHREYRRYPIRDFMVACPEMTT

SEQ ID NO: 5989 - protein, 151 aa, Moorella thermoacetica
MKLRDLIKQMQTNYYKMLVIVDNGRQPEKIIRPLQQEGWTAVDVTDAVLKLIESIPENKVKVRIGGKLKEWFHSLPDRLILYNTTILYSPELGRLNPVGAFKYKSREKEIIVLLEGRLAGNRIQYSHYGRPDYAEMDVSEVIHARMEDIDG

SEQ ID NO: 5990 - protein, 165 aa, Nitrosococcus oceani
MAEPVHDTIKSSLQAAEGLYHRLVLLVGEAGSDKTEAFHDVADELGTEVVNVNLVLSSELLELTAKQRALRLPEILDRIVDKVQSTVVLDNLEILFDKELKQDPLRLLQSISRNRPVVASWNGVIKEGKLIYAEIGHPEYRRYDMADTLIVSMDGTATIDLEKNN

SEQ ID NO: 5991 - protein, 165 aa, Nitrosococcus watsonii
MAESIHDTIKSSLQAAEGLYHRLVLLVGEAGSDKTKALHDVADELGTEVINVNLVLSSELLELTAKQWALRLPEILDRIVDKVQSTVVLDNLEILFDKELKQDPLRLLQSISRNRPIVASWNGIIKEGKLIYAEIGHPEYRRYDMADTLIVSMDGTATIDLEKNN

SEQ ID NO: 5992 - protein, 165 aa, Parvibaculum lavamentivorans
MTHAFALSAEVAKLPALERLIEEINDLQSKLILLVGSSGKTRLLRALARRLNAKPLNVGVTLGRRLAVTPVSDRGFSTNELLREITDGVSGDAPLLLDNLEVLFEPSLKVNPLNVIKLLAHSRPVIAVWPGEIHNDRLIYTGMGHPEHRDYSRDGVVVFETAQRQ

SEQ ID NO: 5993 - protein, 165 aa, Parvibaculum lavamentivorans; identical to SEQ ID NO: 5992

SEQ ID NO: 5994 - protein, 162 aa, Planctomyces brasiliensis
MSAATKTTLSDAIAQVQRSFHRLVLVVGPTRSGKTPLLREVAEEQSCPILNVNLEFSQRMLDLPRTRRAMKAGTIFKELVAENRGDLLILDNLEVLFDPILQLDPLRLLKSVSRNQSLVASWNGAWQNGALNYAEPDHPEYRLYRNVDVMVVPVGQESTTSH

SEQ ID NO: 5995 - protein, 152 aa, Syntrophothermus lipocalidus
MKTDELKKQIAAARSRYYRLVLLVGSAATGKTEILVQTARDEGYPYINLNLALSQKLLEYPARMRALRLPRIVETIIGETGKNTVLLDNTEILFDPVLQQDPLRLLQQVSRNRTIVAAWNGKFEGGALVYAEPDHPEYRKYYEVDALICPLE

SEQ ID NO: 5996 - protein, 161 aa, Tepidanaerobacter acetatoxydans
MGLTDEITNALMIFSHKFYQLLLIAGDDSHKKSLLLKQIAESGNYAYVNLNLALSERLMMIPSHEHSLFVNQCIDEIINGISAETVIFDHIEILFEKPLNTDPMVLLKNISRHRKLISDWPGIIKDDILIYAKPGHREYVKYPVEVDYTIIDIDQNYKASF

SEQ ID NO: 5997 - protein, 161 aa, Tepidanaerobacter acetatoxydans; identical to SEQ ID NO: 5996

SEQ ID NO: 5998 - protein, 158 aa, Thermanaerovibrio acidaminovorans
MAEPLADQVLRKIGEARELYHRLILMVGPAGSGKTSALQEVSASTSAPLVNVNLELSRRMLDLTERQRALQLPRLLGEIVGEATGELVLLDNIEILFDVHLKQDPLRLLQGLSRNKTVVAAWNGSIVDGHMTYAVPDHPEYRRYPIRDFLVASPEVTT

SEQ ID NO: 5999 - protein, 158 aa, Thermoanaerobacter brockii
MSIYKDIQDAFILLPYKYYKLILLVGPIGSGKTQILKKISSDYNYDYINLNLKLSEKLINIPFEERCYYVDDFMEEILFQSKTDVTILDNIEILFSNHLKIDPLKLLKNISRYRKIIASWGGIYVNGILTYAEIGHSEHRKYKKNDLDVIVISIEGGR

SEQ ID NO: 6000 - protein, 158 aa, Thermoanaerobacter italicus
MSIYKDIQDAFILLPSKYYKLILLVGPIGSGKTQILKKISSDYNYDYINLNLKLSEKLINIPFEERCYYVDDFMEEILSQSKTDVTILDNIEILFAPHLKIDPLKMLKNMSKYKKIITSWGGSYINGILTYAEPGYPEYRRYKKDDLDIIVINVEGGR

SEQ ID NO: 6001 - protein, 158 aa, Thermoanaerobacter pseudethanolicus; identical to SEQ ID NO: 5999

SEQ ID NO: 6002 - protein, 156 aa, Thermoanaerobacterium saccharolyticum
MLLCENIRDALAILQNEYHKLILVLTLLDDKAEVVEKISNKYAYDVLNVNLRLSEKLISVPISERWLHVDEFFSRLLNDYKTDVIVLNSIEMLFETHLKVDPLRLLKSVSRYRKIIAIWTGDYTDGVLTYAEPSHPEYRRYKNDDLDFIMVRSNCI

SEQ ID NO: 6003 - protein, 156 aa, Thermoanaerobacterium thermosaccharolyticum
MLLCENIRDALAILPNEYHKLILVLTQLDDKAEVVEKIFNKYVYDVLNVNLRLSEKLISVPISERWRYVDEYFKKLLNEYKTDVIVLNNIEMLFEPHLKVDPLRLLKSASRYRKIIVIWTGDYTGGALTYAEPSHPEYRKYKNDDLDFIMIRSNCI

SEQ ID NO: 6004 - protein, 156 aa, Thermoanaerobacterium xylanolyticum
MLLCENIRDALAILSNEYHKLIIVLTQLDDKAEAVEKISNKYAYDVLNVNLRLSEKLISVPISERWIYVDEYFKKLLNDYKTDVIVLNNIEILFEPHLKVDPLRLLKSVSRYRKIIAIWTGNYTDGVLTYAEPSHPEYRRYKNDDLDFIMVCSNCI

SEQ ID NO: 6005 - protein, 161 aa, planctomycete KSU-1
MSEQIIKGIEQVTGLYYRLILVVAPSGKGKTLALQEVRKRLALPLLNVNIELSRCLLDLTEKQRAIHASTILRDIIEKHNERVILLDNTELLFDVSLKLDPLRLLQGISRNKTIAASWNGKIENGYLIYAEPNHPEYRRYPVKDFLVVSPEEDYLPISNKI

SEQ ID NO: 6006 - protein, 146 aa, Bacillus cereus
MDFHLLKNEIENMSSWWHKLIFVCNVESIVDEIVSLNSDIEVLNVNLIISESLVSVSKNKYPLYVEDVMQYKINNPSKIYLLQYIDILFDPVLQINPIRLLENISKRNNLIVIWPGVYKKGQLIYAENGHPEYYSNSNFEGKAITN

SEQ ID NO: 6007 - protein, 140 aa, Lachnospiraceae bacterium
MGIIISRKKFSSMNCEGLLKPIIYCSNYEDITCLALSLNKELAQGLALFGHKQRTMQIEKCFAKILAKFPDNVVLKDFDVLFNPDYKIDVLKIMINTCKVKPFSIIWPGILDGRRLIYAEEGFQDYKTYDVDAYDITCIV

SEQ ID NO: 6008 - protein, 148 aa, Enterococcus faecium
MDDIWMFISHLKKQYQKLGVVVSSQDKEINMDRVEFVNLNLPLSELLLKKSRRSWYLTASDFIKGIIEQSSEEVVLFDNFELIMNPELGVNFMDLLLELSKIKVVLIAWHYDIEGTTLIYAQPGHKEYRRIEMREDQLFFWIGEENAV

SEQ ID NO: 6009 - protein, 153 aa, Caloramator australicus
MFEETLLQKLNNINQNYYKLILIITKDFQKINSLLVNFAEKNSIPYINLNLELSKRLIYVPFNERWIYADKELKNILLKKEHDTIIVDNTEILFEEHLKLNPIEELKNISKYKNIIASVRGNYKNNILTYAKIGEKEFKKYILDDLLNNLITV

SEQ ID NO: 6010 - protein, 164 aa, Pseudoalteromonas marina
MKISNTKIENIKTDIDQAIKSGSFQSSNLILLVLNPTEIHEVIVKNVDSQFKNLSKLLSEKLVVLSLKDREQYLHSLVSDLVKEAEDICYFSRINLLFEESLQADPLKLLQHAAKKKPIIVIWPGSLDSMSLSYAKPGLPDYKSYKLNEFQDVQVITTCEQGVK

SEQ ID NO: 6011 - protein, 152 aa, Desulfotomaculum nigrificans
MSDNHVYTIKKELAQIRYRRHQLIIICGINGLKVLRDITSEFNIPCVNLNLRLSEELLEVPVNRRSRKVSQLVDKIINQTAGDVICLEHIELLFHPQLQQDPMRILENISRNKVILVWWNGDYKNGSLTYAEPGHPEYRLYNRLEASVIVVN

SEQ ID NO: 6012 - protein, 167 aa, Dethiosulfovibrio peptidovorans
MVDPIENQVIRLLEAAEDLYHRLVLIVGKSGSGKTSVVQNLAKLYDVEPININLCLSKELLELTGKQRQLRLGRILAQTVNGNGDKVFLDNIEILFDVELKQDPLRLLQGISRNLTVVASWNGTFEKGKLIYAEPGHREYRSYDLTDTLVVSVSGEATLNLKKTKRG

SEQ ID NO: 6013 - protein, 151 aa, Kingella denitrificans
MIAKLERLIGEIGDLNSKLILLVGPSRSGKTQLLRQLSAKLNIEPLNVGLELGRRLAATPNNKRGFSAGELLREIADKERTEDPLLLDNLELLFEPGLQINPLDLVRRLAHFKRVVAVWPGELRGDRLVYADMSHPEHRDYSRDGVVVLEI

SEQ ID NO: 6014 - protein, 156 aa, Alcanivorax hongdengensis
MLEKLGKIVDEIAALQTKLILLVGESGSGKTALLAKMADSRGGQVLNAGVLLGKRLAALPHRQRPLKVNEELKALADDYVCDKDLVLLDNIELLFDQSLKLDPLELLKRHAHSRRIVAVWPGELLEGRLSYAVMGHPEYQDYGLDGLVPFEINKNS

SEQ ID NO: 6015 - protein, 150 aa, Bacillus cereus
MNNHLLEQIKNGILDVSRRYFKQVYVYDYKNGNSVKKFAENHSLPYINVNIEMSQLIRDVPINSRTYRIAEAFQQLIDKDQNDVICLDYYELLFEPSLAIDPLLLIKNSSRNKTLIISWRGTISGNTFIYAEPGHPEYKKYRVQDALIIT

SEQ ID NO: 6016 - protein, 165 aa, Nitrosococcus oceani; identical to SEQ ID NO: 5990

SEQ ID NO: 6017 - protein, 180 aa, Thermoplasmatales archaeon
MRNLFDYNKGIIPFILCPLGEAMVDIDTLIKENRTNHYKLLTIVGNNKAKINSLIIYLKERNWAAYDVEKIVLELIETIPEDKIKLRIGTELKKWIKNTEDNVILYNANILYSPEMDKIGPFSAFKYNMRGKKEGILFMDGKIRGDVVVYSIPGRPDYHERELSDVLSIELEKVDLPEVK

SEQ ID NO: 6018 - protein, 160 aa, Pseudomonas sp.
MEVVEELEKLLADVPALHNQLILLIGPPGSGKTAALLGLAKRLGGSNSDVMLLNVGSALGTRLATVPGKARSLEATHLLREMADEHSRNSVLLLDNIELLFDRHLRLDPLDLLKRQAQSRPVVAAWSGALHDGRLTYAHMGHPEYQDYAAIGLVHLQIDA

SEQ ID NO: 6019 - protein, 146 aa, Bacillus cereus
MDFHLLKNEIENMSSWWHKLIFVCNVESIVDEIVSLSSDIEVLNVNLILSESLVTVSKNKYPLYVEEVMQHKINNPSKIYLLQYIDILFDPVLQMNPIRLLENISKRNNLIVIWPGAYKNGQLIYAENGHPEYYSNSNFEGKAITN

SEQ ID NO: 6020 - protein, 147 aa, Treponema primitia
MGTIIKISSFTKEILAKTNIPVVFCSPSPVTERLLHESKHRQVSLNLPLAKALTAQDENSRLLHVTDEVLKIVPSGGAPVYLTDYEMLFDPRYRLDVLRLFCDISRKVKLAVHWPGTFESNTLYYAEPGCPDYHTFNIQNFDILCVA

SEQ ID NO: 6021 - protein, 146 aa, Bacillus methanolicus
MSIHLIESELQLFDTRWYKIIYVCGSVNHEKQYSSALNIPYININLRLSEKLQNIPKSNYPLQVGDMLNETFSQYHDSILWLGNIEILFDKQLQQHPVRLLEHLSKRFKLIVSWPGEFDGKALIYATPEHPEYFKCSELEGKIVIV

SEQ ID NO: 6022 - protein, 169 aa, Vibrio scophthalmi
MSTSITSFRLTDQLLQHVQNACLEAEYRSFKLILVIIPKELHREIEVEVLNNSIRLVNLSKELARKLISLSIMDRVKLLEVEVDKIANDCGSSVWLTKLDVLFEPSLENDPMMLLKMVTKSHAVVAIWPGEITETSVVYSKPGKSDYKTYLLKELNDIQVIDACNGVVK

SEQ ID NO: 6023 - protein, 156 aa, Thiorhodovibrio sp.
MPTTEATAAQILEALATAESLYYRLVLLVGSLGAGKSGVLRQVAQQLDRPVINLNLTLSRTLLELTPKQRSLRLLATLNTIAAEQTSPVLLDNTELLFDPSLAQDPLRVLQHMARNRSLLATWNGQYTSGQLIYAQPGHPEYRSYDAVDTLIVSLE

SEQ ID NO: 6024 - protein, 155 aa, Ectothiorhodospira sp.
MLEQLEQRINEVSALQTKLVLLIGHPGSGKSALLGALAKQHGIRVMNVGAALGRQLAAISQRQRALQANVVLRDLADEHAEGDLLLLDNLELLFDRSLKLDPLDLLKRHAHGRRVVAVWPGELREGRLVYAEMGHPEYQDYGLDGLVPFEIESLG

SEQ ID NO: 6025 - protein, 158 aa, Clostridium papyrosolvens
MAFINEVKKMSNSMLDKYYKLILLIGKNGSGKTSLINELCAANTYSYINLNLALSEKLKDVPIGDRCYCVQDFIDEIIRNASGDFIVLDNIELIFSKHLQLEPLGVLKNIAKYRKTIVAWQGSITNGYLTYAEPTHEDYVKYKMDELECLYINLERGL

SEQ ID NO: 6026 - protein, 158 aa, Thermoanaerobacter ethanolicus
MSIYKDIQDAFILLPYKYYKLILLVGPIGSGKTQILKKISSDYNYDYINLNLKLSEKLINIPFEERCYYVDDFMEEILSQSKTDVTILDNIEILFAPHLKIDPLKMLKNMSKYKKIITSWGGSYINGILTYAEPGYPEYRRYKKDDLDIIVINIEGGR

SEQ ID NO: 6027 - protein, 158 aa, Thermoanaerobacter ethanolicus; identical to SEQ ID NO: 5999

SEQ ID NO: 6028 - protein, 155 aa, Nitrococcus mobilis
MLTRLDRLVDEIAALHSKLILLVGPDGCGKTKLLGELANRRAAKVMNVGAELGKRLAALPQRQRPLHANVAMRELADEYASGDLLLLDNIELLFDQSLRLDPLDLLKRHAHTRRVVAAWPGQLREGRLSYAEIGHPEYQDYGLDGLIPFEIETAG

SEQ ID NO: 6029 - DNA, 639 bp, Planctomyces limnophilus
ttgagaaatctccgaaccgtttatgaacaggactcaggcaaaggagccgccacgattgacacatcagctcggacacagattccgttgtccgttctcgactatttgctcactgcccagttcgccatcgcttgggcaggagaaggcggggaagaatcccggcttgactggtggcgtactgacctccagagtgagtttggtggggaagatctttttcgtcgcttgctaccacatacttgggagtgggccatctttcaaagtgtgcgcgaagcagcacggaggagagacgccgatctgcgtgggcacgctcacgacgccgaagaaattatctcacttttttatttgggatttgatgtagatgagcgtgtcgatgatcgacttgccgacctcaaacgccgtcaggtcactccgacgatcgctctccctggattgaaggaaatcgtttccgaaagttggaatccagagcaatttgtggagtggcttgaaggacaccatcctgctgaattcacgaatgttccggcgggccgccgtttgaaagggaaacagccggattcgcttgaactgacggtttccaacttgatttccgcattcaacccgctgtcggattcctatccattgccacactatcggaggtcgagttga

SEQ ID NO: 6030 - DNA, 579 bp, Anaeromyxobacter dehalogenans
gtgtcggcccccgtcaccgtctcgaccgtcgattccatcctcgccgtccagctcacggtcgcctgggctggcgagtcgcgagagacgacgaaacgcctcggctggtggcacaccgacctcatcgactccacgggaggcggcgacttcctggcgcgcctgctccctcgaacgcacgcgtggtcctccctcgaggcagtgcgtgaagcggcccgccgcaccgacgaggcggcccggcgggggatggcggatccggatcaggttcggacgctctacttcctcggtttcgacctcgatgagcggctcgcggaacggctcgcggagctgaagcgcggtggccagccgcccgcatcggcgctctcgttcctcgtcgcgctcgacgccccgttctcgagcgagaagctcacggaagcgctggcattcggcgctgggcgtgcgccggcctacgacgttgtgcccggcggtcggcaactcaagggcacggtgccgtctgcccccgagctgctcgtccagaacctcgccgccgcgctgctcccgctggccgagcgctacccgacgccgttctaccgggtgaggccgtga

SEQ ID NO: 6031 - DNA, 606 bp, Haliangium ochraceum
gtgaccactcctgatacacccgataccaccgagcgcccgcgcgcctacgctgacagcgacatcgaccgcattctgagcgcgcagctcgtggtcgcgtgggccggcgaggctggcgaggaacgccgcttgggctggtggcgcacggatctcgtcgccgagttcggcggccacgatctcttccagcgcctgctgccgcacacctgggactgggccgcgctggagggcgtgcgcgaggccgcgcgccgccgcgatgccgagttgcgcgcccgcgccagcgaccccgacgccatcgtctcgctgttccacctcagcttcgcgctcgacgagcgcacgggcgaccgtctgcgcgcgttcaagcgccgcggcaacgcgcccaacctggccttgcccgcgctcgacgggctcatcgccgagcactgggacgccgacgccttccgcgactgggccgcgtcccagtccaccgccgcgcactccgccgcgcccaccggccggctgctcaagggcgcgccgcccgacgacgtcggcgccctggtcggcgcgctggtcgccgcgctcgtcccgctgtccgagaactacccgctgccgcactaccggagcacgcggtga

SEQ ID NO: 6032 - DNA, 606 bp, Haliangium ochraceum
gtgaccactcctgatacacccgataccaccgagcgcccgcgcgcctacgctgacagcgacatcgaccgcatcctgagcgcgcagctcgtggtcgcgtgggcgggcgaggccggcgaggagcgccgcctgggctggtggcgcacggatctcgtggccgagtttggcggccacgatctcttccagcgcctgctgccgcacacctgggactgggccgcgctggagggcgtgcgcgaggccgcgcgccgccgcgatgccgagctgcgcgcccgcgccagcgaccccgacgccatcgtctcgctgttccacctcagcttcacgctcgacgagcgcacgggcgaccgcctgcgcgcgttcaagcgcgccggcatcgcgcccaacctggccttgcccgcgctcgacgggctcatcgccgagcactgggacgccgacgccttccgcgactgggccgcgtcccaatccaccgccgcccactccgccgcgcccaccggtcggctgctcaagggcgcgccgcccgacgacatcgacgccctggtcggttctctggtggccgcgctcgtcccgctgtccgaaaactacccgctgccccactaccggagcccgcggtga

SEQ ID NO: 6033 - DNA, 666 bp, Rhodopirellula sp.
atgctacctgaacttttaggtcaacatgcggggcgaggtgatttttcgatgagcgaagcgaatgcaacgacagaaactgttctttcgtcggcaccgcttgcgcgagagatcgatgcgttgctgacggctcaattgatcgttgcttgggcgggtgaatccgggaccagtgatgatttaacgacgaagcgattgggatggtggcggaccaatctggttggtgacggcgctgaatacgagcttcaagagttgttaccgaacacgtggcgctgggtcatgttccaatccgtacgcgaagccgctcgtttgcatgacgcggcggttcgctcgaaagaccacgatcctgaccgtctattgacgctcttttccttgggcttcgcgattgacgagaaggttgaagacaggcttcggcaattgaagcttgctgccacggatcctcgagaagcactcccgcaattgggcgaagcaatcgctgacggatggaacaaaaacgcatttgcgagttggaccagttcgttcggtaaagaatcgtttactgacgtgcccgctgggcgacgtttgaagggcaagccacctcagaaccttggcgaactgaccagccgtctggtcgcaggtctgtcaccgatcgctggcagttacccgatgccacacttccggagggatgcatag

SEQ ID NO: 6034 - DNA, 558 bp, Pseudanabaena biceps
atgagtgttcttgcagttgatctagatttgttggatctgatcttggattggcaaatgacgatcgcatgggcaggagaagcaaactgtgagccatcacggttaggttggtggcgcactgatttaattgatgatctgggtggcggcgatctattggctcggttgctgccacgcaccaaggtgtatgcaggatgggagtctgctcgatcagccgcgatcgctacggatcggcgggctaggcaaagaatggctaatcctgataaattgcgaacgattttcttttggggatttgacttagatgagaaattacacgatcgccttgcagcaagaaaacgactgagtgaaaatctgaaattgccgatcgcttgggaagacggctttgatcgtgaggcgatcgccaagcaagttagtgatcgctgtggtgagagtaaatatgagcttgtggctggggggcgcgaaattagaaggtctgattctgaccagcaaaatctcttatttctagttgcggcgcttgtcccgtttgatcaaaattattcaatgccgttttatctgattgcttag

SEQ ID NO: 6035 - protein, 221 aa, Rhodopirellula sp.
MLPELLGQHAGRGDFSMSEANATTETVLSSAPLAREIDALLTAQLIVAWAGESGTSDDLTTKRLGWWRTNLVGDGAEYELQELLPNTWRWVMFQSVREAARLHDAAVRSKDHDPDRLLTLFSLGFAIDEKVEDRLRQLKLAATDPREALPQLGEAIADGWNKNAFASWTSSFGKESFTDVPAGRRLKGKPPQNLGELTSRLVAGLSPIAGSYPMPHFRRDA

SEQ ID NO: 6036 - protein, 185 aa, Pseudanabaena biceps
MSVLAVDLDLLDLILDWQMTIAWAGEANCEPSRLGWWRTDLIDDLGGGDLLARLLPRTKVYAGWESARSAAIATDRRARQRMANPDKLRTIFFWGFDLDEKLHDRLAARKRLSENLKLPIAWEDGFDREAIAKQVSDRCGESKYELVAGGREIRRSDSDQQNLLFLVAALVPFDQNYSMPFYLIA

SEQ ID NO: 6037 - protein, 212 aa, Planctomyces limnophilus
MRNLRTVYEQDSGKGAATIDTSARTQIPLSVLDYLLTAQFAIAWAGEGGEESRLDWWRTDLQSEFGGEDLFRRLLPHTWEWAIFQSVREAARRRDADLRGHAHDAEEIISLFYLGFDVDERVDDRLADLKRRQVTPTIALPGLKEIVSESWNPEQFVEWLEGHHPAEFTNVPAGRRLKGKQPDSLELTVSNLISAFNPLSDSYPLPHYRRSS

SEQ ID NO: 6038 - protein, 192 aa, Anaeromyxobacter dehalogenans
MSAPVTVSTVDSILAVQLTVAWAGESRETTKRLGWWHTDLIDSTGGGDFLARLLPRTHAWSSLEAVREAARRTDEAARRGMADPDQVRTLYFLGFDLDERLAERLAELKRGGQPPASALSFLVALDAPFSSEKLTEALAFGAGRAPAYDVVPGGRQLKGTVPSAPELLVQNLAAALLPLAERYPTPFYRVRP

SEQ ID NO: 6039 - protein, 201 aa, Haliangium ochraceum
MTTPDTPDTTERPRAYADSDIDRILSAQLVVAWAGEAGEERRLGWWRTDLVAEFGGHDLFQRLLPHTWDWAALEGVREAARRRDAELRARASDPDAIVSLFHLSFALDERTGDRLRAFKRRGNAPNLALPALDGLIAEHWDADAFRDWAASQSTAAHSAAPTGRLLKGAPPDDVGALVGALVAALVPLSENYPLPHYRSTR

SEQ ID NO: 6040 - protein, 201 aa, Haliangium ochraceum
MTTPDTPDTTERPRAYADSDIDRILSAQLVVAWAGEAGEERRLGWWRTDLVAEFGGHDLFQRLLPHTWDWAALEGVREAARRRDAELRARASDPDAIVSLFHLSFTLDERTGDRLRAFKRAGIAPNLALPALDGLIAEHWDADAFRDWAASQSTAAHSAAPTGRLLKGAPPDDIDALVGSLVAALVPLSENYPLPHYRSPR

SEQ ID NO: 6041 - DNA, 1710 bp, Planctomyces brasiliensis; identical to SEQ ID NO: 207

SEQ ID NO: 6042 - DNA, 4203 bp, Burkholderia thailandensis; identical to SEQ ID NO: 208

SEQ ID NO: 6043 - DNA, 4242 bp, Candidatus Accumulibacter; identical to SEQ ID NO: 209

SEQ ID NO: 6044 - DNA, 4089 bp, Corallococcus coralloides; identical to SEQ ID NO: 210

SEQ ID NO: 6045 - DNA, 4008 bp, Corynebacterium variabile; identical to SEQ ID NO: 211

SEQ ID NO: 6046 - DNA, 4221 bp, Frankia sp.; identical to SEQ ID NO: 212

SEQ ID NO: 6047 - DNA, 4752 bp, Frankia sp.; identical to SEQ ID NO: 213

SEQ ID NO: 6048 - DNA, 4242 bp, Haliangium ochraceum; identical to SEQ ID NO: 214

SEQ ID NO: 6049 - DNA, 4254 bp, Microlunatus phosphovorus; identical to SEQ ID NO: 215

SEQ ID NO: 6050 - DNA, 4110 bp, Micromonospora aurantiaca; identical to SEQ ID NO: 216

SEQ ID NO: 6051 - DNA, 4218 bp, Mycobacterium gilvum; identical to SEQ ID NO: 217

SEQ ID NO: 6052 - DNA, 4485 bp, Nocardia cyriacigeorgica; identical to SEQ ID NO: 218

SEQ ID NO: 6053 - DNA, 4284 bp, Polaromonas naphthalenivorans; identical to SEQ ID NO: 219

SEQ ID NO: 6054 - DNA, 4227 bp, Saccharomonospora viridis; identical to SEQ ID NO: 220

SEQ ID NO: 6055 - DNA, 3927 bp, Saccharopolyspora erythraea; identical to SEQ ID NO: 221

SEQ ID NO: 6056 - DNA, 4203 bp, Saccharothrix espanaensis; identical to SEQ ID NO: 222

SEQ ID NO: 6057 - DNA, 4242 bp, Singulisphaera acidiphila; identical to SEQ ID NO: 223

SEQ ID NO: 6058 - DNA, 4434 bp, Sorangium cellulosum; identical to SEQ ID NO: 224

SEQ ID NO: 6059 - DNA, 5421 bp, Sorangium cellulosum; identical to SEQ ID NO: 225

SEQ ID NO: 6060 - DNA, 5517 bp, Sorangium cellulosum; identical to SEQ ID NO: 226

SEQ ID NO: 6061 - DNA, 4674 bp, Streptomyces coelicolor; identical to SEQ ID NO: 227

SEQ ID NO: 6062 - DNA, 4677 bp, Streptomyces griseus; identical to SEQ ID NO: 228

SEQ ID NO: 6063 - DNA, 4266 bp, Thermobifida fusca; identical to SEQ ID NO: 229

SEQ ID NO: 6064 - DNA, 4164 bp, Thermobispora bispora; identical to SEQ ID NO: 230

SEQ ID NO: 6065 - DNA, 4158 bp, Hahella chejuensis; identical to SEQ ID NO: 231

SEQ ID NO: 6066 - DNA, 4350 bp, Saccharomonospora glauca; identical to SEQ ID NO: 590

SEQ ID NO: 6067 - DNA, 4140 bp, Rhodococcus triatomae; identical to SEQ ID NO: 591

SEQ ID NO: 6068 - DNA, 4350 bp, Saccharomonospora cyanea; identical to SEQ ID NO: 592

SEQ ID NO: 6069 - DNA, 4167 bp, Gordonia polyisoprenivorans; identical to SEQ ID NO: 593

SEQ ID NO: 6070 - DNA, 4359 bp, Amycolatopsis azurea; identical to SEQ ID NO: 594

SEQ ID NO: 6071 - DNA, 4182 bp, Marinobacter sp.; identical to SEQ ID NO: 595

SEQ ID NO: 6072 - DNA, 3855 bp, Saccharopolyspora erythraea; identical to SEQ ID NO: 596

SEQ ID NO: 6073 - DNA, 4713 bp, Streptomyces turgidiscabies; identical to SEQ ID NO: 597

SEQ ID NO: 6074 - DNA, 4173 bp, Gemmata obscuriglobus; identical to SEQ ID NO: 598

SEQ ID NO: 6075 - DNA, 4242 bp, Rhodococcus ruber; identical to SEQ ID NO: 599

SEQ ID NO: 6076 - DNA, 4185 bp, Mycobacterium xenopi; identical to SEQ ID NO: 600

SEQ ID NO: 6077 - DNA, 4188 bp, Micromonospora sp.; identical to SEQ ID NO: 601

SEQ ID NO: 6078 - DNA, 4401 bp, Saccharomonospora xinjiangensis; identical to SEQ ID NO: 602

SEQ ID NO: 6079 - DNA, 4269 bp, Bradyrhizobium sp.; identical to SEQ ID NO: 603

SEQ ID NO: 6080 - DNA, 4203 bp, Burkholderia thailandensis; identical to SEQ ID NO: 208

SEQ ID NO: 6081 - DNA, 4218 bp, Planctomyces maris; identical to SEQ ID NO: 605

SEQ ID NO: 6082 - DNA, 4674 bp, Streptomyces gancidicus; identical to SEQ ID NO: 606

SEQ ID NO: 6083 - DNA, 4110 bp, Gordonia amicalis; identical to SEQ ID NO: 607

SEQ ID NO: 6084 - DNA, 4158 bp, Mycobacterium intracellulare; identical to SEQ ID NO: 608

SEQ ID NO: 6085 - DNA, 4149 bp, Phaeospirillum molischianum; identical to SEQ ID NO: 609

SEQ ID NO: 6086 - DNA, 624 bp, Nitrococcus mobilis; identical to SEQ ID NO: 610

SEQ ID NO: 6087 - DNA, 3852 bp, Nitrococcus mobilis; identical to SEQ ID NO: 611

SEQ ID NO: 6088 - DNA, 4827 bp, Frankia sp.; identical to SEQ ID NO: 612

SEQ ID NO: 6089 - DNA, 4182 bp, Pseudomonas stutzeri; identical to SEQ ID NO: 613

SEQ ID NO: 6090 - protein, 569 aa, Planctomyces brasiliensis
MTEDEKDLIADLLVKWEDAFDQGREILAEELCTDCPHLTQTVRSKIESLKTTAWTKRDPARPLDEAEVARDDTGTVLADRYRLEQLLGSGGYGQVYRASDTKLHRQVAVKIGHHRTSSDLLLDEARRVARCPKHPGIVSVHDCGEHEGRVFLVFEYVAGRSLAEVVRTKRPSTSEAVQLVATVAESLSAAHKLGLVHRDLKPENILLDEAGNPLIADFGVACTLDEAAKGRAGTSGTLPYQSPEILSGDMQLLDGRCDIHSLGVVLYELLSGKTPFPAKDKTELREQILFRQPTPLREVNKSVPEELDAICMKAMAKHPGGRFETVDDFAAALRNWLDNSVSHRRWLRFVGLAVALCIIVLTAIWYLTRPNPESLIQDGLLHFDGRTRIVTNVDRTLPVTLEVWVRPDPYIDENCQFIIGSDISGKYGLGLAICGSMLSVEYVRGMVNSSAAVPPNRWSHLAAVFTENETRLYLDGKLVQTAPGSKPGGETRFVIGNVGQNNLISFFKGQMRSVRISEGERYSGEFEPPSEFASEESPLLLISKPRIEGNSIRTASGTVVGTVEYVKEH

SEQ ID NO: 6091 - protein, 1400 aa, Burkholderia thailandensis
MSGRWKAISPSQFPWEQDALDFVQRALPNREPFRAYSNFEFVADDGSINEVDLLVISRYSIFLVEIKSRPGEVGGDSHTWIWRDGGREYFDDNPLLLTNRKAKKLASLLRKQLTLQKRRTPYIQSLVFLSDPAQRCKLTGPARENVQLRADIVGKLFDETAPVTSAQPIDRDLATSINRALEIVGIRPPQQSRRVGDYQLEQVLAETDFHQDWLAKHVSLNNLWRRVRLYTAKRTLSAAQRAVLVDAARREFQLLEGIRHPGILRALDFIDSEHGPALIFEYEEGLQRLDHFIRAQGDQLDLWQRLKLVRAIAEALDAAHRYRLYHRGLSPHTIMVRTVGTNSFDVTLFDWQIATRQLQEAESETTGTLHVEMLSDRVAQEIYLAPEARNAPRPDAIKLDVFSLGAISYFVLAGEPPAVSGDELVIKCEQGPGLTLSAMVNGCLAEIEDLIQFATWPSPDDRFSSTNEFLSALDKAEEALEDALTAPASPLASPLDANTGNELNGFEVLRRLGKGGTSLALEVRRKSAGQPRQGVFKIALEPEYNNRLKQEAETLVRLQPHQNIVQCFERFEIAGLATLFLSSAGEETLGERLRQEGRLGLDLLQRFGEELISVVEYLEREGVPHRDIKPDNIGIRPGAGKRLTLTLFDFSLAGVPATDLNAGTRVYMDPFLRKRGMWDGYAERYSCALTLHEMATGTLPEWGDGSADPVTLKSEIVLDSERFDASIRKQALDFFSRALARDHRKRFDNAEQMLRQWRRVFENVSRPVTTHTTQLPQSQLPLGEESPAGGITPGTPLESLELDSRHLELLDRIGRDELATAGDLADLPRNRLYRHRGIALAVARELHQIADRLRHQFSGGAAKDDEPADTTVAKLSVDAAAALLIPKKGDESQLEVLEKWLGLSAQPGTSLLQEDVLQSMVERMSRQPEITHLRDDVALVLAGLGGIATVGEIAAALLARRGSVQTGAARRSEAEAVTRAVITVERTKQAARWQLVKRAANVRPLVEPPQVDDLVVATLASSGAAGLFPSAPEVRASYAVALGEAADRLAQQDPLPSSQQVADTLARIPPPAGDLGLSSERLIRLAAACAQQAALSSRLEFYPVQLSAARAVKLATNSLLGLRQFDLQTIGRRIFARYPEAAPLPGPTELEQLLEDAGLEVKWDGAKCAFVTHYSAGIISSTTQIGRFGTNNRPRTATAPDVQAAQQIDERIKHALSSGKLLTLSVDPKGLAIAQHELAQRFGLKVIDFDDLVLTQFEAQAKEWDIDWNTLLAADAAPAGSVDSHNFATVLGEVWPKVEAQLLQDDQPGLLVNLGLAARWQKMPLFAKLADACMFGKRPPLIALLASPLTPDNRPVLDGEAVPVTINTTDYGRIPRAWLENAHRKHDITASTTSTKSKLI

SEQ ID NO: 6092 - protein, 1413 aa, Candidatus Accumulibacter
MKDPRWTAISESNFAWEKAALDWLRDRLSDRDPWHVWSNFEFIDDEGKVNEVDALVLSPVGIFLVEVKSRPGVLTGDAHTWTWRTDGRDYAYDNPLILANRKAKRLATLLRRQSSVIKARSRVPFIEPLIFLSAINADAFRLSGNGRSGAFLKGRPDTSNDDGIIARLEGTGNYPPTGPLLGHELGRVVCRAVVEAGVRPSNKHRRIADYQLGALIQEGENYQDWAGEHVSAGVRRRVRIYGYALASTVDARQSLVRQATREFQILEGVDHPGILKVRDFKESELGPALLFDYNPQGRRLDFLLREQGNQLNADQRLSILRQLAETLKYAHQKKLIHRALSPQSILVQNQDGAPLKLAIMNWQLAARGGQGTEQSNLTALGASAGTLARTVGTRHVENYLEDPARVFLAPEALWDGAPTGPHLDVFSLGAIAWQVFTGAPPATSASELQQKLRAGNGLRISDVLDGAGRALQDLIQFSTCPDVSARLGSVTDFLEYLELVEDELTAPAELATVDPASAKSGDPIDGGFTVVRRLGKGSSSDVLLVTRRGNAEELVLKVALDASHNRRLLAEGEALRKLRHANIVEWRETLTVAGRTALLMSSAGKDTLAHLLRNNRPSLDLVRRFGEELLQTVVYLENEGIYHRDIKPDNIGLCPSSHSGRLQLVLFDFSLSKASVDNIQAGTRPYLDPFLSLRKPPRWDIYAERFAAAMTLYEMLTGTLPGWGDGVSDPAVIEPEVTLDVTLFDPNLREASAAFFGKALRRDFRERFDNAEDMLRDWRKIFDQADTQTAADPFEVIALRATRETAIGELDYSVEAQNVLDRMGIHSVRELLAVDRVRFRYLKSVGDKVRKEIRGTAKRLAQIRPDLVAGTPTVLDTDAGKSGIRSLDELANHLFPKRAAADERPDDDALAIYLGLETAETGTENERNATLWPTLGDAAQAAGIARPALTHAIVASRARWIRSIAISEVREELAITLSASGGVMAVTEAASSLLASHGSIEQDDANRLRLAAAVLRAVSETEADLAQPRYQVFPGAAKGAVPLVAASVDHADYALRLGAAADSVIAADEETSAGESLPTPQQVIERLEAVDRPHTVAAVSTQRLVKLAAGCSQRAAVSSRLELYPLAMAAQRAIRIAMGSLIGPRVLTESQVRERIMGRYPDAEPLPGRPSLDSLLGAAGSDLVWRHDGEDGPGYYSAHRGFGPSAGTTTFLHRPDTVADDDQSEEVLAARQFDDRLKHAIKSGGFLVLTAAPRLARHAEAALRRTIAGADFLPISLDRIVLESLKEEALQRKVGWSKVLEADIGGPGSRDWSNLIRLASFARARIRGKLTAQGKSLLLLDPGLLARLDLLDLISDLQSMAGRADGILSVWMLAPMAGQGMPTLDGVPIPVITQAQWARVPDRWPGHSSRTAA

SEQ ID NO: 6093 - protein, 1362 aa, Corallococcus coralloides
MAAKFIQIGEPAHDAERQALRFLVEGLPESFTVYGNAWLVERSGVVYELDTVVVAPHAIFVVEIKSYRGRIEGTDNDWWLPEKIRSPLKLNRITSQVLKSHLKNASYQAGQVWTEGLVFLSATTDVGVRGPASNDRVHTRKTILAALQDPELIKRMSGGRALMPSSNAERELLELFTGAQSGPRPVRRVREYEVVETFEHHDTFTELLGKNTLSGAERVLRIYSVPPLATQTQRDRISERARWEAQVLGRLGRSEGVLTADPPFSDEAGIVLPLEHFKGITLTTWVERYGPDARGKEKAELRVRSDLWIRIAQTIDEVHRQGVVHRLLRPDVVLVEDKQEPTEVRVTGFDLAKQMTSDATISLTTIHDDRLVYAAPEVVTAFSSAEPASDQFSLGAMLALVLTGKPLFENTRQLMAQRRLMRRVRDISQRLPLSLDEAVAKMVELRATDRYATLAEAIEAVRIGRDPSPRVQALIQNVGRAQLDADNLQAGQRIGSDYEIVTRLGQGGMAVVYAARHLVSGRTRALKIARSEDAAEEALRGEYTVLTGLDHPNIVRVIDLTKMVEGRLTLVMERVSGMNLRQWFAQHPAPEPTTQRRLAEDLIAGLDYLEQKSVTHKDLKPDNLLVSDGRLTIIDFSLASMPEDAPYGGTALYRDSASARWTHATDRFAAALCLFELYAGRHAFEGRVPEPGQAPIVADDDIQPTGLAAFFRKALEPTPEKRFPSARAMREALLVALGEDTTTASSVPPPKQIDATTPLRTSGLSTRAINALARCQVHTVGQLLALPDAQVRAIHAIGTKTANDIIAFQETLRGRGLEGTESAGTLEPPLLPDLCSSPEPVQKLPLGETLRSALAAGGLPTVGAVASVTRSALLALPGIGRKRLAEVVEALYQFRAYTEGKATGGDDGAHTLDRVWELATRPLTPEQRIAVERVIGITGEPETQEQIADDLGTNQPKVSHDVSKGLERMDLSALADLTSAFDAVVDGFGGLVRLDEIGQRFESEWPAGVVTGEGIVRVIVRVTPGRAHIFEVDGAEQPIVARPIFDRDTVKAFAAEVVRLAGQWPPVEPDTARRTLAGLLPHFDGDPLALGVRICEDVEIAETGHLFIGPVDPKHSIGFVLDQAREPLQLEDLAVRVRRIFGPHTPYPDPDHLLAILRDLDCRVQGALVLPGRAGSIVAAQPLAADELPNSFGAERSPELVVRDMLKEAAGSRGFRMLVTPPEGHAEIGRSVSAALGGKWLSFDDAFFGEHSADIKSLERAERFVAQREALTEAAEQTLFNLLEEYGRPGNVIVLGDTALFGLCEALDLPRRLYDETLSGSRGFWILVVPGVIHNRQPRFNEGSAMWHLEGATLPLLHPLPG

SEQ ID NO: 6094 - protein, 1335 aa, Corynebacterium variabile
MDALVVSPAQINLIELKSWSGHFTGNEHSWHSDWNGGSSRRNPLGAANYKAKLLKSRLETVFRRILTEHRGDPDYPESFAEVPWIQECVFLHSERITTDFSSQGAQNVFGIDGHRAQTNLPGIGNRITEKVRRYQAPIDERFATNMLIPALTEITGYRRRNARADEWLLTEHLDDEEDRQVWAAENARDRKDRAVVRVIDIPRTADRIENNRLYAHAHREYELLKGLTHPNIEAPFALKIADIGAGEAPALVYRPSDGFEPLDLLYPGLVLTAAQQVELITQVADAVTYAHANNVVHRRLTPAAVLLNTAALDKDNPAGSRIEVKVSRWTAVTESVQSTRLRSALTAQTGTTAGTKNATSFDETVGFLPPEGFDGTADRTVGDLFSIGALAYFIFSGGRQPATTRADLDRVLTRSGGLDLDATDAQVEERIRDLVLGVTSPSPTTRLSTVEPKSGRRGKGTDPVKLFLDKLQDTSRDRLPDEGDALHPKVGELLDDRFTMVKQLGTGSTALGLLVQDNQADNSERVLKVARSEDVVADLEHEAESLTELSRKLAGNPQKKHFVELLEPTLRLPFNRTALLLSFGGEFTLADQLQMGPLGADQFWTHGEQLLTLLVALENTGLAHRDIKPANLGLLGKPSAKTLVLFDFSLTHKDLTATDLGTRPYLDPFLSKDATPARPHFDSYAERYSALVVLLQMATADYPRYGADDGTAAALTDGHLALTAEDFPAEWPAAQREALTDLFADNLDRDLRRRAGSAQDLLEAFRSIRRRRGTTGAAGASGATDTADATQIQEAAPVPELTVTRTPSGVTLLSLNDLSQELAAYSGAKGSHERRLVQNILGVAKDATHIDPFIPASGFAEILETSPGKMPALMAAVAPVWDQTPALRNALDALSAKLATVLRSLGGIGTPEDLRPVVEELFPSTASAVPTPGSTPGQNARRQLGVLRLLEMTLSRRADGDGRVHLIRRAGSGDAAAVALTDDAALTGLPAALAEAAQTLLETAPHEIVDATALVTALSNAAVEYLGVAPTDLQVPPSMLPRLAVAADGALALTASGDLYPVGISTESLVRAVFPTAADRVDRHTLTNKVQRRFPEAVHAKLPAHPKLTEIVTALVPDLVYDAAKKAWLRPTAEQPVSVLETRLTRHTTVGLSDRPRADLPERSRVLLDGLEATLRDRYFRVVPVATGEAAQTLDLIKTSFGARHVDIAEVVLDELWHMFEETRQTAEAFTALLDMDAADNPARPQLAQLIRVFADKALKNALATTDPAPVVLTDASILADFGCLDVLAPWMQIGADNPVPVWLITVDDSPSLTNAHAVEGVQLPLSSPGQVVGA

SEQ ID NO: 6095 - protein, 1406 aa, Frankia sp.
MDDERWTQCTPSEYAWERAALSYLKAQLPTGDPYRAWANAEFLGSDGSVNEVDLLLVLPAGIVVLEIKSWSGVLVGDAGTWRQSHRAPVDNPVIGANRKARKLKSLLVSRPAMRGRRVPWVEGAVFLSDARLEIRLVPEGRAHVFGRHDQTQLPSFLDFARQPGRVDGELSNALARAVDQAGIRPSQRARTVGSLRLELPAFQEGVGWQDFLARNQRFPDDRPRRVRIYLASGVESVHQRDQLVRAAEREYLALRGIDYPGIAAPIDFVEHDLGPALVFPHDPELIRLDHFLQEHERELSFDDRLALLRVLAETMAYAHRRVLTHRGLSPRCVWVRRRSDRFALQITDWQTASRGSESTSGIPSTTGPATSTGGYVELADDAAAAYFAPEWSWGTAKGVTLDVFGVGAIAYRIFTGKPPAASSGELSRRLSEHNRLLLAEQVDAVSEELNKLVARATEADPEQRTRDMAAFLLDLDLVRERLAAIAEEAPVVVDPLEAEAGAELEGGFSVLGRLGRGSTALALLVERDGGRAVLKVSLDRDRDPRLVAEAETLRTLSEHPGVVQLLSDGVIDVGPRRALLITSAGERTLAQELRERGRLQPEWLQGWGDDLLEIVQHLQRAGLAHRDIKPDNLGVAERGGRGKKRQLVLFDFSLAKEPLEAIEAGTRPYLDPFLGRGERRRWDQAAERYAAAVTLYEMATARRPEYGTHGGHPSFVDADVAIEPELFDRSYATGLTEFFRRALHRDVRQRFDTAEDMRRAWNAILAEPASVVPQPPSARISRDTPIGAAGLSRPVLSVFERLSIDTVGGALDLSPAQVVWLPGIGTKTRQQLRADLDRLAGQVTSSPAERPTEPTLLDRVAAGLIPRATDRAVAEALLGLGEQGGNAWTSVRDAAKALDREQRTVRQAVARFERHWLALDGMRELRDTIVKVVESVGGVASARHCAAALLDFQGSTVEEPLRSRLAEAVVRAAIDAELADDSPRDDTTHDTTHDASGGSEMGGDPRLVYSREPNGILVAAGPARAGDGPSTADRLDWASRLGGAADDLAGADPLPAPARVIETLRAVRAPGDTDPSLIFPERLLDVAMIASENAAVTPRLEVYPRGLDAGRALRLAAGALYGRTELTPEQVAERIIVRFPHAGALPGRPELDALLDAAGVPLCWDDEKKRYVTRRIEVTGLTSLVTSRGTRPRWSTGAGAAWTTMGWRRVSDEVLAADDRLTRSLVDGGWLVLSVPPRRLARAERCLAAQDVTVVDAEQALLAGMREFCAQHRVQWSIVLAADAADRSSRDWANLSRVAQAGLAGVRASIEAAGPAVLITNAGVVARYDPALVVLDELRASVRMTTETSPVRTVWLLVPWADVDKQPLLDGGAPVPQFGNQGLALSEEWIVRHESRLADGAEGGAA

SEQ ID NO: 6096 - protein, 1583 aa, Frankia sp.
MREGEGRWETVTPSQFPHEREALEQVRKLLPDAEPYRAWSNFTFTATTGHIREVDLLVVARGGVYLIEIKSLAGRLTASGSNWTQHRSSGEPRIFDNPLHLANQKSKELRSLLENAARTPGQSRVRIPFIQPAVFLSNPTLRVEFPDHQLHWIFGPEQAAAQAGQSSGAAAAPKARPGGGVTLPSIWSGLLDAPLRDERYRVTPEVSKALAKLLPAAGIARSRRHQRVGSWQLEFPAFDSGPTWQDYHAAHTQVASERRRVRIYLVERAAGEAERASREAVARREFLVLHGINHPGIVQVDGLESHEAGPALIFRHRPDELRLDQYLDRYGDRLDAGTRLDMIRQLAEAVAYAHGRHLYHRALAARSVLVVPSGRRSAGEQGWLAPRLVISDWQAAARDAGSSTGVLTGAMTKTSMALAVEPAARFLPHLEVATAGYLAPEIGAPFPDPVGIDVFGLGALAYLILTGQPPADSPNALKARLEQSGGLNPAEVVDSLSEMANELVAEATRPLPDDRPATVGEFLDLLGLVEEEFTRPEPAVAAGDSTPAEQPVAGQDEPEPDPLEAQHGDLVGGEWRIRERLGTGSTSRAFLAHNEKTNRYEVLKVALSDERAARLEHEASVLGRLGDSRVIRLARPDTLVIGGRAVLVLDHAGEQTVARKLREGRLSVDELETYSDYLFGAVDYLDGEGVAHRDLKPDNIVIRRRPNRTYQLVLIDFSLANHSVRDIAAGTPRYLDPFLGAGTRTAYDDHAERYALAVTLHEMASGELPLWGDGSAEARFTQGPPTVATEAFDPAIRAGLTSFFLRTLDRDATRRFASLKDMRDAWQAVFRAADSTPPAVTAHPAASDGARLTESESVVVTPGSSAGVAMADEETARRARDAAAAAATSDTPLDAAGLSPRAVSAAHRLNATTVGDLLTLGSKEIISLPGTGAKTRQELQSRIRQWRRSLAAAPAGTPSAATAAQPDPAQQETPAAQTPAAKPDYARMPVEDVAGRLLPRALAGGRNATEREATRLLLGLPDDAGRLPDVPLWAPQQQIAERVGVTSGRIAQVLTARRKTWHADEAVRSVRDELVEILGDAGRVMGFDELTTAVLARHGSRRPPAERRALAGAAVRAALETVDLDSEPTLARRKFYERTLVALEAAEDDGPLTPAAPALFDYAIALGKAADRLAKAEELPAPATVLRELAAVGAAPAAGDTDDAGLADTDPAAAEGRAGLPALDEQRLVRLAAAASRNAAANARLEIYPRDLGLVRALRLAQAGVPPPRQAVMPAPPAGLDERPDRPLLEVAVIHERVTARFPGLTTELPAHPALDRPLADAGFVLEWNAARDGYVPPNSLLTSTGLGGSRATPVREPTDLGSRPARRVFDSPDLADAARTEQRLVAAAESGGFRALTVRRNHYLLARAELAQPHRFAAEPIDVAAVFLDALHAEVDPRPKPTWATVLRADVAEPGSRAAGNLTELVRTAWDRAAPLLAELVDAAAGRTGPHGPAPLLLHDAGVFGRYDGRGMDLLFTLAERARAGGRAVWVLCPTTEPTQPPRLDGTLVQLVTGSEWVALPDAWVINRHRSDDEPDLAGKAS

SEQ ID NO: 6097 - protein, 1413 aa, Haliangium ochraceum
MSARHIEIGAPVHAGEASGIRFLVENLPDDYLVVSNVELPTGRPGRTYEHDAVVVAPHAVFAVELKSWGGLIQGNRDRWRLSGSGYVASPISLILSKARVLKGVLKTRHADLRSIWVQGLVFVTAPDATLSISRDFDEYAHTRDTIIAALTQPAQWGLAAGALSAGQKRHVETFLADGVPPSARTHYGGYELVERLPVEDKPYDAYRAKDSLGFHRLIHVYPVLGDNEVTQQRARSRALREATFADKLSGGPDILRWCGHHDLPHDNVIVLAFEDTGALLTLRDWVDQRRPGFQDRLSVALSVARALVWIHQKKVIHRRISPQTILVSDQDKPIDLRLAAFDLARDLSGQAPTITAKRLRDSEYRYTAPELLKRGEAGIGSDLFALGATLVELFIERPLFQKAEEALHPFEVPPLHVAGQPVPAEVQRLVEQLLALNPTDRPESATAVAERLERCLRRPVDASERQRPLQADDEVQGYRLLELVAEGAGGQTWKVLHLLENQVWAAKIADPERSAELEIEQGILRDVKHPNLVPYKDICNLPGRGMMLVLGWIDGVTGKEWAELGDPLSPEQLLACGRGLFGAIDALHRAGYVHRDLKPANLMLREPGAEPVLIDLGLGTLAGDTDHLTVGTVDYKDPQLYEQGAWEPSFDLFAAWLVLYQVATGVHPFGGRPEPGRQPAIDTSLFAEGYAGDQLDRLGKLFEEALSPKLDHRPKSADAARRALVDLLAPAPQVTFDDLRANLGAPPAPPPQPAAQPQAPELSAAPGPGELLAGASVDTPLAEIALSARAARALARLGVTLVGQVGAIAPAQLAGQRNVGTKTRRELENLIAEARARFPGLPSAPLASEIPLTAAVDALYPELEGDERPIDELGAALKPKARQGLARMGVGSVGELAMLDRTTLRSVPGLGPKQSDEIVRALERLAGATRAPADLAALAVEIEAEIGAASFGIIAQLVGLSDGLVRSRREVAEHFDISRQRVEQVADVSQLRKQASAAAPLLAAVRRLLPKAGFARLDAIADTLPTQIRPSAGASALGYARLAAVLLEPGRRLLDLDDIELVCLPPWTAEAVGYVVETVASAASWPPLPRAEAAALAWRATPEVIQGTLRRWGVEPEAVLGASRPLLGDVLATHDEALFTPPVPFAEAVRHARAELEPPLSLGQLRETLQRRYRGVPDPDDLEAELEAADLRLHDGQVIDAAAPAPAPASVPKLDQGVAHRVRTDDGELDLGVLVAAAERGGFRVAVLPPGRHHRLVEDIRAALERQLGDERVRLIDVDRVLLEALEHAGLWSDAEFFDRQGDTSWGWAREALVAALEHAIDETARPGRVTILGRPSLLGPLGLLDWLAGVYDQVRGGVRGLLLLALPGGIHDGRVRLNERYPFPYTPDMAAVSLIDAAAFTREPEPGAGELR

SEQ ID NO: 6098 - protein, 1417 aa, Microlunatus phosphovorus
MTPAADPRWVEVSPSQFTHETEGVRYVKDLLPSQPPFRAWSNFEFRDSHGRWHEVDLLVLGRRRLHLVELKYYSGRLRGDDHRWLRDGHRAEDSPLKLARRKAQYLASKLQDEFRSWVREKRVQNAPPVREVVPFIQEAVFLHHPGLRCELSEASALGLYGLDGQARTTRLPGISDLLLEPARPGVAIHERIVAELMARIGLVPRREREAGSWVIEGEPVGEGDGWQDWDAFHRFTQRERARIRFQIAAPGASDDERRRIRRIAEHEFTVMRRLNHEGLLAPQDLVEADLGVGLVYPLDESWQRLDLWLADRPDGIPLTTQLAIIRQVGETLQYAHGNRVVHRGIRPGAVWVREQGSAVTVQVRDWQSAGQVPFTDQTASSAGGVTALFDPSKLIGDDAGGLGPFAAPEGALAAGVDRVRVDVFGLGALAFYLLAGQPAATSASTLRDRLREQSGLDLAPELPQVSSTLRRAILHATRPAVSERTADVTAFLAELSEAERVETEHEPVVDPLEAPPDAIMDGRFRLIRRLGTGSTAVGLLVRDLAHADSERVLKVAVDDAARQRLHDEAEVLTGLRSPRLVSLVEGPLIVGGRTALLLESAGEQTLAHALSARGRMSLDLLERWGTDILEALIALDRAGVDHRDIKPSNLGVREIRATREDRAAHLVLFDFSLSRAAASALRAGTPPYLDPFLGADGRDRYDSAAERYAAAAVLLEMATGQPPQYGDGLSDPAVIDAEVTLRLDRFDPAVAHEMLSFFQRALARRVADRQHTAAELLAGWQQVFGQSHTTAPDNADELVGAATLETSLTGSGLSARALSALEPLGVTTVGELVAVDPVRLNRLPGVARATRDQIKEAVSRWRARLGPVRGRRDGGSWQQSTLPVPYDLAEMLLAPTHARRARIRTALASMMLGVTGQADAFATQAQLGALLPEPVTAARVTQVVAELHDLWAADETTLTLLTRLGAEVDARLDVLGGVATADELTRHLLALMVTDPANEPSDSERIAAGVLRIAVDRRRALSRADERTVEYVVRRRDPSPLLVAREASLLDLAGQLGEEADRLLRDASPADPTIAVLAAIRVNEELSRAAGGVDQLPVALRGSTRLAGLAAATSTAAALSGTGELHHRGLPLPRAIAHALGSLAAGQALPPTEIRDRVRVRFPALRPLPERPRLDQLIADSGLGLRYDDRERVYRAPRADHGTTGLPSRQVTDIAPEPTPVSALGAIGQRLADSLARRSFLALGVPARALLKLPTVLETTYSARLINISAELIAIMHQQADQVGLPWARVRAADAQPSGSRDAQGIKALVERSLPLLEERIQATLEDAGPGPVVLADAEPLARYGAVNRLSRWTDLGTRRSRAVWLVVPQLHANQGALLDHKPVPLAAPGQFVPVDSSWVDAQYAAIAEPVQEGASA

SEQ ID NO: 6099 - protein, 1369 aa, Micromonospora aurantiaca
MREDSPRWQQINPTAYLHEQDGLRELASYLPDAEPYHVWANVEFVGTDGSINEIDALVLTRSGLYVLELKHWQGRISGDGQRWQHGRSHVDSPLILTNRKAKRLRSVIRQYAPPAARIPFVHAAVFLHARNMHCELDDIGRQHVYGLDDNNSQLPSLKQMLLAPPADSRHLVDAVRARQIVELVRGAKIRPSVAERRVNQLMLHQRPFAEGIGWQDFLADHTVDTSLLRRVRFYLTSRAAEEDVPAIRRAAEREFRLLQGIHHPGIARALDLVDHPWGPAVVFDHRPEWQRLDQWLAERDGRLQLAQRLQLVQDLAEIVGHAHSRRLSHRSLNPRAVYVCDPDSARPTLVVTDWQTGGRLPGTRMTSLGSPTDPASLELFFDDSVRRYQAPEAATLDDLPGHQLDMFSLGALAYRIFTAVEPAASAEELVAAVAGGGLRLDAVADGMPKALVEIVYDATRGDPGPRMRRVTDFLAGLELVWEELTAPEPEPVVDPLRAHRGDVLDGGLTVLGRLGSGSTAVALLVTEEAGSDRRPVVLKVARDEQYADRFAAEARAVDKLRDARVAALVRGPVKVGGRTALLLENAGERTLAEDLRGGRLALDLLERYGRDLLEIVAFLDGQGVWHRDIKPANLASRPRPKDKQPHLCIFDFSLAAVPADQLTAGTTAYLDPFLGPPRRLRYDAAAERFAAAVTLYEMATGTLPRWGNGANPAAVSDEVTLDPAAFDPSVADRLVAYFAKALARDTADRFDTLDEMTDAWRAVFREIPEPAALAGDTGGLAPLSRASSLEAAELTARARSALERLGIGTVGELLDAEPSALTRARGVPDATRKEILARSRELRELLATVEPPVPGRPDAQHVEALCATLLPAETARTSWHRTAIQVLLGQAADEDGHYLHWPSQADVARVVGKQQPQISNLLRRVQTRDWLSNSALGLVRDEVVALLDARGGVASSEEIAEALNVTRGSYTAEPKRTAQAIGLVRAAVETELARGGDARLAMQRLRGGDTVLIGREPDDPSTERTADDLLGYVTRLGRRAAVLAGADPLPSRSRAVEELRALERPPAGMPPLSEARLLQLAAAGSGGEAAVNAQGQLYPAERMAAERALRLAAGALVGQKLDPETVRARVRARFPRAQELPPRPKLDELVREIPLFWDASTGRYVPPDRTSSLTGTRSVSTVGPILAPGAAARARRRLAEVIDRRGFLVALTSIRRPGCARQALLDRYDLTEVDVTAVMLERLRALGFPWETIVAADTGSPTDADFRSLVELFQHEVMPAIRTALAETDRPVLITEAAPLARYQQLGVVQELADPTRPRPAARLLLVPVRRTEPLLLDGQQLPLTSLANQSLWLPDEWDSPILERTAPR

SEQ ID NO: 6100 - protein, 1405 aa, Mycobacterium gilvum
MKDGRWVTIAESQFDHEKAGLNAIKQLLPDAEPFRAWANFEFRDNRGRWHEVDLLVLARDTLYLIELKHYRGILTGNDHRWRRNNRTEDSPLLLARRKAQYFSSLLKDAIRERGGDEAVSRITYVQELVFLHHEQFVCDLPPNSKINLYGLDGREGITKLPGISKVLLAPARHDPISERDSQLIAGLMKAIGLAPRRQREVGSWIIDDQPLADGDGWQDWPAFHHVNTEDHVRIRFYTATPGATKADEHARRQAVTHEYNLLSRLTYDGLQAPKDLVDEPELGIGLVFPQPKSDTPLDLWLADHTLSLDAQLDLIARLADIVHYAHRHRVVHRSLNPRSVAVRERGEALLPQVVDWDSAGILPANPDTAVTRLSGGSLTLMAGAPSDTARLFAAPEGSRPTDPARIDVFGLGALAFFILTGGTAPATERGELIDRLRRDRGLDLAAEMPQVRTPLRQLVLDATNPSPADRIADIGEFVARLDAVRNEVLLKTTGTDPLEAGPGAELAGGRFVYQRRLGAGSTAVGILVKDNQVGGALRVLKVAKDPDAAERLRAEAQVLGRFENDDRIVTLHGVEDVGGRTALILRYAGRTTLAEELNNRGRLSIDVLQRWGTDLLTALVALERNGVTHRDIKPSNLGVYQSSSRADTHLVMFDFSMAGVSPDNVEAGTPPYLDPFLGTGTRRRYDTAAERYGAAVVLFEMATGATPHYGPDPGAHPATVDDDVTVVPAMFEAALAPAMVAFFTAALSRDPARRPDTAEDMLRAWRQTFTAADTPVTPQANDADAENADAATILSSAGLSARAVSALASAAVTTVGELLAVDSTTLNRLVAREAKDTRKEIVERYRAWTKRLGKQQPQRSGTELRSLNDTGALLLSAVSAQRSSTTRRDAAALLLGTTPGLDGFASSTELAEKLGKAPQRGTQLIKELQEDWANTPATRELLDALTDIARGVIEDFGGVAAVSTLTAEIRSQLPQTGAGAIDPSAERAAAGLLRVALDRLHEHETASDEKTLVRRRHGRRLALLATDEMLLSAAEAAAKRADELVSADPNAVIPAVRAAAALRTAFQAGYTAVADSDATAPMPSDGRLVRLAAAIAKHAAVSGRGELHNTDMSPAAAVAEALRGLAQNESLSASQIRSRVTARFPELDKVPQRPHLDTILAQTALNLTWDAAREVYCFPDAEPPSATSMHTRQPTALPATGETVADIDQAVNAVALLRRSLDEAGFVAVGVQIPRDRPGEHERVAQHLAKTYGGELVDVTTELIAGMQKLADERGIPWDLIRGADSAEATPRDAQGLRAVIDRVAPALRETLRAAVFDGQRSASPLILTEVSPLARYGHLDLLATLSDLAAPRRRPVWVVLPQLRGQVGALVDRKPIQLGSPGGQFVLWRDALDAVPTAGDGKTT

SEQ ID NO: 6101 - protein, 1494 aa, Nocardia cyriacigeorgica
MDEGRWTTVTESSFEHERRGLEAIRTQLPNVDPWYAWSNFTFTAKTGHIREVDLLVIAANGVYMIELKDWSGRLTSEGGDWVQTTTRGDRRFHRNPLHLVNQKSKELAGLLGDNGARVFLSSAVCLTNSGLRFDLPTGDRASTYTVRELIDRLHAPVRDIKHTINAQRARAIKKALEQIGIRRSDADFTVGPYLLERKPLDAGPTWQDYLAVHTELREPVRVRLYLRERGADEEARKSVDAAARREAAVLRRFRHPGAVQLELFDPSAHTAGPALIFRYHPDTLHLDDYLARHGASLDIGDRIELVRQLAETLRSAHSARLYHRALAARSIHVVPRPGAGEAQRWRSPRLQISDWQVATQRSAGTALTMTRHAPTLLSAHHLSAGSDAYLAPEVSAPSPDPIAMDVYGLGLLTYLLVTGRAPAATQAELLARFEAGEDLRPSALVDNLPSDVDLLVAAATDYRPSKRLTSMDEFLELVEDVEESLTAPAEEEVVTEEKDPLDAVPGDVLAGRWLVRRRLGTGSTSRALLVRDLQAETDKRGAKTYVVLKIALSDDRADLLEREAGVLRGLRRHSGVINLVDPGVLVLGGRKTLVLEYVGDEQGLDQDSDHRTEATVARELRDNGRLQVGRLETYSDYLFAASDFLEGEGVWHRDLKPDNIAIRVRPNRTRELVLIDFSLAGYPVQNTDAGTDGYLDPFIGTLTRSVYDAQAERYALAVTLHEMASGELPRWGDGSVLPRQLDPAEFPYPKIAADAFDASVRDGLVAFFRKALHRDAGQRFSDLKPMRDAWRKIFLDMSRSVPSRPLSSHPSEPVDVDEVSPEDQRRLIAEQATVETHLSQAGLTAATEQFLYGLGVNTVGELLDYGRGKLINAPGLGARARREIQDRLKEWGRRFGKEEPAPLTPQARKEAKQELDAAEADLGAGLLRTLSLDTLAARFVPERNNNGSNASKVDAVARLLRIPGAGDLPELDAWPTQSSVAESLNLTSGRVAQLLKAQRQQWKKDPAVQALRDQVLELLEEFGRVAAATELADALAARRGTRLDDRAQRRALGLAAVRVVVEVEQLTPDEAALYTAQKRDSGANPVVVLALEAGEEAGPGAPAAPALANYALRLGRTADALAAQETLPTAATVLDRLGAIEPPAGTFALDERRLVQVAVSASRNAAVTPRLEIYPRDLPLVRAVRLTQAGLLTLTPGVPLKQQTGLRAERVFERILARFPELVIAGSDRDVPTPELTKALREAGFDLVVATHPESRIQRYIPEHADLQSSYTAHAPRWSTAVNSHAAGSYSDDPDMAKAARAEELLTGAAPRDGFRVLTSPTSPTSATPAAIRELRERFSVRPMSATALFLANMHDLVPPGTKPTWDTILRADIAEPGSRAALKFSEYARTAWGRIETEIADNIAGDGPLLLTDTLVFARYDAMGVLGRLAEQARRGKGGLWLLCPQSDPLRQPHLGTEAVPYQSSLNEWIQLPEAWIRNIHRTSASTDTGVTA

SEQ ID NO: 6102 - protein, 1427 aa, Polaromonas naphthalenivorans
MSMSANRWKVIAESSFPWERDALEWLRAQLPDREPWSVWTNFEFIDDQGKVNEVDVLVLSPAGLFLIEIKSRPGTVDGDAHTWTWNTDGREYSYDNPLLLADRKSKRLASLLRRQAAIVKAKIRLPFIQPAIFLSSTSLKSKLQGIAKTATFQRGQPGSLTDDGIVHALVNGIHSNAAQAVDGQKARAIARGLAEAGIRPSNKHRQVGDYQLIKLIAEGEGFQDWQSQHVSMASIQRRVRIYTVAHASSPEARATRVRQARREFEVLEGISHPNILKVNDYKETEMGPALVFDHDPKAQRLDHLLRDRGTQLTVTQRLQLVRDIAETLKFAHSRRLYHRALGPQSIMVHTADGGALTPRLMNWQTASREAGNPDTVHRTTGTRHVEDYVEDPGLVYLAPETTRADATHGPSLDVFSLGAIAYHVFSGQAPAGSVLELAEKLRLGQGLRLSDVSDGCGMRLQELIQYATCPDVMARYDVVQGFLDDLVKVEDELTAPDPEATVDPSIAGHGDRLEGGFTVVKRMGRGSSSDVLLVREDDSPEELILKVACDLAHNDRLVAEGDVLAGLHHQNIVEYRRTLSVAGRTALLMRSAGPKTLAQKIKEDGRLSLDLLQRFGEELIEVVNHLEDHGVAHRDLKPENIGIATTSSGKLQLVLFDFSLCRTPTENISAGTHSYLDPFLSLRKPPRWDLYAERFALAVTLYEMAIGKLPVWGDGQTSPAMLDVEATVASDVFDPVTREGFTAFFSKAMRRDFKERFDNAEDMLRAWRAIFAARQTVHPPQAEGFSAIALTALSTTTMAELGYTLEAQDVLERMGVHNARELLAVDRIRFRYLKGVGDRIRKEIRLTAKELAHLRPDLAQGRATLHDSDDDGTHDGAVSVNELAALLMPRRPAGDDRPEEAALAHYLGLDLGLDDAAQPESASSQAAWPTLGESAQATGVERSTLTATLVKARERWLKNPAFTEVRLQLDKLVLTQGQVMTAHEAALALLALRGCAMQEDAQRLQLASAVLRAVLEAEAHLENPRIQLYDHPPSPLIATSSAWADYARQLGSVADTCALVDPLLPPSRVIEALVAVQPVGVLMGSGPAQEAGEAPMPGTRLLRLATSASRTAALSSRQEIYRRGMPALQALRQSLGALVGVPTLRIRELQDRVRGRYPEATLLPGRPALDRLLEEAGAPLQWSPAAADGAGAYLCPALNNHPTVGTTTVFSRQSTFPGAHAAGTPAGEASEAALADAQAAEIRLQRALKSGGLLVLTVEPRQARHAEAELLRRFGPDSQTQPALQRMSFDALLLKALRTEADRARVDWSMVLRADTAEPGSRDWANLQRLVQRTLASLKPLLLDSPAPALLTNVGLLARYDLMALVTEMEASAGRPGHTPAVWLLLPSHKQGLPVIDGVPVPLVNSTQAFALPPAWIENKHRASALA

SEQ ID NO: 6103 - protein, 1408 aa, Saccharomonospora viridis
MMPQAEPYRAWATFSFTAASGRINECDLLIAVPGGLYLVELKGHTGRVVNSGETWSFFREGEKRPRRFRNPLHLTDLKCKELKQRLEWAAKQIGYSGRIPWIEPAIFLSAPGLVSELDEVQRTRVYGRDEQVEGLDWIWRDLLSRPPQREQQRVSPKFSQRLPELLKKIGIRASTAHLHFGDDWVLSDEVLDAGPTWEDRLAKHAGPVRDEGRVRIYLTEQQAVEERRQSVERAARREYQVLQGIIHRGIAQAMQFREHQSGPAILFRHNSSDLRLDSYLEIHGERLSIETRLDLVRQLAEAVQYAHHRSLYHRALSARSVWVAAKEDGSDPVLRITDWQAAARDFDSTSTATVGKTSLTGEHLASSAEVYLAPEFAPHADPVDLDVFGLGAVSFLILTGQPPATQRSGLIERLAESQGLHPYAVSDGISDALDALVFDATRTDLSQRLESADAFLKRLDAAEWESLPESSVPVVDPLTVSAGQMVDEQWRVERVLGTGATARALLVRRVDTDDEQPERRVLKVALDEDKAQHLHAEARALALAGGGVVVKLLDGPRELGGRTVLDLEYAGGQDPQGYTLGELLRAEGKLSYHNLERYGRDLFTALDQLAGKGVRHRDLKPDNFGVYRRADRSTQLMLFDFSLAEASERDVTAGTRGYLDPFLGTNRRPAYDDHAERYAAAVTLHEMASGQRPVWGDGVSDPRTTGDELPVLAVELFEPALRDGLTEFFQRALHRDVNRRFDTLRQMEDAWREVFTAADTAQPLTTPDTVGIEGKTLEEARDFYAEKATLDTQLDVAGLSPRAVSLAQSLGATTVRELLEQVRPYEISRARGAGKVVRNELNRRYKQWTRALSLQDEPDRPAPEATPGLSTVDDFVAWLVPQKARRGSRKADVVRLTLGLPEGDDDELLRWPTQTEVARRLEITQGTVSQHYRAAVKAWAAEPWLSRVRDELVELVAEAGRVMTAHELAAAVRAKYGVAEPEARERALARSLAVVRAAVDTEAWERQQDEDEDEEGPRFSALRRGDHVLIALESLPGTDAPSAPELADYAVALGARADELVAMDPLPGRGVVVRELRAVPAPEGLPSQADTRLVELAAVMSQRAAASARAELYPRELDMVRALRMSQAAVGVRRETGITREALLAKVRARFPAVVVDDQTSEVQLEEALRAAGTPLEWDTETKRFRPPEPKFSRSAVSSSTSRSGHGPLFSGGVDPREVLGGKLVRAGEHGGFLALTLRGVYLPGVAEALASRYAVHPVHVDSEFVATFRELIAERGQDWELVRRLDAGFGRTGLPKPGFREYVRKVWERLRDRLVAVGGERTVLLLHHAGLVGRYADLGGREFLTSLQQAARSASAKPHGLWVLCPGESAREAPQLDGLRVEALTESERVVLDKDFLRDLQVVDQAS

SEQ ID NO: 6104 - protein, 1308 aa, Saccharopolyspora erythraea
MQQRGHRSMRTPWIQPAIFLSAQGLRSELDEVQRAHVYARSEDSGLPEIWRDLLAKPPQREHQRVRPEFSRLLRDLFATIGISAATSHLRFGDNWSLWPEKLDAGRTWEDRLAERSVPVKEEGRVRIYLTAQQASEKQRQSVERAARREYQVLQGINHRGIAQAVQFAEHGGSPAILFRHRHADLRLDSYLDLFGDRLSTEARLELVRQLAEAVQYAHQRSLYHRALSARSIYVSARDDGSQPLLRIIDWQTAARDFETTMGTSSLGNSSVTGEHLADSSEVYLAPDFDTPYADPVDLDVFGLGALTYFLLTGSPPATQRSALIDRLRKNQGLRPSAVADGVSDELDALVFEATRADPMDRLTAADEFLKRLDDAEKKSVPVGVASDVDPLDVSAGQTVGGEWDVVRVLGTGATARALLVSRIDEDADGEPRPEYRVFKVALDEDKAAQLRAEAEALTKVGGGVVVKLLSPARQFAGRTVLDLEFAGGFDLEGKTLGETIRAEGKLSYHNLERYGRDLFNALDILAGHGVWHRDLKPDNFGVFKRADRSTQLMLFDFSLAGVSERDVKAGTRGYLDPFLGTSRRPVYDDHAERYAAAVTLHEMASGQRPEWGDGMTDPRTTADETPNLAADLFEPDLREPLTSFFRRAFHREVDKRFDTLKQMDDAWREVFRKADRTPPLTTPGTAEADDASLPDLREAAAKSATLETPLDAAGLSPRAVSVANSFEAFTVGDLLRVPPYQISKARGAGALVRRELNRRHTQWSKVLLAGATPQRPQVEGRAPTIDDLVEILAPKPRRGSPRPEAIRLLLGLPGEDGTPPPWPTQSDVAKALGRTQATVSRHLNSQAKEWAADEHLTAVRDDLVALLGEAGRVMTADELAAALRARRGSVEQDSARAHALALAVVRAAAETEMAAQGTDAEPRLLVLRRAERVLVALESLSDSSDPSAPELADFAGALGSCADELVKLDPLPGRGVVVRELRSIDAPAGLPVQADTRLVELAAAMSRNAAASPRLELYPRDLDLVRALRISQAPAGVRRGVGIAVDDLLAKVKARFPLLELGESITYVQLERELSAAGFPLVYDVEKARFTQPEPESSRSVGSSYTSVTSTEQRSDPSEQAHAKLTSALNKGGFAALTLRGVHLPGAAESISSAFPVDSVHVDELFLAQFRALVKQHDVDWNDIRALDNEFGATGVIADGFASFVEVTWENVQEELARRASSSVLFLHHASLLARYYNRGGRDLLTELQNAARRPDSRPHGMWLLCPGDSAWETPRLEQHIVEVLGESERVVLDGAFLAGLNAGEGAA

SEQ ID NO: 6105 - protein, 1400 aa, Saccharothrix espanaensis
MDENSKRWHEITQSAFGHERAALRQVRDLLPDRHPFEAWSNFTFTSQHGHVREVDLLVATPSGLHLVEIKSLQGRLTNQNSIWVQHRPNGRVRTFDNPLALANQKAMELKSLLLQAARRDGVHVPYVAAAVFLSEAGLDCRLSESQRHGVYGPEHGTSLAKIGSDLLTGQVSRSPVPPEFFIALPRLLKSIGIHPTRRSVTVGAWQIEPRPYESGPTWQDHHATREDMPGEYRRVRIYLYEREADRDKRESIRAAAEREFRACQGIRHPGLLRPVDFVAHELGPALLLEQQPEAVRLDHYIAQHHAALDLPTRLDLVRQLAEAVNYAHERRLVHRALSPRAVIVQPTGGDWLRPQLQVGEWQAAARGLSGPTTGHRLRPSSGAAAHIEAAATPYLAPDFTDDPDGTVAIDVFGVGAIAYLVLTGQAPAAPADRAQDHDGLHPQAADDSIPDDLDAVIALATTPVVADRFPDLALFLEELADATRLDATGAEREDPWDAGLGQRLADSDYVVRKVLGTGATARAYLVDHDGIDTVVKVSRSAEAEDRLVDEAHSLEHLRHDHIVVLRRSLFPLGSRHAIEIDYAGERSLAQVLRDEGALLPDKLQLLGDQLLDALSYLERKGVAHRDIKPDNLGLRSHPKTGQALVLFDFSLAGAPPNDVQAGTRGYLDPFLGTDRRPGYDAHGERYAAAVTLHEMASLELPTWGEDGTNPRFHGHPATIASELFEAGLREPLRTFFGKALHRDAEQRFASAEQMREAWRQVFTALDETGPAAISSSGSDDPAELRQEAAERAGLDTALDAAGLTLRAVAVANRLGANTVGDLLDLRLNEVRRARGLSRKTRTELLDRIAAWRTRLVSDPSAMRPLPLPEDADSGRLPLDAIVPLLLPTAKRRNDTQAAISRLLLGLPDAGGALPATRWPTNRAVADRTNVTPGRIAQVLTARRKAWSELDVLESVLDEVVDALASLRRVAAAEELAEVLIARHGFAETTDPGLRTAYAYAVLRAVYEADSIREESRLVLRRHHDRLLLALQVGQDEPVETPSDEALLDLATALADAATALAAQDPLPTPTAVVRELAACVERFGEAFDEKRLVRLAAAGSGAVLSNVRMELYPRDLPAVRALRLAQAGAGLPTDGLSAEAVQRRVDNRFPGLDRLPTGRALKELLVEAGFAVRWDGERFGPPAPQLTAVTPDLTSSTGSTSRPMIEGTAAGDVDARLADVARRGGIRVVTVRLKRWARARVAVELALGLPVVDVTTAFVAALREVAKELRIPDFDRVLRADAAEPGSNDQLNLHRVVEQACRRLEADWTRRHVLALDGLTPLGRYPAAQALLEKLCDRARYGRTAGGPPGPDTVVLLCPAEDETKAPHINGYVIRVNSPEEWIIARSPWPPAGILHPQAG

SEQ ID NO: 6106 - protein, 1413 aa, Singulisphaera acidiphila
MMKTRWNTITPSQYSWERAALDFVREGLPDHDPYRAWSNFEFQADGGAIYEVDLLVLTKQGFWLVECKGWNGRITGDSGSWTRSDGGRPKSEDNPVLLANRKAKALSSLLKAQSSVAKVKVPWLDALVFLSADEVQCELTGPARNRVCLKDRPAHEGRPERKSVLAALLERDCPGVDPDLRSTIDTKVAKALSRAMEQAGIRPSQRARRVGDYVLGGLIADGIGYQDWLAKHASFEDVHCRVRQYTVAQALSEEERQRLRRAAAREFQIIQTLDHPGILPVLDYKEHENGPALLFRYLDPNAIRFDQYLATNAHKLTTDQRLDLLRQVADAVRYAHRKRVIHRALSPQSILVTDAASSTPRLQIYNWQVGVRETASTSARATEVEDLVESQAFVYMSPEAIADGRKVTEASDVFSLGAIAFHLFASRPPASSPADLARILREQKGLSISSVLDGAGAKLEELIQWSTHPDVLTRIGSVEDYLTLLDDVEDELTAPAEAVVLDPLQAKRGDRIEQGFVVQRVLGQGATAVALLVTKGDEEFVLKVAISEEQNARLHEEAEALRSIHSEFIVAIVDELIINGKAVLVLQKAGDKTLAAMLRSEGVPGLEMLARYGDDLLSAVSSLERHGVAHRDIKPDNIGIRSLTKQRNQLILFDFSLAQAPLDNIRVGTSGYTDPFLINRKPKRWDLDAERYSAATTLYEMTLGTGVLPQWGDGKSDPAMTDAELRIDAEKFDPSVREGLVKFFFKALDRDPTGRFHNADEMRWAWQQVFQGAEERKIKTPSGEEVDLRVTLEQADLTTPVAALGLSSRAQNALERANILTVRNLLEHPIGDIHLMRGVGNQTRREIIDFLTKLRGRFPSVEATSTKDQGSPDESSGPPGLELMEHRIVGIKIPKKDAEWQIRTALLGVTVADSQPPDKWPSQSDVADALGLSRARVGQIVIFDRNRWSKDPAVTSFRHELCEQIQRLGGIVTIPEIIDLTILLRPPASLLEPGRQQRMASAVARAAVETETSMTVPRFQIRRIGRKVAVSCSQELAVFAEELGQKADGLAATDPLPPPLRVFQELYEVAQPQQPHGCQPFGNERLLKLAAAMSRNAAVSSRQELYPRDMAAERALRLGIGALSGLGLGEGDDGFTIEQIRDRLKSRYPEADPLPGRPELDDLLRRVGLDVRWHPHTSTYHRRETSTLATSGSSIPLRRTTATSNRKVEITPDLAEARQFEERLSHAYDDGGFLVLTVRPSRMRRCENELMRRFPLERVSFDALLFDALRDEADELEIDWSIVEEADGADRSSQDWNNLISLVARVAPKLTAGLCDRRQHLLMVHPGLAARYDQMTVLETLRDKVGHDVACPGLWLLVATDWQHDLPMLDNAEIPLITPGQRSRVSESWIDNLHRGHANGAATRPVASRKGGV

SEQ ID NO: 6107 - protein, 1477 aa, Sorangium cellulosum
MALSRGRVLAQGTTPHRHEQEALEFVKSVLPDTDPYRVWALVDLVDSSGRRYELDLVVLGYHALYLIEIKSHPGAVSGDVVDWRFRSPEGHVSIKENPLRLTALKARVLGSLLEKQMGRKRPYVEPLVFLSDPNIHVTLEGNAKARVVTRRGFLAAMQHGDYPGSEARPLGSPIDRPMGQAIDVALKALGLRESKGAMKVGDLALGELIEEGPGYQDREAQHERMATLKRRVRSYLVPQSPGQERRDQLRRAADREAEVLSVLSDHPAILRFTDYIAEGPMGGPCIVFEDFAGGLPLDAYLRRHPDLSFDHRIHMVQQLADALDYCHRKKVLHRGLHPGAVLVRERQDNKPPEVRLYNFQLASREDGSSGTVHLSALAPDRAVVYRAPEVIEEPSAAKPESDVFSLGAIAYQIFTRTAPGATLLEREMLLQAGGGHLSIAAVRDDLAGGATPLGETERKSLDEVVGFATEANPVQRADNALDWLDLLLQAVTAPATGPVPGLDPLEARPGDLLGGKLSVARLLGTGATARVLAVEREGSLLALKVPLAPEFEDRLRAEAEVLGALRSERIVRLEGTPTLGGRFCLLTSYGGETLADLLTREGPPSLDYARRWGEDLLRALEFLEDEGVQHRDIKPANVGVLPSQSKKQRHLYLFDFSLSMLDSAQTLVGTPAYRDPFVPLRGRWDEAADRFSAAVTLYELLTGTRPRWGRGDVPATAGQEEMSLDAERFDTAVRGRLVPFFRRAFAREAGQRHETAEQMRTEWIACFAAAPSEAGADEADGAPPVAADLSIFTEATPVEALPLGAREKNALDRSGIVTVRELLALPQNQLSAIRGVGRETARAIQDFVERWRAARATAGVASSVPEGGAPGRPRSAPPLPAPFYPGFQGEDAAVAYLPGVPRELTTALADAGLARASHVAAASPRRILHVLGDRPDAAEAVRAALAKLAEGATDDAPATLAAWLDLLLPGKAAGSGRARVNAGRGPGSAVPFKHVRELFGLDPVEGERITEASLLAKKHRISPQAVYLQLSKAREHWRGFPRLQVLHDLVHGALAGLGGVASVASVGAALASAVPAGPAAADASSDAAARLAEALVRVVVETSEHLVVGPVRGLWIAPSYEHLRVARALGDEADALAAREPLPASEEARAALAARVKDTELAALPPERLVSLAAEASRTAAKSARLELYPRAMSPARALKLSAGAMAHLELQPEEILKAVAARYPEAERPPPRPALDALVRPLGLEWSDEKNAYIRPGALPTSTVHTQVPPPPLPTHHGSRRPTRDPLVQEAREFDERLRLAASRKLFRVIEVNCAFADEAANRLSRDLGIEPVSLDRAILRAADAVALEWEIPDRGVLDDADRAGPTGPDWANLRDLMRESAERVVRDLVARNASVLLTQPGLLARYRLDGVLATLIEATQKDDGPAVFLLVPAYDDLGPAPIDAVPAPMPIPQSSPAQRLRVPESWIENRHRAMP

SEQ ID NO: 6108 - protein, 1806 aa, Sorangium cellulosum
MRLPREMGAPSPYTITGTLHEGGRTRLLRAVRSADGRPVILKVIDPRSGCSQDIERLRREYMMGKALRHEAFVEPLALETFEGLPALVMEDFGGESLDHLILLDAPMSAGRFLDLAVRLVTCVAELHQRDVLHKDLKPQNILVNATTGEVKLADFGLASRLPREQPPVGTPRLIEGSLPYLSPEQTGRMNRAIDGRADLYAVGVTFYQMLTGRLPFEARDPLEWVHCHVALAPPPPSAVVPGVPEVLSAIVVKLLAKMAEDRYQTARGLRHDLDRCLSQHRACGRIEPFSLGERDISGRVQLPQKLYGREREVSALRRTFERVVDTGVPELVLVSGYSGSGKSALVHELYRSIVRERALFLSGKFERSRRGVPHFTLVQAFRDVVCEILAEPEDRIAALRQRLLDALGPNGQLIVDVIPQVELVIGRQPQVPELPLAEAQHRFRVVFRRFIGAFARKEHPLVLFLDDLQWTNPASLGLLHDLMTHPEARHLLFVGAYRDNEVTPSHPLMMALDKVRKDGARVSDIVLGPLSREHLGALVGDALRCRSEDAAQLSALVHEKTAGNPFFAIQFLTALHEERLIELDERAERFRWDVAKIRDKGFTDNVIDLMVGKLVRLPPGAQEALKHLACLGSAAGVDLLAMVRGSSVEETHADLWDAVRAGLVLRRGASYRFVHDRVQEAAYSLIPEGERPAVHLGIGRLLASRAAPEALEEKIFEIVNQLDRGAPLITSRAERERVAELNLIAGKRARGSNACVLALRYLAVGRALLPEDGWERRYELTFELELHRAECEYLTGDLSAAEERLSALSRRAASLVDLAAVTCVRLGLYTTMDRSDRGVDVGLDYLRRVGVTWSPHPTDEEVRKEYERVWELLGSRSVEDLIDSPQMTDPECRATLDVLTHAQSPALFTDANLNCLVVTRMTTLCLERGNCDASCIAYTWFVVQRARFGLEVDIVTAQLRLIRALRGLLPDLSSFSDADFDERRFERRLEGDPRLAIATCWYWIRKLQARFLAGDLDGSLEAAEKARPLLWTSGSFFEVAEYHFYGALARAARCRAADAAERRRHLEALAAHQRQIDTWAESCPENFRDRAALIGAEIARLRGAWDDAAQLYEQAIRAGRASGFVHHEALAYEIASGFYRERGFELIADTYLREARACYVRWGADGKVRHIDQRNPRLWDARPLAPTASFAARFEQLDQLSVIKASQTLSSEIVLDKLLRTLLTVVLEQGGAQRACLVLHQDERLSVGAEAILEESGEVKTLLPRSGEGASQRVPMSLVRYVQRTKERVILSPTEALDGKFSGDAYFARRKPRSVLCMPILRQAEVAGLLYLENDLLAGAFPPERLTALSLLAAQAAISLENARLLSKEQAARTGAEAAERRAAFLAEAGEILSGSLDYEETLGRVARLAVQSLCDWCITDVVEGEQIRRSLWAHRDSAKESLIEQLRRRYSSALDSPHPAARALRRGEPLLVSGCSEEELRQYCEDDEHARLIHELGVQSLIVVPLMARGRPIGALSVVSSAPGRCYGEADLEIVQHVAHRAALAIDNARLYRATQEAIRMRDEFLTVATHELNTPMTSLTLSLEAMDRSLRSGRPCDPPAMGRQVERALRQVMRLARLNRELLEVSRIDTDRASLDLAEVDLGVVVRDVIARFELDLARAGCSVSLRISGRNVGSWDRSRVDQIVTNLVANAIKFGPGKPIEIVLGEEAGTTRLSVKDHGIGVDPARQERIFDRFERAVSERHYGGLGLGLYISRQIAQAHGGSIRVESAPGAGATFTVELPGAGPPVSPRAPVFSNDSIGSIR

SEQ ID NO: 6109 - protein, 1838 aa, Sorangium cellulosum
MRSTSEAWNRPAVQEARSVEPGRAPSVRPGTAQLKGYHVTAKIGEGPGSTTYRARRDADGIDVAIRMLHTDDARAGDVMRLRHAYRAIRQLDSERVVKVYAVEEHEDGLALVTEAFPGAPLSAKAACKLGVRASLDVLIPVAEALADIHRHGLIHGDVRPTNILLGEDGQVKLTGFGVESIVTREKEEIYCRRVLSKVLPYTSPEQTGRMNRSVDYRTDMYSFGVVLYEMLAGRRPFEALDPLELMHAHIAVTPVAPSEIDPEVPDALSAVTMKLLSKNAEDRYQCAEGLRADLEEIRARWQRGGQIGAFSPGRHDRRDLFRLPQKLYGREGDIRKLVGAFDDVLRGKRTIVLVSGYSGIGKSSLVQEILKPLVREKGYYISGKYDQVNRDTPYSAIVHAFDTLVRQLLSESEERITRWRDAILGALGTNGQVICDVLPSLEHLLGEQPPVPALGPVEAQNRFILYFHNFVSVFARHAHPLALFLDDLQWVDSASLSLLTSVLAREDLESLFFCGAYRDNEVSPTHPFLVALEQLTKGGLEARDIVLAPLGLAHLTELINDSLQTGGGEALAGAIMKKTGGNPFFVKQFMRHLYDTKALVFDPPAGWRWDLRQIERLECTDNVLSLMAETIRRLPQATQRVLRLASAIGNTFEMDVLNTVSERPPDETYASLDHAVAEGLIVSADEQVRFAHDKIQEAAYSLIPEGDRPAFHYRIGKLLLGKPRSDEGRDLFDVVNHLNSAGDLIRAPEERMESARLNLQAAGRAQESSAFTAALRYLEHGISMLPGDAWTSSYELTFTYHTKKGLLESLCGRHDDALSTLSGTFERAVGRLHKTEVRRLKMNVEILKNDLPAAMEEGLAALGAYDIHLPPYPDDGALMAEMERTIAMIGDRPIASLVDLPALDDPEIAALQDVLQEMFSPTYQLGTNNFGITVMKALQNSLAHGISRNSIYAYVNFGTLLCARLDIEKGYEFGRAAVRLNERRPDAKSESMLCNMWGAWVQHWMDPYESSKASLRKGVHAGMETGQYIWAFYNACNASMNGLLRGEHLHDVIEEARQYLPLCKLDKFNAITWIVGAVGQLCEYLSTPDEGDWKRGAWVDIDAVTEAARSIDNRASLYFVNVFKVHAGVFQGAYEEVAEIWGSTDPARLGMLAAWHASPCYHFYGGLAFSRAAGAAAPALRAAYLARLAECARKVESWAALGPESHRHRSLILKAEVARSERREGAGALYDQGIAAAREGHFLHDEALANELCARHYLDLGRAFVARAYMTEAHRLYARWGAVRPMLRLERDFPHALGPEALRRRTDLARDGGADVRGAAVGHGARPGLDFMTMLRASQAVSGELNLDRVIEALLTIAVEHAGAERGLLIRASCGSHAAHDVEAEVVTRRGRVEVTLRQTPVTSSDLPTAILQYVIRTRESVILDDAAVPNLYSEDAYVRGRRPRSVLCLPLVKQGALVGVLYLENNLTPRAFTADRIEVLELLASQSAISLENARLYTQLQQENGERRRAELALREREARIRRLVDSNIIGIAVWDLDGRVIDANDALLCMLGYSREDLTSGNIRWADLTPPEFKEATRRTLEQVRVTGEFGPLEKEYFRKDGGRVPVVIGGARFEGSESQGVAFFLDVTERKQAEERQKLLMNELNHRVKNTLAIVQAIAVQTLRMADSPKAFTSAFLARLLALSQTHNLLNQTAWQGADLHDVVRAELAPHASGDAERVRLVGQDVRLLPEAAVTLGMVFHELASNATKYGALSQPSGRVAVTWDVITQAHGRLLHLEWQETGGPPVRPPRRKGFGSRLIERDLGRQLATEVRLDYLPGGVHCVMDLPFERVGVG

SEQ ID NO: 6110 - protein, 1557 aa, Streptomyces coelicolor
MREGRWVTVTESEFEHERRGLEAIRQKLPDGDPWRAWSNFTFTANTGHVREVDLLVVAPGGLCMVELKDWHGSVTSENGTWVQTTPGGRRRTHGNPLHLVNRKAKELAGLLAQPGAKRVWVAEAVCFTDNGLRVRLPAHDQNGVYTVDELVDMLKQAPSDERRRVTAIGSREVAAALKNIGIRKSDAQYKVGPYELERKSFDSGPTWADYLARHSDLPEAARVRIYLSERGSDASLRQSVENAARREAAVLGRFKHPGAVQLKQYFPSGHAAGPALIFDYHPHTQKLDEYLVQYGEKLDILGRMALVRQLAETVRSAHASRIHHRALAARSVLVVPRSRGGKGRAVGEEAAWLTPQLQISDWQIATQRSGDSSQGQGMTRFAPTALSAMHLADDADAYLAPELTALNPDPVYLDVYGLGVLTYLLVTGKAPAASQAELLARLEAGEGLRPSSLVDGLSEDVDELVQAATAYRPGQRLSSVDEFLELLEVVEDSLTAPAAALDGPAEDETGASADKDPLEVVAGDLLAGRWEVRRRLGTGSTSRAFLVRDLEAETRRTRPLAVLKVALSDSRGEILVREAEAMRRLRPHSGIIRLAEPEPLHIGGRTVLALEYVGDERDDDGPGAEGATRPRRREETVARQLREHGRLPVDQLEAYGDYLFGAVDFLEGEGIWHRDIKPDNIAVRIRPNRTRELVLIDFSLAGYPAKNTDAGTDGYLDPFVDVITRGSYDSHAERYAVAVTLHQMASGELPKWGDGSVLPRMTDPKEWPYPTIAAEAFDPAVRDGLVAFFQKALHRDAGKRFPELKPMRDAWRKVFLDASQTVPSSHRTRPAAPADGAAPAEGAAAGIADAEPETAEQQRDRLAAEVTRDTPLTVSGLTPAAQSFLYGLGITTVGELLDYSRRKLVNAPGLGAKTRNEVQQRQREWGERLREAPVSPLTPKGRAEAKEELEQLTAAESALVGQLATGESAGALSARTLRSVSLDTLATVLVPAVNNNGSNRNKAEMVRLLLRLPDEHGVLPGIGVWPKQKDVADALGLSHGRIPQMLKDERKRWKAEPAVQALRDEIIELLASMGRVASAVEIADALAVRRGTHLAGREQRRAMALAAVRAVVEVEQLVPQEVEFQHQPNRKATDESLGAGLLALDVREDDAPDTPTAPGLLDYATRLGKTADRLARLDTLPTAATVLAELGALTVPPGAVDWDERRMVELAAAASVNAAATPRLEIYPRDLSLVRALRLTQAGLVRWIPGVPEGRQPGLTGEDVHERVRARFPELVVPDGRGGTAHELPTAGPLTKALRDAGFELSLSMREDTGTLRYLPTRVDEASSYLTTGAWRQSTRTGTVTRYADDPQLAGAVRAEERLLASAHRDGYRVLTVRQQLVRDAVRELGAERLGGQAVSVTELFLEALHGQVTPGTKPTWETLLKADAAEPGSKGAVRFAEYARTAWGSVEPRIAELLGDGGGGAGPVLLTEAGVFARYDAMGVLDRLASAARRGGRGLWLLVPQSDPSREPRLGQVAVPYQAGLGEWIQLPDTWVGNRHRGSGEVVASGVEGDAK

SEQ ID NO: 6111 - protein, 1558 aa, Streptomyces griseus
MREGRWTTVTESEFDHERRGLKAIREQLPDADPWRAWSNFTFTANSGHVREVDLLVVAPGGVCMIELKNWHGSLTSENGTWVQTAPNGRRIPHGNPLHLVDKKAKELAGLLGQHGRRVWVGEAVCFTEGSLRIRLPANDQNGVHTVDELVAMLKQPPRDERRRITAPGSRDIKKALDRVGIRKSDAEFKVGPYELKRKSFDTGPTWADYLAEHSELPEIARVRVYLRERGSDATIRRSVETAALREAAVLQRFQHVGVVQLKQYNPSGHSAGPALIFDYHPQTLRLDEYLLQYGEKLDILGRMALVRQLAETMRSAHSSRIFHRALAARSVHVIPRDRGRRDHALGEEAAWLTPGLQISDWQIATQQGATTPGSTRLAPTALSTTHLAEGSDAYLAPELRAPSADPVYLDVYGLGVLTYLLVTGRAPAASQAELLARLEAGEGLRPSSLVDGLSEDIDELVQAATAYRPDHRLSTVDEFLEMLELVEDALTAPSSSPVTEAPEKDPLEAVAGDVLGGRWEVRRRLGTGSTSRAFLVRDLEAEARGTRPLAVLKVALSDSRGDVLAREAEVMGRLRPDSRVIRLVEPQPLRIAERTLLALEYVGDERDDDAESTETGGKRSRRRQETVARQLRDSGRLQVDQLEAYGEYLFGAVDFLEGESVWHRDIKPDNIAIRVRPNRTRELVLIDFSLAGYPAREYEAGTDGYLDPFIGTLTRTAYDSHAERYAVAVTLHQMASGELPKWGDGSVLPRQTDHKEFPYPTVAADAFEPAVRDGLVAFFQKALHRDVSRRYPELKPMRDAWRKIFLDASQTVPSSFSRPASTPVPVSEDGRPAIADAEPLSAEQQRDRLAKDVTRETHLSTAGLTEAAQSFLYNLGITTVGGLLDYSRRKLVNAPGLGAKTRGEVQRRQREWGELLREAPVSPLTARGRAEAKEELAQLTSGEAAVVDALATDGKAAGLSGAALRSVSLDTLATILVPELNNNGANSSKVEMVRLLLRLPNERGVLPAIGVWPRPKDVAELVGVTPQRVYQMLKEERKRWKKDPAVSALRAEIMDLLKGLGRIASASEIADALAVRRGTQLSEREQRRALALAAVRAVVELEQFDPESAQFQHQANRGATDESLGAGLLALDVRDPDEEAGTPGDPPDTPTAPGLLDYAARLGRKADGLAALDTLPTATTVLGELAALAPPPGTVEWDERRLVELAAAASENAAATPRLEIYPRDLDLVRALRLTQAGLVRLIPGSPEGRQPGITGDDVHERVRARFPELVVPDGRGGTTVDLPTAGPLTKALREAGFELTLATREDTGTLRYLPTRMDAASSYLTTDSWGRSTNLGAVTRYADDPLVAAAVRTDERLVASARKDGYRVLTVRQDLSPKAVRSLARESGDGALGAHAVSATQLFLDALHALVPPGTKPTWETLLKADAAEPGHRGAVKFAEYARTAWGSVEPRVRELLAEGGPGTPPVLLTDANVFARYDAMGVLHRLAQAARHGGRGLWLLVPQGDPAREPKLGQVAVAYQAGLGEWIELPDAWVDDVHRSVPAARSGVQQHQGETK

SEQ ID NO: 6112 - protein, 1421 aa, Thermobifida fusca
MTDRWWGERSEHPWEQEALEHIKALMPQRDPYRAWQCFSFTAASGQIRECDLFIVTPAGAFLVEIKSQPGRAINRGSTWTFYGDRVRTIDNPLYLTDKKAKELKSQLEWAAKKLGIRDYRLPYFTPAVFLSAPDLRCDFDEIQRQHVYGREGLDKQTGLPGIWSGLLNRRTHRSPDPVFFRSITRLMETIGAKAIRRDLTAGSYTLQRRAFDSGPTWTDYLGKHTVITNKHSRVRIYHYRPDADEQTKKSVLRAAEREYRSLVGVAHEGIVKAEDFVEVEGYRPAVVFEHRESWQRLDHFMQEKGADLDVYTRVEMVRQLAEAVNHAHRNRLFHRALAARSVWVELDGHYPRLRIADWQTAARQGIGSLGHTQHVGQTTVHALVEHIEAAAQAYLAPEVNAPNSDPRALDMFGLGALTFLILTGQPPGNDRREFNEHIREHGELSPAAVSDDIHPLMDTLVREATRLIPTERTSSPREFLRRLEEIEELLTRPEVVTSPLEATKGQEIIDGWKVESVLGKGATSRALLVSRNGEQRVFKVAVNDSAAAKLRREAEQLRRLRDRRIVAVIGDDPVMTIGEHTVLQLELAGEVTLADYLRQEGNLGIEELRRFGIDLFEIADYLEDQKVFHRDIKPANLGVRERTKKSRELVLFDFSLAGTSTRETQAGTPGYLDPFLAEGNRSYDSAAERYAIAVTLHEMASGDLPVWNEEGVEPHLLPDSVEYPRLSEEDFPDQVRASLTEFFRRALHRRPEQRFATLADMREAWEQAFQNIEASPVTTPDSLELAEVDDEATRRRNAENATADTPLVVAGLSPDALDAATRLLRCETVGDLLKKPVAEIRRLRGVPLRARNELARQANRWRRKLAHAEPLPKVSAKLSVDGASEEEKELALENASLDKIIRQFLPKTTERNRDWVRTVRELLGLPEDALAEPVWRTQKEVARRLGLQQATVSRHLAEARQYWVKNTPSQLRTAVRDDIVEILERHGRVREVRQIADELLSKRGTSAEIPETRKAYALAAIRVVTECEERKQKESPVFVLRRLYTHSDTPKVLVAQVIENDPTVPVEADLLDYAAALGREADRIVRFDDDAPLPSPAEVRQRLRGVPTKPGMAPLSDVDLVTLAAAASENAQATARLELYPRSLSLKRVLDIVQVASYLGEPGITPQQIVDRVRARFPHMDPPGVHVIRRQLREDFPNLESRTASDGTEYWYLPRTAITRSITYSAISAGGGYEPPSEHESARRRLDQAVARGGYLAVKTWMSEAERVAELLAARPDVAAFDASAEFVRVVTEMINQYGGPPWDVVVAADVPGGPPEFGNMVAEACMILGDRIRAAGQDRPVFVYGATPLARYPAGRDLLRTLAQQARESGTAPYGLWLLCPMGNPYRPARLDDEPAGAITDAEQLRLPRGFGAEEPVLVG

SEQ ID NO: 6113 - protein, 1387 aa, Thermobispora bispora
MEPGSKRWIEVTPSQHAHERGGLAAIRALLPDAEPYRAWSNFTFTTKGNRQYEVDLLVIGKAGIFLLELKHWSGTITGDHQTWFHNGFAEDNPRILAESKAKHFKQLLIETGERAVPFVYAGVVLHNPEAQVRLTERGRAGVYRIDGQGPAGLPELIKDLITAEPRNPHHLIDAKRSQDLAKLIKKAGVRQSMQFRKVGNLLLAEDPIAEGPGWQDYLAKHPMLDRPRRVRFYLVNKAASPNERAAIMRAAQREFIVLENLNHPGIARAIEFYEHERGPAVVFDHDPTETRLDHFMRQKGAALTVEQRVDLVRTLAQTLRYAHSRRLVHRRLSPLSVFVRNLAQGKYGVRVRDWHTAGRLMPGTPGHRAQVAGTRTLDALTDKGAHGYIAPETLHSPDADPILADIFGLGAVSYLIFTGAAPAESSEQLHQRLARERGLDVRVALDGAPQAMVDLVHDATAADADLRIASVDEFVERLERLAQEVTAEQAAAEQVDPLEAVAGSRIGPADDPTRFEVIQRLGQGSTALALLVKDPVHGQAVLKVAIDEEDARQRLLDEAEVLPLARDPRVVRCLEGPMTVGGRTALLLEDAGRETLAALIRREGRLSLDFLARWGTDLLDILAALDLAGINHRDIKPDNLAFRELGKNREVHLTLFDFSLSRAPLEQTAVGTPPYLDPFFDPVHRPRYDAAAERYAAAVTLYEMATGQTPIYGSGTSHPAVIDSDVTIDPEDFEPGPARDPLIAFLRKALARDVKQRHDSIESMRLEWRAVFEAVPPAAATPASVNPVTGKELDEAAARATLDTPIAAAGLTPRAVDALHRIDVRTVRDLLARSPFELSRLSGVADPTKREIRRRAKQWRARLQPATPEPIGTGEPADDLGRGVDAVLRSLLPKGVKPDTAEAQVLRCYLGLEETESAWPTNAELGEAAGVTAGRVSQILPKARKRWRQSKALAEVRDEIVHLVTEAGGVLSAEAIAETLLTLRGSAAAGDQRMRRALGLVRTAVEVEAERGGEARLLHRRTRNSAIVALEEPTDPDAVAGTDLLDYAVRLGRVADRLAAEDPLPTAEQTEAQLRKVRLPQGMAELPAERLAALAAAASERAAANGRGEIYPDGLDPRRALERLSSSFGVIRYGLTPDQLKARIRVRYPRVGPLPDDLQDLDALLRLARVPLVFQDGVFWPRRDVQSSVLVPSTHGSFTRLAGPVADRDSADFERRLTASLEERGFVTISASFRAYPEAIRALAGRFGVEVVDVTAELLVAMRTTAEANNVDWSLVLRADRPDAAPQDAANLRLLVGLAATGLEERLRTDPRPLLIIEAAPLARYDRLAVLEQLADKATDRPAARWLLVPVEQDGRPYLDNRPAPGALGAVRLPSAWLVQQRRQAAS

SEQ ID NO: 6114 - protein, 1385 aa, Hahella chejuensis
MDKFWKQITTSDHTWEQEALDFVKAALPDHEPYRAWANFEFITKEGFVNEVDLLVHTPKGLFLVEIKSHPGVMKGDAGIWIWEAPEGKRKAFDNPLLLTDRKAKKLASLLQAQDAARKSSKERIPFITPVIFLSAPNIVNKLEGNGRKQVYTRKNFIEEITRIDDSWKHKKLDKVSAKTVSQAMLQAGIKESLRTRRVGQFDLAELLDETDLYQEWLGRHVDTQVRRRVRIYLTQGKAADEAARLDKAAHLEAQLLEGVDYPGILKTLEFQRHDHGPALIYENFDGSQRLDHWLLKQDEGKRLDQSVAVSLLRSIAETVKYAHSQKLYHRALSPQSIFIKEENGEFKIKIANWATAQRIFETESKHISAFSKLTRMVQEESGSYMALESHTLEEADGTQLDVFSLGAIAYHLFTGKKPAANELELQDKLGKDGLQVTDVINGASSWVSYLVQYATHPDPGARLDSVQDFLDYLTEVENDITRPEGEVTQKPTEAKKGDTFEGGYTVIKRLGRGACSVAFLVEYQGQQRVLKMALDPEHNRRLHQEGETLGQLRHQAIIAHHKTLDILGHTCLLIDYATGGTLAQRIRRTGAIQLELLERFGDDLLSAMVHLEDKALMHRDIKPDNIGVTELGSQLHLVLFDFSLSNAGTDNIKVGTMAYMDPYIRDAGRRRWDDYAERFAAALTLYEMAAGTLPGWAANQGLPIDLEHELQLDASVFDPSIRSSMAKFFQRALARDLGSRFATAADMLRAWRQVFLQASKESRHPTVHGEVPTCPVEEAQQDTQIGLLELSPQALDALSRRNLNTVADLLKQNRSKVRAWPGVGIKTRNEVSELIRKLQEKWPNEVAQPVSQHDGAQQASVDRLFGLIYPKTPDISRRSFLNEFLGRLDSEAPKGHHNVHWPSITMLCSEINMEAAEARQILSKLTTQWGKLSEVNLLRNEIVEILTENGGVMTAIELADAVLLRRGSVEDNPIRSRHAQAVVRAAVETEISKQQPRWILRRFGNRYVIADNQQEQGEDLATYAQDLGQLASECALKQPLLSPQATLDKVRAVPAPETFTGLSTHRLLRLAAAASEQAALSSRAEFYPRDMEAAQALELAQGALLGSKALTVAEVQVRVKGRYPAAKPLPGRPHLDDLVLKLDMGFLWDPNYETFDKDGKKQLGAYCLPITSFTEYQATQTKTSLTQQTDWDGEAWQDEKSIRQSISNSLRDGRFLALGVRPRDMEKAKIKLCSTYGLVSFSFDELLLRRLHQHCAAMKNPPNWQVVLKADAADQTSRDWVNLQRLVHQVLPSIADEIKQSDKPVLLTEPGLIARYDLIHTWLNELRQHLANTGHVHALVLLIVGDAQQHAPVIDGKVIPLEAGNSIYARLSGSWVKPDQPQFSN

SEQ ID NO: 6115 - protein, 1449 aa, Saccharomonospora glauca
MSDGRRPTPKPAPPPPKQRWFQERTSPYPWEQDGLDHIRRLMPQAEPYRAWATFSFTAASGRVNECDLLIAVPGGLYLVELKGHTGRVVNNGDTWIFYDEGARRPRTLRNPLHLTDLKCKELKQRLEWAAKQNHYTGRIPRIEPAIFLSAPGLTSELDEVQRTRVYGRDGQVDGLDWIWRDLLSRPPQREHQRISPEFSRHVLPKLLEKIGIRASTAHLRFGDDWELSGEVLDAGPTWEDRLAFRTGLVREEGRVRIYLTEQQAAEERRQSVERAARREYQVLQGITHRGIAQAVQIREHQSGPAILFRHSSSDLRLDSYLDVHGERLSIDTRLDLVRQLAEAVQYAHHRSLYHRALSARSVWVSAKDDGSDPVLRITDWQAAARDFDTTSLSTVGKTSLTGEHLAGSAEVYLAPEFAPHADPVDLDVFGLGAVSFLILTGQPPATQRSGLIEWLADSHGLHPYAVSDGISDALDALVFDATRTELSQRLESADAFLKRLDAAEWESLPESSVPVVDPLTVSAGQMVDERWRVERVLGTGATARALLVRRVDTDDEQPERRVLKVALDDDKAQHLHAEARALALAGGGVVVQLLDGPREVGGRTVLDLEYAGGQDPQGYTLGEHLRAEGRLSYHNLERYGRDLFIALDQLAGKGVRHRDLKPDNFGIYRRADRSTQLMLFDFSLADVSERDVTAGTRGYLDPFLGTNRRPAYDDHAERYAAAVTLHEMASGQRPVWGDGVSDPRTTTDETPVLAAELFEPALRDGLTAFFRRALHRDVNRRFDTVRQMEDAWREVFTAADTAQPLTTPDTVGVEGETLEATRDAHAERATLDTQLDVSGLSPRAASLAQSFGVTTVRELLEQVRPYEISRARGAGKVVRNELNRRHKQWTRALLQPSEPDRPEPESPSGRSTVDELVAVLLPPRGRRGSRKADVVRLTLGLPAGEGEQPPPPWPTQTEVARRLGITQGPVSQHYRAAVKAWAAEPRLSAVRDELVELVAEAGRVMPAHELAATVRARYGVAERDTREHALAQALAVVRAAVDTEAWERQQSEDEDGPRFSALRRGEHVLIALESLPGTDAPSAPELADYAVALGARADELVELDPLPGRGVVVRELRAVPAPEGLPSQADTRLVELAAVMSRHAAASARSELYPRELDLVRALRMSQAAVGVRRDAGITLGDLLAKVRARFPSVAVDENITYVRLEEALREAGTPLEWDIEAQRFRPPAPEFSRLAASSSLTRGGPGPRWSGGLDPQDVLHDKLTRAVEYGGFVALTLWGANLPGAAESLAARYAVRAVHVDGEFLAAFRELVAEHGQDWELVRKLDERFGRTGRPKPGFRRYVQQAWERLRDRLEASSDGERTVLLLHHAGLVGRYADLGGREFLTGLQQAARSARAWPHGLWVLCPGESKREAPQLDGLRVEALTEAERVVLDREFLHGPRGADRAS

SEQ ID NO: 6116 - protein, 1379 aa, Rhodococcus triatomae
MTTGGDVAQGSGSNRQGDRWVEVSKSAFNHEAEGLSFLQDIVPNASPYRAWTNFEFMDNHGMWHEVDALVLGRRRLHLIELKHFVGRLGGTETNWVRHLPSGKVRTQRSPLLLTRRKAQRLATRIEEEARKVAIENGLNPEKVRRALPFVQESVFLHAEGFSVEMSEVAKSGLFGLDGEEHRSNLPGISTRILESPTDGRRVDEDISVIVALALKNLGVSRRTERDAGSWTISGAPLASGDDWQEWPAKHKGTDEPARARIVSFRPGTPVHARAAAHRKMGREYTLLSSLRHEAIVAPRDLVQDDDGNTVLVYPETPGYEPLDLALATRTLTAEQQLTVLTSIAEALAYAHRNHVAHRGLGPSTVLIHTERLDAGRVDVRLVDWSWAGRIHDGGTKSATMLGTALTATGGAAADEVYQAPEDRWAPDSDRIALDVFSLGALAYFLLSGGQNPARDRAALLERLRLEQGLDLAASTGRFVDEQLRELVLRTTSPSVSKRVAVDAKSGRPTFGAQHFAAALDDYRRAQEPAAAAPEIDPLNPPTGALLDDRFEVLQVLGSGSTARGILVADHDADGRQRVLKVGLDDTAAHRLQNEAEVLTTLAQQQPPVPGVVELIEGPLQLAQRTALLLSNCGEQTLADVVRYTPLGEAQLKTWGLGLLDAVVALDAAGITHRDIKPSNLGLSRPTGKRNEKPKLALFDFSLSRAAVEQTDAGTPPYRDPFLGTGIRTAYDSAAERYSAAVVLYEMATASTPLYGDGVSDPRVLADDVSVSAEDFGGHSRTRAEALTTFFRSALARNVKDRFDTAAAMRAAWAAVFAAKATEPEPVVQPPAPTPTEPTPPPVVVAEPATYRSLRVLSAEFARAAATKPSAIRRQVVELLLGSHPDSPADPFVTYQVLAPLAGVTPGRVAQIFGEMRDLWSKNPQLAATVDLLFQRGITLLESTGGASTPEVLARELAASLDTDGVPDPQRTALGVLRLVLTSAAEPEPGSEDDDPRPLLTRRQSTGSVAMIATNAVSRRLPAVLAREVDGLVAAAEDQGLALVTAEHAEQPLRAAAAAALDVAPEEVEIPGYVLLRIAAGSSVQVALSARDELHSVGLPIRDVLALLLQGLSTSDAFGRPELESRVAARFPALAKSLPRRPDLDALVASVAPGMAWSDARNRYEFEDAPQRLSHVPTRHTLAGSPAAAGQKGSDVELLLHASARERTFRALGVPMGASDQVADALVERFGAVRVDVTDVLLGELRSKAAQAGIPWDAILAADSGAAADREGLKGFVAQSIPAVVDAVNAAGGPVVLTDLSTLAAYGQLGALQAWVDVTNPPPHAVWALIPQPEESGGRPGARVDGTALPRTTPEQFVQVDRFGLRALVSTDDRSMKEHV

SEQ ID NO: 6117 - protein, 1449 aa, Saccharomonospora cyanea
MSDGRRPTPKPAPPPPKQRWFQERTSPYPWEQDGLDHIRRLMPQAEPYRAWATFSFTAASGRVNECDLLIAVPGGLYLVELKGHTGRVVNNGDTWIFYDEGARRPRTLRNPLHLTDLKCKELKQRLEWAAKQNHYTGRIPRIEPAIFLSAPGLTSELDEVQRTRVYGRDGQVDGLDWIWRDLLSRPPQREHQRISPEFSRHVLPKLLEKIGIRASTAHLRFGDDWELSGEVLDAGPTWEDRLAFRTGLVREEGRVRIYLTEQQAAEERRQSVERAARREYQVLQGITHRGIAQAVQIREHQSGPAILFRHSSSDLRLDSYLDVHGERLSIDTRLDLVRQLAEAVQYAHHRSLYHRALSARSVWVSAKDDGSDPVLRITDWQAAARDFDTTSLSTVGKTSLTGEHLAGSAEVYLAPEFAPHADPVDLDVFGLGAVSFLILTGQPPATQRSGLIEWLADSHGLHPYAVSDGISDALDALVFDATRTELSQRLESADAFLKRLDAAEWESLPESSVPVVDPLTVSAGQMVDERWRVERVLGTGATARALLVRRVDTDDEQPERRVLKVALDDDKAQHLHAEARALALAGGGVVVQLLDGPREVGGRTVLDLEYAGGQDPQGYTLGEHLRAEGRLSYHNLERYGRDLFIALDQLAGKGVRHRDLKPDNFGIYRRADRSTQLMLFDFSLADVSERDVTAGTRGYLDPFLGTNRRPAYDDHAERYAAAVTLHEMASGQRPVWGDGVSDPRTTTDETPVLAAELFEPALRDGLTAFFRRALHRDVNRRFDTVRQMEDAWREVFTAADTAQPLTTPDTVGVEGETLEATRDAHAERATLDTQLDVSGLSPRAASLAQSFGVTTVRELLEQVRPYEISRARGAGKVVRNELNRRHKQWTRALLQPSEPDRPEPDSPSGRSTVDELVAVLLPPRGRRGSRKADVVRLTLGLPAGEGEQPPPPWPTQTEVARRLGITQGPVSQHYRAAVKAWAAEPRLSAVRDELVELVAEAGRVMPAHELAATVRARYGVAERDTREHALAQALAVVRAAVDTEAWERQQSEDEDGPRFSALRRGEHVLIALESLPGTDAPSAPELADYAVALGARADELVELDPLPGRGVVVRELRAVPAPEGLPSQADTRLVELAAVMSRHAAASARSELYPRELDLVRALRMSQAAVGVRRDAGITLADLLAKVRARFPSVAVDENITYVRLEEALREAGTPLEWDIEAQRFRPPAPEFSRLAASSSLTRGGPGPRWSGGLDPQDVLHDKLTRAVEYGGFVALTLWGANLPGAAESLAARYAVRAVHVDGEFLAAFRELVAEHGQDWELVRKLDERFGRTARPKPGFRRYVQQAWERLRDRLEASSDGERTVLLLHHAGLVGRYADLGGREFLTGLQQAARSARAWPHGLWVLCPGESKREAPQLDGLRVEALTEAERVVLDREFLHGPRAADRAS

SEQ ID NO: 6118 - protein, 1388 aa, Gordonia polyisoprenivorans
MADDRWIEVSTSAFAHETEGLRLLREIVPSASPYRAWTNFEFMDNHGGWNEIDALILGRRRLHMVELKSWNGVLSGNEKNWILTGSNRQSRTQRSALLTTRHKAQKLASRLKDEVRKVAQEHHLNVDKVMRQFPFIQEEVYFHGDRFAVNLSDLAKSNLFGIDGRESQTGLPGIAARLLEPPNEGRDVYGEDMSVIIALALRELGATRRTERDAGSWTLTGETLDSGDDWQDFDVVHKVTGVHGRARIVTTRRGAPAQARAAARRRIQREYELIRSLRQESIVPPLDLATDDDGNAVLVYEKLDDFAPLDLALLTRTLTAEQQLEVLTQVAEALAYAHRNQVSNRGLSPSTVLINTSCLDDSGAIQIRLADWSWAGRIHATTSASPTLAGSQIAGTTSDDDVYQAPEDRWSPTADRMAVDLFSLGALAYFVLSGEPPARDRTDLRTRLRAQNGLDLAAVDGRFVDERLRSLVLHATRPSVSERVDLDAKTQQPRFGAAEFRSALQEYKSDSGPDPEVRTDPLNPQPDDELADGRFIVLKVLGAGSTARGILVADNAADGEHRVLKVGLDDSKTARLYEEAEVLTALGELTPKVPGVVELLEPPLHIGGRTALLLSDCGEQTLSDIVRHTAVSDAQLKLWGTQLLDTVVALDAAGIAHRDIKPSNLGLAKHASAGKTKRPRTSLALFDFSLSRAGVTETEAGTPTYRDPFLGMGTRTAFDSAAERYSAAVVLYEMATGTTPVYGDGQSDPTSITNDVTIDVESFIDAGLSQTRADALAAFFRTALAREARTRHDTAAAMRDAWRAVFDARSPAPTTDPTPVKPQGAKAYPAPVIVIDAPDDVSMQPAFTSLPEFVSALTELAGRRPSVMRRQVLEMLLGTHEDAPDDPFVTFNELALRVHLTPARISQIFSEFPALLSTDDPVRAFVTGRVKATVDDLYQRAQTLLTASGGASTPELIARELVGQMQIGDLHDVGRTALGVLRFVLACAPKPTVEDTTAADAQPTGIEMVRRQGAGTVAMLATAAIDRRLPAMLARRAERLVAEAQEQGTTLVPSTDAAPELKDEVAAALGIAQQSEVEIPPHVLLAIAVTSSPELGLSSRNELHSASLPVESALRAVLQGLSDTDTFGRAELETRLLARFPALRGALPRRPALDAVVATVAPGMVWDEPSARYRFPRTDEPKGSTIPTYRTRTPHPNKVVGPRSDVLSALGAGERGGGERRFRALGVPIGHSDAVAEALSERFAATRINVTDVILDAMRARAAEVGLDWSMILAADAGATADREGLKGFVAQCAPAIIDVVAAANGPVVLTDLSTLAAYGQLNIVSAWTDLAAPPPHSVWAMIPQPHTTGGAGPLVDGVALPLNSPEQFIPLTDDDVGALIAPADAAP

SEQ ID NO: 6119 - protein, 1452 aa, Amycolatopsis azurea
MTPGANSGSSSVRWYQRKQSDYAWEQEGLDFIKRQMPDAEPYRAWATFSFTAASSRSNECDLLIAVPSGLYLLELKAHPGRVVNHGSTWRFTDRHSGRVRTLPNPLEMTNLKAKELRGQLTRAAQKVGYTGRVPWIEPIVFLTDAGLRSELDEFQTPNVYARHANSGLPTVWDDLLARPPHREADRIRPEFASRVLPQLMTAIGILPATAHLRYGDFWKLDPKALDAGPFWEDRLVRRDDGQLDEQGRLRIYLISSGTSKADAEKAHRAAKREYQVLQGIDHRGIAQARQFGEHQGRPAILFRHHESDLRLDAYLATFSDSLTSETRLGLVRQLAEALKYAHDRMLYHRALSPRSIYVSCRPDGSSPVLRLIDWQTAARDFETTSLRSIGDSSLDGAFIEDTALRYLAPEAEHQYPDPVEMDVFSLGSVSYLVLTSRPPASSRSELVERVGTDGGLQVSAVDDTLPPEIGDLIYDASRSDVVLRLDSAAAFLDRLDDAEEDATPMPAGRSFVDPLEAIAGQEVDEEWFVRRVLGTGATARALQVERLRETDDGAVVDERVFKVALDEDSRAARLHDEAEALRKVTGGTIVQLLDGPRLIGGHTALELELAGEVSLAKHLREEGRLSYHDLENFGRELILAMYQLEAAEIHHRDIKPDNLGIHRRANRSRQLKLFDFSLAKASPTDTVGTRGYLDPFVHTTRRQFYDDHAERYAAAVTLYEMATGERPLWGEGINAPTVTQDETPQIEGHLFDDRLRDGLTAFFKRALHRDTAHRFTSLREMDDLWRSVFTEADKARPATTQETVRNTAADRSDIEVLDRAAEAAKLTTPLSAAGLSPRAASVADGLGATTVGELLDIPASTITRARGAGALTRRELTRRHRQWSAKLRTDTGAADGPDSEKLAVPVDVERQSVELLLERLLTKPKINSKDKGPNVERLTLGLPRVDGSVADISTWPVQRLVADAVGLTQPSVSTKYVSSLRKWQTFDWMDTIRREVVEVLGDLGRIATAPEVAAEFLARHGSTENDPVIALRNASAIIRAAVDTELLLPGKDDLERSEPALAVLRRNDRVLLAAESLDGSDDPSPSELGDYAIALGQAADGISKRDPLPSSATALRDLHAVERPEGMSPLADTRLLSLAASMSAHSAASRRLELYPLDLGLVRGLRISQAAAGVSDDGITLDALLAKVRVRFPEISLGTPSPIDVGEALRDAGSSLTFDPVKNRFCPPRPAESLRPARSSSRTLTSIDHAALNTGRSSSELITARLVDGHRLGGFLALKVKAKNLPGTATLVASEHDVEAVDLGRLFLTELRALVKERNQGWDRVLVADTRVGRDGTVPPGLASYVSVSWQRVQNRLMATMAEAGPRSVLFLHNAGLIGRYFDAGGHSFLTELQRAARDPQATPHGLWLLCPMETAGEAPSLASQIVGTEGDHEVLLLRSKYLDELHKGEVA

SEQ ID NO: 6120 - protein, 1393 aa, Marinobacter sp.
MDMLWKQITQSDYAWEIEALEFAKQLLPDHDPYRAWANFEFIALDGSINEVDLMVLTPKGMYLIEIKSHPGVIRGDASNWVWEKPKGGQKIFDNPRLLTRRKAQKLASLLKVQASVIRSKERVPFIEALVFLSAENLTIKLDDNARQGVVNRTELLPELTQVNESWSHKQIPVSSARVITRAVEEAGIKESLRMRRVGSYELKHLLSEADNFQEWYAVHSELGVERKVRIYLTQGKAEADVKRLEKAAQLEFRLLEGIEHPGIMRAKDYLHHDSGPALVYEYDPMAFRLDHLLMNLGQSRRLETTQALYLLRLIAEAVKYAHGQKLFHRGLSPQSVWVKPLGDEKYDVKISNWATAERVYENETRHITAMSHLSQFVQEDAGCYAALEAHGRAADGVHLDVFSLGAIAYHLFTGKKPAESDIELLDKLRHSKGLQVTDEINGASEGMQYLVQYATHPDVGSRLESVTDFLQHLDVLEDEISQPDTLRSNNPTEARKGDTFAGGFTVVRPLGKGACSVVFQVQYQGQDRVLKIAATPDHNSRLIKEGNVLAKLRHQSIVAYHKTLDIGGHTALLLDYASEGTLAQRLRHVGAVQLELLERFGDDLLSAIAHLEDQALVHRDIKPENLGLVMQGSALHLILFDFSLSSVGADNVKAGTLAYMDPFIRDPGRRRWDDHAERFSAALTLYEMAAGALPGWAVAEGLPPLLEGELEVDRTLFDPSIRDRVVDFFKRALIRDARERFASAGDMLREWRKIFHQARTDTQHSTVHPGQRSCPINEARLDTQIGLLELSPQALDTLSRRNINTVAELIKLNRSRVRVLTGVGVKTRNELSEVIGQLQERLLEAQQRVQFDAGDTSIVSVDRLFQQILPKVTKATDPTRLRFLHEYLGRLDDDSPRGLHNVHWPTPAAISGYLGIETLMVRELISKVSVQWGKTKTITDLREDIAGLLEDNGGVMTAVELADAVLLRRGSVQDSPLRERWAYAVVRAAVETELSKQEPRWLLRRSGSRILIADNRQGWAEELADYANDLGDLADECANQYPLLSPVRALERIRAVPAPESFSELSNPRLSRLAAAASQQAALSSRAEFYPRGLPAKRALELAQGALLGSKALAVQDVQARVAGRYPAAEALPKRPQLDALVLALDIGFKWDAQFEFSNGNKGAYCLPSVGLTSFATGTTSYSAVTQQSDEDSASLREVKELHKRVQQVITASHFLALTVRPRQWQQAQLKLCADYPFKLISFDELLLRHVHQVCSDMPRAPDWQVVLNADSFDRASRDWQNLQRLVHRALPAMTQEILTAGQPVLLTDPGLMARYDLIGTWLADLRMQLMQENNGSSVDLPGLALLIAADDQFTGAAIDGSLVPTGAGSKEYARIPGSWFDYDVNTRKEGAA

SEQ ID NO: 6121 - protein, 1284 aa, Saccharopolyspora erythraea
MRSELDEVQRAHVYARSEDSGLPEIWRDLLAKPPQREHQRVRPEFSRLLRDLFATIGISAATSHLRFGDNWSLWPEKLDAGRTWEDRLAERSVPVKEEGRVRIYLTAQQASEKQRQSVERAARREYQVLQGINHRGIAQAVQFAEHGGSPAILFRHRHADLRLDSYLDLFGDRLSTEARLELVRQLAEAVQYAHQRSLYHRALSARSIYVSARDDGSQPLLRIIDWQTAARDFETTMGTSSLGNSSVTGEHLADSSEVYLAPDFDTPYADPVDLDVFGLGALTYFLLTGSPPATQRSALIDRLRKNQGLRPSAVADGVSDELDALVFEATRADPMDRLTAADEFLKRLDDAEKKSVPVGVASDVDPLDVSAGQTVGGEWDVVRVLGTGATARALLVSRIDEDADGEPRPEYRVFKVALDEDKAAQLRAEAEALTKVGGGVVVKLLSPARQFAGRTVLDLEFAGGFDLEGKTLGETIRAEGKLSYHNLERYGRDLFNALDILAGHGVWHRDLKPDNFGVFKRADRSTQLMLFDFSLAGVSERDVKAGTRGYLDPFLGTSRRPVYDDHAERYAAAVTLHEMASGQRPEWGDGMTDPRTTADETPNLAADLFEPDLREPLTSFFRRAFHREVDKRFDTLKQMDDAWREVFRKADRTPPLTTPGTAEADDASLPDLREAAAKSATLETPLDAAGLSPRAVSVANSFEAFTVGDLLRVPPYQISKARGAGALVRRELNRRHTQWSKVLLAGATPQRPQVEGRAPTIDDLVEILAPKPRRGSPRPEAIRLLLGLPGEDGTPPPWPTQSDVAKALGRTQATVSRHLNSQAKEWAADEHLTAVRDDLVALLGEAGRVMTADELAAALRARRGSVEQDSARAHALALAVVRAAAETEMAAQGTDAEPRLLVLRRAERVLVALESLSDSSDPSAPELADFAGALGSCADELVKLDPLPGRGVVVRELRSIDAPAGLPVQADTRLVELAAAMSRNAAASPRLELYPRDLDLVRALRISQAPAGVRRGVGIAVDDLLAKVKARFPLLELGESITYVQLERELSAAGFPLVYDVEKARFTQPEPESSRSVGSSYTSVTSTEQRSDPSEQAHAKLTSALNKGGFAALTLRGVHLPGAAESISSAFPVDSVHVDELFLAQFRALVKQHDVDWNDIRALDNEFGATGVIADGFASFVEVTWENVQEELARRASSSVLFLHHASLLARYYNRGGRDLLTELQNAARRPDSRPHGMWLLCPGDSAWETPRLEQHIVEVLGESERVVLDGAFLAGLNAGEGAA

SEQ ID NO: 6122 - protein, 1570 aa, Streptomyces turgidiscabies
MREGRWVTVTESEFDHERRGLEAIREKLPDSDPWRAWSNFTFTANTGHVREVDLLVVAPGGACMIELKDWHGSVTSENGTWVQTTPGGRRRTHGNPLHLVNRKAKELAGLLALPGNKRVWVAEAVCFTDNSLRVRLPVHDQNGVYTVHQLVEMLKQPPRDERRRVTAIGSREIEAALKNIGIRKSDAQYKVGPYELERKSFDSGPTWADYLARHSELPEAARVRIYLSERGSDTSLRQSVENAARREAAVLGRFKHPGAVELKQYFPSGHNAGPALIFDYHPDTLKLDEYLVQYGEKLDILGRMALVRQLAETMRSAHSSRIHHRALAARSVLVVPRPRGGKGRAVGEEAAWLTPHLQISDWQIATQRSGDSSQGQGMTRFAPTALSAMHLADDADAYLAPELTALNPDPVHLDVYGLGVLTYLLVTGKAPAASQAELLARLEAGEGLRPSSLVDGLSEDVDDLVQAATAYRPGQRLSSVDEFLELLEIVEDSLTAPAQAATAGTEEPGDEDDVTAADKDPLEAVAGDTFAGRWEIRRRLGTGSTSRAFLVRDLQAEARRTRPLAVLKVALSDSRSEILAREAEAMGRLRPHSGIIRLVEPEPLHLGGRTVLALEYVGDERDDAGQGTEGGSRPRRREETVARQLRDNGRLQVDQLEAYGDYLFGAVDFLEGEGVWHRDIKPDNIAIRIRPNRTRELVLIDFSLAGYPAKSTNAGTDGYLDPFVDVITRGSYDSHAERYAVAVTLHQMASGELPKWGDGSLLPRMTDAKEWPYPTIAAEAFDPAVRDGLVAFFQKALHRDAGQRFPELKPMRDAWRKVFLDASQTVPSSHRSRHPAPATAGEGTPAEGAVAAAIADAEPETAEQQRDRLAAEVTRDTPLTVSGLTPAAQSFLYGLGITTVGELLDYSRRKLVNAPGLGAKTRNEVQQRQREWGERLREIPVSPLTPKGRAEAKEELEQLTAAESALVGHLATGESAGALPARTLRSVSLDTLATVFVPAVNNNGSNRNKAEMVRLLLRVPDEHGVLPDIGVWPKQKDVAEALGLSQGRIPQLLKDERRRWKAEPAVQALREEIIDLLVSMGRVASAVEIADALAVRRGTHLAGREQRRAMALAAVRAVVEVEQLLPQEAEFLHQPNRKATDESLGAGLLALDVREDDGPDTPTAPGLLEYATRLGRTADRLAKLDTLPTAATVLAELGGLTVPPGAVDWDERRMVELAAAASLNAAATPRLEIYPRDLSLVRALRLTQAGLVRWIPGMPEGQQPGLTGEAVHERVRARFPEMVVPDGRGGTHHELPTGGPLTKALRDAGFELSLNMHEREGVLRYLPTRVDDASSYLTTGAWRQSTRTGAVTRYADDPQLAGAVRAEERLLASARRDGYRVLTVRQQLVRDAVRELGAGRLGTAAVSVTELFLEALHAQVTPGTKPTWETLLKADAAEPGSRGAVRFAEFTRTAWGAVEPRIAELLGNGGGGAGPVLLTEAGVFARYDAMGVLDRLASVARQGGRGLWLLVPQSDPSREPRLGQVAVPYQAGLGEWIQLPDTWVGNAHRGSGEGAASSSASASGVEGDVK

SEQ ID NO: 6123 - protein, 1390 aa, Gemmata obscuriglobus
MSPKTNWVTVTDSRYQWERDALDFVRDRWPDHEPYRAWSNFEFIALDGSINEVDLLLLTPMGFFLVEIKSRPGRVSGDAGTWTWDTEGRLVTVGNPLLAANLKAKKLRALLERQKAVKVKGGLPFVEPLVFLSAPGLQCDLRDTAVYGVCLRDADAEGGRPERAGILAAVKRRECPGLKPKHGPFIDRPLAKIVSQAIQQAGIPNQHRQRRVSDYVLGRLLDEGPGYQDWEASHVQNVGGKRRVRLYLVWNEATADDRQMVERAARRDYQLTEALQHPGVLRTLGYTEHEIGPAVVFEHDPNALRLDHYLAQRGDRLGADVRLDLLRQIAEVVRFAHEKKVVHRGLCPRSILVHDPDGPRPRVKVHNWQVGYRVGGSSSGGTRDITATSHVDLLVEDAGTAYMAPEAVLPADTAGEHLDIFSLGAVAYHVFTGTPPAGNRLELAEKLRQTRGLLVSDALNGAAPSLQELVQYSTHPDVTSRVDSAADFLAGLDLVEEELTAPTTDALVDPVRAQKGDALPGGFTVVRRLGQGGTSVALLVEREGEEYVLKVPNTADDEPRLRAEGEVLAKLRHPHVIEYVQPQKLSGLPYLLLRSAGPETLGQRLRKEGRLHLDLLQRFGEDLLEVVKYLEEQGIPHRDIKPDNIGVGPVGRGDMLHVVLFDFSLSRTPPENVEAGTKAYLDPALPRRKRWDLAAERYAAAVTLFEMATGTLPRWGDGRSEPSQLDCEATVDEELFDPTLRDAFVLFFRKALRREARERHDNADEMLRAWRDCFAAIGPPDAGELNEEELRARLEGATFDSSVHELGLGTRATNALDRANMLTVEDMLSVSMRRLLRLRGVGNKTRREIASAVKILRARLGTPQADATVAVEEPEEPPTGAPGRLSVDLLVQRLTRSSPREGGTAKQSVIALLGLEESLPNPWPSQADVSRFIGVTRARVGAVISKVIDRWGRDKALTALRGDLAGLLVTAGGVMTAGELGDAILAARGSVAEEPQRSLLGRAIARAAVEVERTMSEPRFLVRRDDTRTLVALHPALADHAARLGDRADELAREDPLASPTRALQVLREVPAPAGFEPLADSRLLRLAAAASVEAAVSSRQEIYPRGMDALRALRLAQGALGNVKVLTVEQVRDRVAGRYPDAQPLPERPQLDELLEAADVGLRWNPDAADGRGGYVSRFQETVSVTTASTPPQRQPTASGHAPRETFSPEEADARLFEEKLRRSLKEGAFLTLLVAQRSYQQALGELQSERFSLKTIDADRLIIDSLRETAGKARVDWPLVLRADSHTGNGDWAKLMMLVGRAMPRVEERLAGSDSTILLLNPGLLARYDKLDLLEKLRDRVGRPGGPAGLWLLLPNQQPMIDGKAVPLLSPAQRVHVPESWVENRHRA

SEQ ID NO: 6124 - protein, 1413 aa, Rhodococcus ruber
MRGQVQSDRWVEVSPSPFDHEREGLERIKEILPDAPPFRAWSNFEFRDNRGRWHEVDLLVLARDTLYLIELKYYSGILRGNDHVWTRGNRSEDSPLLLARKKAQYFSSLLKDRLAEKTGQKNLKGIIPFVQELVYLHHPDFVCALPTSSKINLYGIDGNDDRSRLPGISERLLAPATHGPVSEEKSLLIRDLMAAIGLAPRRQREVGSWVIDDQPLGDGDGWQDWPAFHHVDMERAARIRFYLPKPGATSAEEHARARGVEHEYKLLSRLKHDGLQVPVDVVKDKELGIGLVFPKSDTDVRLDLWLADHHGEMTLERQLELLTEVAEVVHYAHRHRVVHRTLNPRAIVVRDRKSGPQAQVTDWDTAGVLPANAETGVTRLSAGPLSLMAGSLSDQAKLFTSPEGVNPTDPARMDVFGLGALAFYLLTGGQSPATERGELLDRLRRDGGLDLAVELPQVPSILRQFVLDATDPSPAERISSVADFLERLEAVRSDLFRAEGETDPLDAKPGDELGDGRFVYKRRLGAGSTAVGILVVDRKAGDHERVLKVARDDEAAARLHAEAQVLGKLDDPRIVQLASEENVGGRAALVVHYAGRTTLAEELAAKGGRLSIDLLERWGTDLLQALVALERAGVVHRDLKPSNLGVHQSSPRADAHLRLFDFSMAGVDLRNTDAGTPPYLDPFLGVGGRTQYDTAAERYGAAVVLFEMATGAAPQYGPDPQANPATVQDDVTVAPSMFETPVAAGLTAYFTSALSRDVATRPDTAEEMLRDWRRVFTDLDAAPANADKTTRAVKVVAGTSLAAAGLSARAVSALAAAQVTTVGELLVLDSTRLNRLVAKEAKATRTEIRDRHRAWVKELGRSAAKPQDQQGLLGLDDAVALLVSAVGTGRAGTRRSAAELLLGVAGTLDAFASGNELASALKKSGPRGNQLLKELQSDWAENPATRELLDELIDVADQVLRDSGGVVAISTLTAEIRARLPQSAAATTDVMAPRLAERAAAGLLRLALDRLTEHETAEGTRRWVRRRHGGRLALVADDELLLAGAEAAGRRADDLMVATPISQVVPMGTAARELRGAFARAYAAAAGPDVPVPLPPDGRLVRLAAAISKFAAVSGRGELHSRSLGPSDALRIALAGLAQTEALSPTEIRARVAARFPELDRLPGRPALDAHIDRAGLGLTWDGTAYRYEQAAPPSETSLHTRTATYTGPPAGPVVSAATGEGGAARNSLVARSLAENGFLVFGVPVHRPGDHQVVARELVEAHEGEVLDVTGAIIDAMRAFSSERGVPWDLVRSADAAAAGSKDARGLRAVLEQVMPRVCAGLEERVFGDAAQARPLVLTEVSPLARYGYLDILARLADLSAPRRRPVWVVLPQMRGQRGALVDGQPIQLGSPGGQFVVYPVWKTGIVESEKV

SEQ ID NO: 6125 - protein, 1394 aa, Mycobacterium xenopi
MKDGRWVQIAESQFAHEQQGLDAIKRILPDAAPFRAWANFEFRDNRGRWHEVDLLVLARDTLYLIELKHYAGTLRGNDHVWMRNGQRAEDSPLLLTRRKAQYFKSLLTDTLRQKAGYDPGIIPYVQELVFLHHPEFTCELPESSKINLYGLDGLSHKTGLPGISERLLAPARREPVSEKNSLIIHGLMKAIGLAPRRQREVGSWIIDEQPLADGDGWQDWPAFHHVDTERHARIRFYTIGEGVTKADSHARKQAVTHEFHLLSRLRYDGLQVPEDLVNEPELGIGLVFPQPKGDVPLDLWLADHKNLSLEQQLDLIGRLADIVNYAHRNRVVHRGLNPRSVAIRERDELLPQVTDWDSAGVLPANPDTAVSRLSSGSLSLMAAAPSDMARLFAAPEGPRPADPARIDVFGLGALAFYVLTGGRSPATERGELMDRLRRDHGLDLAAEMPQVRSSLRQLVLDATNPKPDERIADVAEFLERLAAAREDVLGKATGTDPLEAGPGTELAGRFTYRRKLGAGSTAVGILVADHQVGGAERVLKVAKDADAAERLRAEAQILGRFEDDDRIVTLHGVVEVGGRTALLLKYAGRTTLAEELNNRGRLSIDVLERWGTDLLTALVALERNGVMHRDIKPANLGVYQSSSRADSHLVIFDFSMAGVDPKNIEAGTPPYLDPFLGTGGRRQYDTAAERYGAAVVLFEMATGKSPRYGPNPNANPATVDDDITLTPDMFEPTAAAAMVEFFTTALSRDAAKRPDTAEDMLRAWRAIFSAVDTETAPQESDSVAARADLSTPLAAAGLSARAVSALATAQVATVGELLALDSTPLNRLVAREAKDTRREIRTRYQEWTKRLGKQRTISDQLMGLDDAVGLLMSAVSAPRAATTRRRAAELILGVTPGLDAFASSTELAEKLGKTTPRGIQVLKELQDDWAKNTDARELLDAITEIAKQVVTDFGGVAAVSTLTAEIRARLPQSDVTLPDWSAHDRTAGGLLRAALDRLSEHETASGTKEFVRRRHGRRLALLAEDEMLLAAAEAAGERADKLVTDVAAVVPASTAARELRAAFLDGYRAVSDADAQIPLPADARLVRLAAAISGHAAVSGRGELHNRSMPPAAAVRVALTGLAQSERLSPSQVRSRVTARFPELDRIPLRPHLDSLIAQTGLDLEWDGEKGEYRFRVAEPPSATTMHTHTPTQVPGSGGLDAEALQRADHAAALRRCIDERGFLAVGVPIQPDRPGEHERVARELAAAYNGEVLDVTTRLIAAMRELAERQGVSWDLIRSADAAAPGSRDARGLRAVIDRVVPQLAEELRASVLDGPSRAEPLILTEVSPLARYGHLDILATLSDLSAPRRRPVWVLLPQLRGQTGALVDRKPIQLGSPGQFLVWREAVDAVHT

SEQ ID NO: 6126 - protein, 1395 aa, Micromonospora sp.
MVVREWQWSRGGAGHGMREDSPRWEQINPSSYQHEQEGLRELAAYLPDAEPYHVWANVEFVGTDGSINEVDALVLTRSGLYVLELKHWQGRFSGDGQQWRRHKPNGRTQVLDSPLILANRKAKRLRSVIQQYAPPGARVPYVQAAVFLHARDSRSELDEIGRQHVYGLDGHAAGKLPSLKEMLLAQPLDARHHVDAVRGRQIVELVKGARIRPSVADRRVNQLVLHQRPFAEGIGWQDFLADHTVGGELLRRVRFYLTSRAAEEDVPTIKLAAEREFRLLQGIHHPGIARALDLVEHPWGPAVVFDHRKEWVRLDQWLAERDGRLQLAQRLQLVQDLAEIVDHAHSRRLSHRSLNPRAVFVCDPDSARPTLVVTDWQTGGRLPGTRMTTLGSPTDPASLELFFDDVVRRYQAPEAAVVEGLPGHQLDIFSLGALAYRIFAGVEPAATAEDLLAAVADGGLRLDAVADGMPTALVSAVYDATRGDPAQRMARVGDFLTWLDLVWEELTAPEPEPVVDPLQAHRGDVLDGGLTVLGNLGSGATAIALAVTRGDTSDGRELVLKVARDEQYADRFAAEARTVDKLRDSRVAALVQGPIKVGNRTALLLESAGKRTLAEDLRGGRLALDLLERYGRDLLEIVAFLDGQGVWHRDIKPANLAALPRPKDKQPHLCIFDFSLAGVPADQLTAGTTAYLDPFLGPPRRLRFDAAAERFAAAVTLYEMATGTLPRWGNGANPAAVSDEVTLDPAAFDPSVADRLVAFFAKALARDTADRFDTLDEMTDAWRAVFREIPEPAAATDDTGGAAPLGRSSPLEGAELTARARSALERLGITTVGELLDAEPSALTRARGVPDATRKEILARVRELRDLLDAEPEPAAAARPYAQGVEALCATLLPAVTDRTAWHRTAVQVLLGQAPDADGRYLRWPSQSDVARVAGKQQPQISTLLRRVVARDWQPNVALRLVCDEIVAVLDGRGGVASAEEIAEALVAARGSYTVEPKRTAQAIGLVRAAVETELARGGDARVAMHRLRDSDTVLVGREPDDPGIERTADDLLGYVTRLGRRATELAGADPLPTRARAVEELRALEPPPAGTPPLSDARLLQLAAAGSGGRAAVNAQGQLYPAGMPAGRALRLAAGALVGQKLDPDAVRARVRARFPRAQELPPRPQLDGLLREAIPLVWDVSAGLYAPPDRTSSVTGTRMQSTVGPILEPDAAAQVSRRLHDVIGRRGFLVALTSVRRTAHARRALLQRYDLTEVDVTAIMLERLRALSFPWEAIVAADTGSPTDADFRSLVELFQHEVLPAVERRLAEAPGPVLITEAAPLARYDQLRLVQELADPTRARPAARLLLVPVRRTEPVLLDGRQLPLTSPASQSLWLPEEWSGAAPAQQQRNATR

SEQ ID NO: 6127 - protein, 1466 aa, Saccharomonospora xinjiangensis
MSDGRGPAPKPAPPPPVERWRQERTSPYPWEQDGLDHIRRLMPQAEPYRAWATFSFTAASGRVNECDLLIAVPGGLYLLELKGHTGRVVNSGETWSFFREGVRRPRTLRNPLHLTDLKCKELKGRLEWAAKQNHFSGRIPRIEPAIFLSAPGLVAELDEVQRTRVYGRDEQVEGLDWIWRDLLSRPPQREQQRISPEFSRYVLPRLLERIGIRASVAHLRFGDDWVLANEVLDAGPTWEDRLAERTSLVHEQGRVRIYLTEQQAVEERRQSVERAARREYQVLQGITHRGIAQAVQIREHQGGPAILFRHDASDLRLDSYLDVHGENLSIDTRLDLVRQLAEAVQYAHHRSLYHRALSARSVWVSAKDDGSDPVLRITDWQAAARDFDTTSLSTVGKTSLTREHLANSAEVYLAPEFAPHADPVDLDVFGLGAVSFLILTGRPPAGQRSGLIERLAESHGLHPYAVADGISDALDALVFDATRTDLAQRLDSADAFLKRLDAAEWESLPESSVPVVDPLTVSAGQLVDEQWRVERVLGTGATARALLVRKVDTADTDTAASDTVERRVLKVALDDDKAQRLHAEARALALVGGGVVVKLLDGPREVGGRTVLDLEYAGGQDPDGPTLGEWLRAEGKLTYHNLERYGRDLFTALDHLAGKGVRHRDLKPDNFGIYRRADRSTQLMLFDFSLADVSERDVAAGTRGYLDPFLGTSRRPVYDDHAERYAAAVTLHEMASGQRPVWGDGVSDPRTTSDETPVLAAEAFEPALRDGLTEFFRRALHRDVNRRFDTLRQMEDAWREVFTSADTAAPLTTPGTVGIEGSTLEATRDAHADKATLDTQLDLAGLSPRAVSLAQSLGATTVRELLEQVRPYEISRARGAGKVVRNELNRRHKQWTHALLRRAEPDGPAPETGDGPATLDGLVALLLPVKARRGSRKADVVRLTLGLPEGSDRDGHDGGEDGAAALSWPTQTQVAARLGVTQATVSQHYRKAMAAWAAEPRVAALREEVVRLLAEAGRVMTAYELAAAVKAAYGGAERDTRERALARALAVVRAAVDTEAWDRQQEGREGAEDGPRFSVLRRGEHVVVALESLPGTDEPSAPELADYAVALGARADELVMVDPLPGRGVVVRELRAVRAPKGLSSQADTRLVELAAAMSVRAAASPRSELYPRSLDLVRALRMSQAAVGVRRETGIAPADLLAKVRARFPSVSVADDVTYVRLEEALRAAGTPLEYDTEKKLFYPPAPEFSRLASSSSTTRDSSGGPRPGGLDPHELLRDKLARSVEQGGFLALTLRGTALPGAAEALASRYPVRPVQVDREFLAVFRGLVVEYDQDWERVRKLDERFGRTGEPKPGFRRVVRLAWERLRDRLVDQAGARTVLLLHHADLVGRYADLGGREFLTGLQQAARSAEALPHGLWVLCPGESAEEAPQLDGLRVEALTESERAALGREFVQGLRVCDRAS

SEQ ID NO: 6128 - protein, 1422 aa, Bradyrhizobium sp.
MALPEARIHRGRPTPFPWERRALDLIYKHTSLSDTDPHQAWELHELYDPSSGRLYEIDLLFLSRQGLFLVEIKSHSGILTGDIVDWTITENGRRRTIECPYPSANLKAKVLGDLIERQLGTDRPYVHAAVFLSNVTDVRLDGGRPPWLLLPDDVGSKLVNGLGGRDARRIVNRPMMKDLLQAAHRIGLRPSTTARVVGGYKLGFLLDDGEGYQEHLAKNTVVESDQARVRSYLVPAATSVERRSQLHRAAKREAQTLAQIGQHPGILAYRSFVDDAPLGPAVLFEAFEDSLPLHAFIRQEPNVTFDDRLDILQQIVEAVAHCHRSSILHRNLSPASVLVRRGGDGRIHVRLHRFQTAAWIEHSSVGTRHFHQLSQDVDRLYQAPEVLADPEKATYESDVFSVGCLAWLVLTGQHPAATVPEREQRIKGVKDGEGGLRPSAVRADLAILDEAIASATQPNLHARADDIAEWFNTFVLEPLTGPAADASAGTDPREAQKGDTLQGGLRVERRLGSGGTALVLHVRREGRDFALKVPHDAGCGERLLAEAKTLRDLRHEHIVALRDVVTLGGLPCLLLEFAGDRSLGDVLREQGTLPLELARRYGDDLLSAVQYLEEAGVTHRDIKPTNVGFTSLSKKQSHLLLLDFSLSSADPTAITAGTAEWRDPWLYLRGAWGAEADRYAAAAVLYYALTAARPGLPQGDATAEIVVEAERFDAAVRDRLTAFFHKAFARDVNVRFASAEAMRQAWVQALSVEAETDDGASAIALDQVRTETPVDALPLSARARNALDRAGVSTVAELLLLPRNQLSVVRGVGTQVARDIVKIADELRARFEVDKRPAFMPGFARPRLLLEEPEACIDATTVGRLVAAGIKTTVDAALAHTARIEKLLGKSGADALRERLTALAAAEPTPGSLADWARELIGRASQSEANKRLRVLVGLDPLPDERPDTGIPAARTVSEVAGAFGIDAAQIHSSLQFQRNKRWTDSTAAASLTEALSSALDALAPAAPFLDLAAALAKARTAGTPSGEEVRIAAALVRVGLELRPNPPAVWRRISGTPWVARDSEVLDALAALSETADSLAATEPLPSSEVVRSKLAEVAEGTPLAALPADQRLTLAARASTNAAASARLELYPRNMDAARALDLSLAALSGTGLTPEVVMKRVAARYPEAAPLPERPTLDRLLAPHGLVFMADIGPGEYTRPGVYALTSMTAAVPSRQTTAPAPPQRRSPNAQRAAAFQDQLDRGVAAGRFRVVQVRADLASRATDELASALRTTAISLDVELFTAIRKTAAELRVEWANIEAADRAGPDGPDWPLLLELVRQASDVAIDTLLSRREPTLVLAWPGALARYGLSGALARIVNEAERGNAPAILLVVPSHADGAAPSINGRLPVPAPLPSQRLVMPDAWLRNEHKAAETLWG

SEQ ID NO: 6129 - protein, 1400 aa, Burkholderia thailandensis; identical to SEQ ID NO: 6091

SEQ ID NO: 6130 - protein, 1405 aa, Planctomyces maris
MAEADNWTTVTESKFSWEREALDYVRSQFPKFAPYRAWSNFEFIADDGSINEVDLLVFSPQGFFLIEIKSSPGRLQGDAGTWTWERDGKRYPVDNPLIATNLKAKKLSSLLQKQKALKNRGRLPFIEPLVFCSAAGLQCELKGNARAKVCLRDREEPKRPGIMAAISRRECPGLDSHLKGTHDTPMSNAVGQALNQAGIRPSQKSRKVGDYLLKQIIGEGPGYQDWSAEHTALENSKRRVRLYLVRNEATPEDRDTVQRAALREYQILETLEHPGILRVNNFTEHELGPALLFEHDPLSMRLDHFLARQKDQLDIATQLDLIRQLAEAMQYAHEKKVVHRGLCPQSILVTSINSEHPRLKVFNWQLSYRESSTSTKVSRAVSATSHVDRLVEDAATAYMAPEILTDSQTSTGEHLDVFSLGTIAYQIFSGLPPAANALELSEKLRETKGLQISSVLNGASEWLQEMIRSATNPVVPDRTGSIVDFLEMLDEVENELTSPDHEQLEDPTRAKIDDILPGGYKILRRLGHGACSVAFLVELDQQDFILKVASETRHNDRLRAEAELLSRQEMRHTNIVDFVDAVQLGNHFGFLMRPVYTERGKRLIETLGQRLRKDGRLHIDLLQRFGDDLLQVVNHLEEQGIPHRDIKPDNIAVGMVGRGSKLHLVLFDFSLSKTPAENIRAGTTGYLEPLLPLREPAPPRWDLHAERYAAAVTLYELATGTLPVWGDGVTTAIYLPTDTEITIDAELFDLALRESLTEFFTQAFRRNIDQRFDNAEEMLRAWRNCFEGIDEPGALSDHADETRLQELLADAEFETQIPELGLGSRSANALDRANILTVEDLLTVPMRRLMRLRGVGNKTRREITSAVKILRDRLGKPDRDPSSLSDPESTQTEPVAVEHLSLDLLVSRLLNTGARDGENFQRGVRLLLGLDPALQDPWPSQAEIARELDVTRARAGQIVTRLQDRWSKDAALTRLRADLAEMLAVQSGVMSIRELAEALIVARGSSEELLQKTAHACAVIRAAVEVERTMTEPRFLVRRENQSILIAAHTEFATWARKLGVIADQLADEDPLLAPARILERLQEVTPPDDLLIPDARLVRLAAEVSDHAALSSRQELYPRNMDPVRALKLSQGALLGQRKLTVAQIQERVAGRYPDASPLPDRPLLNNLLDQAGFDLKWEPSDEDPPGCYFSRQPNQITLTSSNTSRQRRSSLPSDPGEITPELADARQFEERLQRNLQEGSFLTLLVGPREFETALAELTRRFPLELVDLEGLLIEALRETASQAGVNWELVLQTDARPQSGDWDKLKLLVNRAVPVVEQKLKHADKTMLMIYPGLLARYDQMELLSQLSQQVGRPNGIHGLWLLLPGDSQALIDGKPVPLIGPGQRTRIPRSWLKNIHREDAS

SEQ ID NO: 6131 - protein, 1557 aa, Streptomyces gancidicus
MREGRWVTVTESEFEHERRGLEAIREKLPDSDPWRAWSNFTFTANTGHVREVDLLVVAPGGLCMIELKDWHGSVTSENGTWVQTTPSGHRRTHGNPLHLVNRKAKELAGLLAQTGAKRVWVAEAVCFTDNSLRVRLPAHDQNGVYTVDELVEMLKQPPRDERRRVTAIGSREVAAALKNIGIRKSDAQYKVGPYELERKSFDSGPTWADYLARHSDLPEAARVRIYLSERGSDASLRQSVENAARREAAVLGRFKHPGVVQLKQYFPSGHAAGPALIFDYHPDTLKLDEYLVRYGEKLDILGRMALVRQLAETMRSAHASRIHHRALAARSVHVVPRPRGRKGQAVGEEAAWLTPQLQISDWQIATQRSGDSSQGQGMTRFAPTALSAMHLSDDADAYLAPELTALSPDPVYLDVYGLGVLTYLLVTGKAPAASQAELLARLEAGEGLRPSSLVDGLSEDVDELVQAATAYRPGQRLSSVDEFLELLEVVEDSLTAPAAALDGHAEEETGENADKDPLEAVAGDVLAGRWEVRRRLGTGSTSRAFLVRDLEAETRRTRPLAVLKVALSDSRGEILVHEAEAMRRLRPHSGIIRLVEPEPLHIAGRTVLALEYVGDERDDAGQSAEGASRPRRREETVARQLREHGRLPVDQLEAYGDYLFGAVDFLEGEGVWHRDIKPDNIAVRIRPNRTRELVLIDFSLAGYPAKNTDAGTEGYLDPFVDVITRGSYDSHAERYAVAVTLHQMASGELPKWGDGSVLPRMTDPKEWPYPTIAAEAFDPAVRDGLVAFFQKALHRDAGKRFPELKPMRDAWRKVFLDASQTVPSSHRTRPTAPSEGTAPAEGAAAGIADAEPETAEQQRDRLAAEVTRDTPLTVSGLTPAAQSFLYGLGLTTVGELLDYSRRKLVNAPGLGAKTRNEVQQRQREWGERLREIPVSPLTPKGRAEAKEELEQLTAAESALVGQLATGESAGALSARTLRSVSLDTLATVFVPAVNNNGSNRNKAEMVRLLLRLPDEHGVLPDIGVWPKQKDVADALGLSHGRIPQMLKDERKRWKAEPAVQALRDEIIDLLESMGRVASAVEIADALAVRRGTHLAGREQRRAMALAAVRAVVEVEQLVPQEAEFQHQPNRKATDESLGAGLLALDVRENEAPDTPTAPGLLDYATRLGRTADRLARLDTLPTAATVLAELGALTVPPGAVDWDERRMVELAAAASVNAAATPRLEIYPRDLSLVRALRLTQAGLVRWIPGVPEGRQPGLIGEDVHERVRVRFPELVVPDGRGGTTHELPTGGPLTKALRDAGFELSLSMREDTGTLRYLPTRVEDASSYLTTGAWRQSTRTGTVTRYADDPQLAGAVRAEERLLASACRDGYRVLTVRQQLVRDAVRELSAERLGARAVSVTELFLEALHGQVTPGTKPTWETLLKADAAEPGSKGAVRFAEYARTAWGSVEPRIAELLGNGGGGAGPVLLTEAGVFARYDAMGVLDRLASAARRGGRGLWLLVPQNDPSREPRLGQVAVPYQAGLGEWIQLPDTWVGNAHRGSGEVVASGVKGDAK

SEQ ID NO: 6132 - protein, 1369 aa, Gordonia amicalis
MAQGEDRWIEVSKSAFSHEAEGLKFLHDLVPNASPYRAWTNFEFMDNHGQWHEIDALILGRRRLHLVELKAYTGVLQGSETSWVITSLGGRSRTQRSPLLVTRRKAQRLASRIEEEARKVALSAGLDAEKVRRALPFVQESVFLHGDQFHADMPDLAKSSLFGMDGREDQTGLPGISTRLLEPPSDSRRVDEDLSVIIALALQNLGIARRTERDAGSWTITGKPLANGIDWQEWSAKHKATGTEGRARIVSLRPGTPAQARAAAHRRMQREFSLLSSLRHESIVAPRDLVQDDDGNTVLIFPDLPEYEQLDLALATRELTAEQQIQVLTEVSEALAYAHRNQVAHRGLSPSTVLINTHALDEGGTVRIRLADWSWAGRVHSPGTQSSTMLGTPDQPGTAVEDVYQAPEDRWASDADRLALDVFSLGALAYYLLSGGQAPASNRAELLERLRQEQGLDLAASGGRFVDENLRALVLRSTCPSVSKRVAADRKTGVPSFGAHQFAAELSDYRRDRLEPATQHVDPLNPAPGSLIADRFEVIRVLGVGSTARGVLVTDRNDDDAVRVLKVGLDDSAAARLHDEAQVLTELARHTPRVPGVVELIDGPLDLSGRKALLLTNCGEQTLSDLVRHTPLTESRLRTWGLELLDIVVALDSIGISHRDIKPANLGLARVDGRTKAARRTRLALFDFSLSRADVSQIEAGTPPYRDPFLGIGIRTTFDSAAERYSAAVVLYEMATSSTPVYGDGMSDPRVLNDDVTVTAEDFTAAGLSRSRAEALVAFFRTALTRNAKDRFDTAAAMRAAWASAFQVKAAGEHPSAPAPIDPIAKPAAPQPVARTYDSLDTLATEFAKAAGNKPSVMRRQVVELVLGTHERSPADPFITYPALAALAGVTSGRIAQIFGEFSDLWAKNDRLAATAADLYRRGLTLLEASGGASTPELLARELAGSLNTESVADPQRTALGVLRLLLSSRPGTEYQDRSSTDTAVQMVRRHGSGTVAMIATVAVPRRLPAVLASAAETLVDSALAQGTLLVMPDDAKNQLRSAAAAVLDLDGADVEIPGHALLRIAAVASTEVALSSRDELHAASLPVDGALRILLRGLSTADSFGRSELESRWSARFPALTQLLPRRPDLDGLIESVVPGMTWDDASARYRFADAPRTGTNIPTRTTLTTAHPVPTTGTSDVEYILAASARERTFRALGVPLGYSDVVAQALVEHFGATHIDVTELLLGELKQRASSAGLAWEAILAADAGAAADRDGLKGFVAQALPTLVSAVDHAGGPVVLTDLSTLAAYGQLSVLHKWLDLTAPPKYAVWALVPQPEEAGGPPGARVDGTALLPNSPEQFVQVNKDEIKALIAAVRSNDQVKEHI

SEQ ID NO: 6133 - protein, 1385 aa, Mycobacterium intracellulare
MQPNGERWHVVTDSEHPHEKEGLEHVRELLPDRSPFHAWSNFEFVDSNGTWSEVDLLVLGEGALYLVELKHYQGDISGNAYRWQLSHRSEDSPLKKTAMKARRLAGVLKNAAVNMGLDARTIPFVKPAVFLHSQTTRCLLSGADKNDLYGLDGREQQTNLPSIAELLLEPPRRESVNERDFLRVIEHAGFALRREREIGSWRLIGQALDEDDDWQDWPAEHRVTRKLARIRFFTTPQGASKAQVAGARRLAEREYGLTSRLHHPGILAPQDIVEDELGRGLVFPYDPDDQRLDLWLADNGEKLDLRAQMDLVRQLAESVQYAHSNGIVHRGLNPSAVVVHDDGPPRTLIGGWSVAGAAEGASPSVIETQGSATRIFGLLEARKGETNRVAGAYVAPEGQWRPDANRSRLDVFALGSLTYLLVAGHDPATSAVELKQRLEREHGLDLAADLPQVPESLRGLVLAATNPVVSDRLRDVNAFLEMLSRVERELGTSNEDTDIDPLDAPPGTLIGGRFELVRRLGSGSTAVGLLVRDAEADGEARVLKVAIDDNAAKRLDAEVQVLAALTGRKHPRIIRIVETVPVKVGDRKALLLESAGEETLADVLRDRRRLSLDLLDRWGTDLLEALVSLDEAGVDHRDIKPSNLGVREQKSDRAKHLVLFDFSLAKASAATISAGTPPYLDPFLGSGTRLHWDSAAERYAAAVTLFEMATGHAPIYGDGETAPQFVERATIEPGDFDPAIADAMVQFFERALAKEVKHRHDTASDMLTEWRSALAGSVATTPAVADEAAERATPETPLQESGLTPRALSALEPFRLKTVGDLAAIDTSRLSRFTGIVDATKREIRGRAKQWREKFGSQLLPSPVPAEDINPADPFTSPQTAAALLVESAGTPRAQARRTAAAVLLGLEGDVAPFAVLADHANALGLGGQAQASMALASLRDAWAKSPQAAGLLDGVFDRVLGVLEGLDGAAWTESIVDALAPTSASVSDRRLIAGMVRAALDRAEDKAKGADEESPIARRRRRKDNRLLLARTTEVADLAQTLGARATQLVNESASAGEFVVPRGRSVPAFRQLWTSNLPALDDTRLVRLAARLSDGVAASASGELYSTSMPVVIAVRLALGSTMPSQRFSAEEVRRLVQVRLPGVADVPGRPGLDRVLAEAGTGLTWDGEAYSVPSAHSDTTFLTQTSLPVIPIRLESQSHPTDRLLRESISARSFLALGIPAKHAPWIAAGLITAFHAFEVNITDVLLQSLKESGEAAGLPWDAVLAADAAAPESVDARGLAALVEQSIPGIDAAIAGALSGAPGLDRPVVITEAAPLARYGHMSVLSKLADIATKRDQAVWLVVPEEGGGGPLLDRVPIPLTYSSQFVRVDDLFVASEGDQR

SEQ ID NO: 6134 - protein, 1382 aa, Phaeospirillum molischianum
MVMSAQRWSAIAESEFKWEQDALAFLRDHLPDIDPWHVWSNFEFIDDQGRVNEVDALVLSPRGLFLVEIKSRPGRVEGDAHSWTWVQDGRTSTYDNPYLLANRKAKRLKSLLDRQDAFRRARLPVPFVTAAIFLSSPTNDISALPLFVATNVFNRGRPGTVHDEGIIAALTGLVGPGRERNPNGDPAVRRTMKSAMETAGIRRSLRQRRIGDYELERLIEEGDDFQDFQGHHVAADVRRRIRIFQTPPGRSRDDVFKAVAREFQILEGISHPGILRASDFKDTERGPALVFDFDPKAVRLDFVLKEKALVDRLDVDQRLHLVRQLAETIRYAHDKRLTHRALVPQNVLVRDVAERFPRLQVMNWQLATREAGSTGGTLQQTLGTIHPGDHVDDPAKVYMAPEALQHASPPILADIFSLGAIAYHIFSGQPPAGSTVELVNKLRQGQGLMVADVMDGASAALVDLIRQATHPDVSRRLDSVEEFLAMLAKVEDAAAGQADEQVIDPAQAKAGDRLDGGFTVIRRLGRGSSADALLVNSDGSDEQLVLKVAIDSAYADRLGAEGEIIARLNHQSIVRHRQTLSISGRTALLMELAGDETLAVRLRRGERPSLDLARRWGEDLISAIDYLDEQGIAHRDIKPDNIGIRSNRKNTLHLVLFDFSLSKGSLDNIRAGTRPYLDPFLSLRRPPRWDLHAERFAVAITLYEMLTGSIPIWGDGASEPAVLDCEATLEPERFDPQVRDGMVAFFARALRRSPLERFDNAEEMLKVWRQVFEDMRTPVVSDESFDTIARRVTVQTPVAELGLGVEALDVLTRMGVETVRQLLGVSRLKLRYLSGVGDRIRKEIRLKAKRLAHLRPELVPGGTTSQDEAPSLAGSIDHLAASLLPKRPAGEDRAEDQAVSTYLGLEEASEPWLGVGAVAGRTGLSRVALAESLRQARSRWRDKAPLAKVRDDLLRLLEQEGKAVTAIEAARALLLQRGSLITDDRERMRLAQAVVRAAVDAEEMGAEPRFRWVSTPTVPLIASDTVIASAAVALGEAADELASLDPLASPQRVRERLVEGAGPDLLAVAAPQRLVRLAVALSARAALSTRQEIYPRGMPADQAIRLALSSLVGPAMLTRDQIWERVHSRYPESQPLPDRPALDSLLRAAGAELDWREASANGPAGYWRRTMGFDPSGSAQTQSRLGTFAPPDEESPDLADARKFEEKLVRVVADGGFLALALAPRRALAVARELEQRFGMIRFSIDALLLRAMKATAETNEVDWLIVRETDAAGPTTAEWQHLKTLADMAWPQVEAVLRAASGPVLLTDAGLIGRYDLVSRLDVLRGDCATATGPTGMVVLVPMMQPGMPAIEGKPVPVMPAQWAMVPEAWVENRHRAGRAA

SEQ ID NO: 6135 - protein, 207 aa, Nitrococcus mobilis
MHPSAFPHEQEALDTLRAQLPETPPFRAWSNFEFIAADGSINEVDALVVSTDRVYLIEIKSWRGQITGNQNTWLVTQADGRQRYEENPLLLANRKAKKLKSLLARQLPFKKAAVPYPKFNVPKNNFAILRELRSAAAASGTTLRSFYKSAGSHDCFLHAARGGIGPEGLIDSRLIGLGAGGLAHVQGAAIAAVERGGDPALAGEGIA

SEQ ID NO: 6136 - protein, 1283 aa, Nitrococcus mobilis
MGYVQAAVFLSLPECSLALDEIAGQHVYLRPDADRKGQFSVADLIRGRATEAEGRPPLSRAVERALSRAMEQLGLRKRTRAAAHAGDYLLTRLIHENDRYQDWEARHARVESDRKRVRIFPYAKQAPAADQRERKDIAAREYELLREVRHDHILAPIQLTQSDIGPALIYHYQPDAQRLDHLLEAASTSLDVGQRLDLVRQIAEALGYAHQRGVYHRALSPWAVEVIARPDGQLAPRLRDWQSGASDRQTQTATRMTVHIGELSGVIGSAQATVYAPPEVISGHGYDAASIDMFSLGALSYAIFSGQHPATDSEYMLDKCRSGPGLLISEVLDGAPDSLQMLIQCATDPDPAGRPADVREFLTLLDDVENELTTPDTETGVPAADASADDWLSRGLTGGFKVLTRLGSGSTCYALAVERDDGQRGVLKVAKEPSLNERLRSEADALRELRHPNIVKYLGLEEIDGCTAIFMEQAGEQTLGQRLRRYGVLSLDLLERFGEELLNTLVYLERSGINHRDIKPENIGIGTNRKRALTLKLFDFSLSRAPLDNIRAGTPPYLDPFLCQRRPPRWDLHAERFAAGITLHELATGALPTWGSAGQDPASTDHELRLEVEALDPAIRDALAAFFRKVLHRDYRKRFDNADEMYLAWRNVFRHIDRTTHDDTDDGSTTIDLTAIEELGHATELARLGLSARLLNAAERIGATTVGELLDLPGMRMYRNRGIGQQLTRRLRELREQLARHLGSPVPGPMDDAPDHYSIDRLLKSLEAIKLDEHQADIVGAWLGHNGDSGAPAAELPSLREVAEACGASRGAVQDTIDKAVEKWSRNAWMTALRDEAAEFLLRREGIVTVPELAKHLLSKHGSTATGDPRLRQTAAVVQALLEAEAQRESARFVLSRSHAPLLIIATSRLGQAFAAATGERAEYVKALAAQAHRLAHEEPLPTERRIHATLAALAAPAADQPLSPDRRLRLAVAAAPAVALSGRLELYPEGMAAERALRLGTNSLLGASRLSVAQLHERIRSRFGKAEPLPQRPELDHLLQSIEFPLLWHEATDELPAGYAMPVHGSGLTRHTSTLRRRTTAQQADSDSPQARQAQRFEDTVQRAVAERRVLIVTCPLRHIGQAADELARTLALDRLSLERLLIDSLRTQARQVGADWRVVLQADAAARESVDWRRLNTLVQRAIPKVKQQLLDHPRPLLVQHLGLLVRYGQIGLIQALRDTALTSPMPARLLLVPGDAHQAPLLDGRTLPVITPADWTHLPRPWLENRHRAAKPSPIEKNHA

SEQ ID NO: 6137 - protein, 1608 aa, Frankia sp.
MRDGLGRWETVTPSQFPHEREALEHVRLLLPDAEPFRAWSNFTFTATTGHIREVDLLVVARGGVYLIEIKSLVGRLTASGSTWTQHRASGSTRIFDNPLHLANQKSRELRSLLQVAAQASRTKIPFIQPAVFLSNPTLRVDLPDHHLPWVFGPERAAAVNPGGAGGAGGGAGGAGIVGNAGGAGGAGGRGTMLPSLWTGLLDVPLRDERQRITPALSKELARLLPAVGIARSRRHQQVGSWQLEFPAFDSGLTWQDHHAAHAQVASERRRVRIYLVERAAGEAERARREAVARREFLVLNGISHPGIVQVDGLESHEAGPALIFRHRPDEMRLDHYLDQFGDSLDAGTRVSMIRELAETVAYAHGRHLYHRALAARSVLVVPRAGRGWLAPRLMISDWQAAARDTILGSGTPVNGLSTTSRALAVEPAAQLLPHLELAAGGYLAPEIGAPYPDPVGMDIFGLGALAYLILTGQAPADSPNALKTRLEQSGALYPAEVVDSLSETANELVAGATRPLPEERFDTVRDLLDWLQLIEEELTRPDAPAATPGSAPAGGAGGTPADPSALDPNATLQSVTSVSVAGRAGQEAAEGEYDADPLEAQRGDLVGGEWRIRERLGTGSTSRAFLAHNEKTNRDEVLKIALSDERAPRLGHEAAVLGRLNDSRVIRLARPDTLVVGGRTVLVLDHAGEQTVARKLREGRLSVDELETYSDYLFGAVDYLDGEGVVHRDLKPDNIVIRRRPNRTYQLVLIDFSLANLSVHETGAGTPRYLDPFVGAGTRTTYDDHAERYALAVTLHEMASGELPLWGDGSAEARFTSGPPKVVTEAFDPAIRSGLTVFFLRALDRDAARRFASLKDMRDAWQAVFRAADSTPPAPSIHPATAGSAAVARPHGSAGGADEAAAERARDLAAAAATADTPLEAAGLSPRAVSAAHRLNATTVAALLSLGSKEIIGLPGTGAKTRLELQSRIRQWRRALAAARPAAIVPPAVMATPAGKQDDGASAAAAQDYPRMPVEVLADRLLPRAPRAAPADRNATEREATRLLLGLPDADGTLPDLPLWAPQQQIAERVGVTAGRIAQVLIARRKAWHADPAVRSVHDELIEILGDAGRVMGFDELVTAVLARHGSAWRSPAERRSSGERRAFAGAVVRAALETVDLDSEPRLARRRFHDRMLVALEAAEDDGPLTPAAPALFDYAIALGKAADRLARAEELPAPATVLRELAGVAASAGAPAAGADAGSESVDSSGGLPVLDQRRLVGLAAAASRTAAANARLEIYPRDLDLVRALRLAQAGVQPTRPTAAVAPPGSGDERPDRLLLDVPTIHERVHNRFPGLTTDLPTHPELDRPLVAAGFALEWDAARAGYVPPHGLLSSAGFGSWATPVARQPTGLGGGSARALLSDRPDETTAALAERRLETAAETGGFRALTVRRNHYRAACAELAKPHRFAAEPVDVAAVFLDALHAEVDPRPKPTWATILRADAAEPGSRAATKLAEYVRTAWQRAAGQLAAHVDAARPAPLLLHDAGVFGHYNGRGLDVLFALADRARAGGRPVWVLCPTTEPTRPPRLDGALVQLVTESEWVTLPDAWIANWHRASAEQTPAGGRAS

SEQ ID NO: 6138 - protein, 1393 aa, Pseudomonas stutzeri
MDKLWKQITQSDYTWEREALEFAKQLLPDHDPYRAWANFEFIAQDGSINEVDLMVLTPKGMYLIEIKSHPGTISGDAANWVWERPLPKGGQKIFDNPRLLARRKAQKLASLLKLQPSFHRSKETVPFIDALVFLSAEDLVIKLEGNARQGVVNRQELLREITLIDENWRHRQITAYAAKVISRAVEEAGIKESVRMRRVGSYELQSLLDESDTYQDWLALHPDIGVQRKVRIYLTQGKPKEEVSRLEKAAKLEFRLLEGIEHPGILRAHEFQNHDSGPALVYEHDPKAFRLDHLLMHLGKDRRLDTVQATYLLRLIAEAVQYAHGQKLYHRGLSPQCIWVKPLGDEKYSVKISNWATAERIFESESRNISALTRLINLVHEEAGPYVALEAHTGAADGVHLDVFSLGAIAYHLFTGKKPAQTDIELLDKLRRGSGLQVTDEVNGASEAMQYLVQYATHPDVGSRLESVSEFIKRLDDLEDEVSQPNTLRSNPTEARKGDFLPGGFQVVQPLGKGACSVVFLVDYQGQSRVLKIASTPDHNSRLTKEGEVLARLRHQAIVPYYKTLDMVGHTALLLDYATEGTLAQRLRHVGAVQLELLERFGDDLLSAVVHLEDQALVHRDIKPENIGLVMQGSVLHLMLFDFSLSSVGADNISAGTLAYMDPFIRDPGRRRWDDHAERFSVALTLYEMAAGALPGWTSSEGLPHQLEGELEVDRTVFDPSIRDRMVEFFKRALVRDVRKRFASAGEMLREWRKTFHDARSESLHTTQQPQERTCPISEAQLDTQIGLLALSPQALDTLSRRNINSVADLIKLNRSRVRVWTGVGVKTRNELSDVIGQLQARLLDGQQVQQLDSGDTSIVSVDRLFQQVLPKSTDQNRLSFLNEYLGRLDEDAPKGSHNVHWPTPAAISGHLGIETLLVRELVDKVLTQWGKTKAITDLREDIVGLLDDNGGVMTAVEVADAILLRRGSVQDSPLRERWAYAVVRAAVETELSKQEPRWLLRRSGNRFLIADNRQGRGEELADYACDLGSLADECARQLPLLAPVRTLEKIRAVPAPESFAGLSNHRLLRLAAAASESAALSSRVEFYPRGMSAKLALELAQGALLGSKALTVKDVQTRVAGRYPAAQELPGRPELDELVRSLDIGFQWNGSFEFANGDRGGYCLPSAGMTSFASAGSTHYSQTQQGEDDTTTLKSVKELGLMLEKAVTASHFLALTVRPRQWWQAQEKLCRDYPFKRISFDELLLRHVQAVCASMPKAPDWQVVLKADACEHSSRDWQNLQRLVQRALPSMAKEILQAGQPVLLTEPGLLARYELVTTWLNDLRQQLMSVSGRSGIALPGLVLLIAVDAQRSAAMIDDVLVPTGAGSKEFAHIPSSWLDDAQLLPEAVKTTA

SEQ ID NO: 6139 - DNA, 17332 bp, Artificial sequence
  Plasmid used to integrate B. cereus H3081.97 PYZA genes into B. subtilis BEST7003
  misc_feature (1)..(1130): B. subtilis BEST7003 regions 3' of PYZA
  misc_feature (1131)..(1981): Chloramphenicol resistance cassette
  misc_feature (2624)..(15709): B. cereus PYZA System
  misc_feature (2624)..(4654): B. cereus pglL
  misc_feature (4678)..(7242): B. cereus pglZ
  misc_feature (7322)..(10861): B. cereus pglX
  misc_feature (10921)..(14499): B. cereus pglY
  misc_feature (14527)..(15105): B. cereus pglB
  misc_feature (15107)..(15709): B. cereus pglA
  misc_feature (16216)..(17332): subtilis BEST7003 regions 5' of PYZA
tgcctgcatgagctgatttgggaatggcaaaccggcaacctgatggcggagatcgctgttgtcatcagtaaccatgaggaagcgagagagctggttgagcgcctgaacattccattccactatatgaaagcgaacaaagacatcagagcggaagtcgaaaagaagcagcttgaactgctggagcagtacgatgttgatgtgatcgtgctcgcacgctatatgcagattctaactcctgattttgtttcggctcatccgaatcgcatcatcaatatccaccattcattcctgccagcttttatcggtgcgaatccgtacaaacgggcctacgagcgcggcgtgaaactgatcggtgcgacatctcattatgtgacaaacgatcttgatgaagggccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgcaagaggcccgcgcaatgcgggctatttttgatgacaaaaaaccttgacaagtgtcttttttctttgcataatataaaaaaatcattgagcgttgaagaggattagtaagcagacctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacgaatagcaaaggaagcattgatgaggcaaaaatcagagagcatgttcaggcgatttccgtgttaaaaaaagcggggcatgaaatgattctgattacctcgggtgccgtagcggcggggttttccagcctcggttatccatcccgtcccgttaccatcaaaggaaaacaggcggcgtagatctggagctgtaatataaaaaccttcttcaactaacggggcaggttagtgacattagaaaaccgactgtaaaaagtacagtcggcattatctcatattataaaagccagtcattaggcctatctgacaattcctgaatagagttcataaacaatcctgcatgataaccatcacaaacagaatgatgtacctgtaaagatagcggtaaatatattgaattacctttattaatgaattttcctgctgtaataatgggtagaaggtaattactattattattgatatttaagttaaacccagtaaatgaagtccatggaataatagaaagagaaaaagcattttcaggtataggtgttttgggaaacaatttccccgaaccattatatttctctacatcagaaaggtataaatcataaaactctttgaagtcattctttacaggagtccaaataccagagaatgttttagatacaccatcaaaaattgtataaagtggctctaacttatcccaataacctaactctccgtcgctattgtaaccagttctaaaagctgtatttgagtttatcacccttgtcactaagaaaataaatgcagggtaaaatttatatccttcttgttttatgtttcggtataaaacactaatatcaatttctgtggttatactaaaagtcgtttgttggttcaaataatgattaaatatctcttttctcttccaattgtctaaatcaattttattaaagttcatttgatatgcctcctaaatttttatctaaagtgaatttaggaggcttacttgtctgctttcttcattagaatcaatccttttttaaaagtcaatattactggtttttcgcctctaaatactcatccattactcttaaaaaaccttcacgcaaattactactcatattaccgcccttttctccattatctcttgtatattttttaacatttcatcatcattaaaggtataccattctcaccctcacaaacagttacaattgcaattacaattacaattacaattacaattacaattactaccattttatcaaactatatatacgcataaaagaaaaatcatacgtcattccgtatgatttaataattcctattctcctgactactttcctcaagatctccctttccccaaaactctcctaatcttgcttcctcaacattctcttccaaatatcactctcagccgtcttcttaataatatcatcctggcaaatacctcttctttcgtcaggtctttcagtgtgaggttttaaaaagcaacatcaactccttattcttcccacgtcggaatgacactatttggtaccctttttcctctaaaagccccttacacatgttatagatggtaacaataagcatttctataacatctaatataactacttattcacaaaataaatatctatttcattgttactatttaataatataaaaggcaaatggaatttccccatttgccttttatattattctacccctaaagctttaaacaccgcatcttctgcactttgataaaaacctatttgaaatttagcaaacaattcgggtggtacagttggtatatctacagccgataccatcggtaaaagtatttttttcgcccctgaatcaaaacaaacttgtaatacattggctaattcttctactttattaattgttccacttatactaatagatcctaatacaaccatttgactttgtactggtttattcaatgcacctgaacataatgcgataaatgctgcaagcgataactcaccagttaatccaactccatgaatatcttgaatatgcattaagtagtcttttgttgttgtactaatagtaccacttatatttttattatttgctttaaagaatcgaaaggcggtatctatactttctttagcatctcgatctgaatttaatcccgttttttcaaacttaccattaccactcacaacttctgtttccaatttataagtaccaatcattccagtctttccacgagcaactgtataaatatgccctggtttgttcatcccctctgggattaaagttcctccaccttgttctggaaccgatacaaactcttcattcattgattcattatcaatataagagaaattgacatcataaaactccatgccaccaattttctttaattgttccttcacacgtctgcgccctattagagcgtaacgtagtacttcttccacatcttcttttatatattcaccgttcggatataacaacttaatcaaacccgaaacagttttacgcactgcgattacatctcgttgatttaaattatttcctaatctaaaatatttatcgatcgcatctgagaaagaacgttttcgcatttcccttaaaaactctgctaaataatctgttatgaagccatattcatttgtgaaaaactcgggtctcattttaggaatttcccacccaggtaaatagtaatgcattcgatcgaaaaatgccgaatcatatgccattgcttctgggaacgggtcaaacaagtgtgaggttttcaataatacatctacactttgattaatatttcctacaaaaaccatagaagcgctagcatttttttcttcacggcctcgggcaaaagaacctgaagccatataatctttcataatctggataccatctttatctttaaatgtaattcctgcaacttcatcaaatgctaccgtatcccacatgccaactaatcctatttttctagtcgacatattataaaataaattcgcaaccgttgtttgaccacccgatactagaatcgaattaggtgaaatctctttatagatatgtgatttccctgtccccctcggcccaagttcacataaattgtaattattctctacgagtggtaccattctttcaagcaaatgccactttactgtgtcttctaattgagttggttccataccagttgaacgaataagaacatcgatccattcttctttggaaaattgccttctttgttcaaacatctcttctaaatccatattaggcatttgaattggtgtaacgctctcaatgctaaatggacttgtaccttttgattcttcatcaaaataatattccatttttacaatgcaccatataccacctgcaaggagcttatcaaattcttttacataatgtgaagaaatcggaaccccatttagtccaagattagaaaactctgcttcatatatgtcttttttatcatttaattttacgccaattttatcaatgaccgtatacttgccaagctccttaactttcgactttactttctctgcttcatctgggcgtacgaaattatccgataaaatctttttgaccatttgtacgccatcattcatactcttttcatcgtccgttgcacaatacataccaagcaagtactcaagtacatatactggtacattcgcaccttctttaattttttttgttaaatctttacgtactacttttcctgcaaaatgtgcgtttaactttatatttaaatcctccatctccactcaaccccacatttcttttagaaaccaaaatcatttgtaatggctatatcaatcggaaatgctactttctcataaatattttcaacagcctcttcttcatcctctaacactaaataatatttcttcgttttatcataagtcatgctctttagcacaaacttttctttaaacgtacgatcctctggcttagaagactgactatctgcgataataatattttcattagaaattcgatttccctcttcatcagtgaaataaacctttaagcgcaatggtgttttcttaccttcaattttttccgtttggaagaactccagatatgtaatactgtttgtaatctttcttgttaaacttgttaatttcacttcaacctttctcacatcattcttactagacttactacgatcatttttaaacttaattactggcactactatttcttgtagcattgcaccaccgtgtacatagtttgctcctgtaccttgaacagcgaaacgattcgcccctcgtggcacttttacatactttccagaaccttcacctaacacatagtccattgaaaaattcattgtaccttctatagaattggattcactagagataataaatcgtcgtttttcaatatctgtattcagaaaatcttttttcactttatcactagcttgcaatgtatctcgattataaataaatccgtgatccgccgtaataacgatattagatgcgctaacagtattaataagctgatctactaaagaacgaatatcttttaatgtttgttccaccgcatgaaacacttcatgttctgttgctgcatgatcgccccgtgcatcaattacattatgataaatataacttactttttttccagaaaagacatcgcgaaattgttgacgattcattgcggctaaatccttatattgaatagctgtagagtctttataatgctttgaaagaatcgttgctctattttctgtacttgatgctttgtaatcatttacatatacttcagcattttcattaaaagtgattgacttatacggaagtagtgtcgccatccctaagtccgtatatgaaggcagaacaccttgcatcgcgacaatatcagtcgatgcttttcgttccacattcaacatattagataattccttcgcaacttcatagcggagtgcatctgatataattacaaacactctctcttctttattaacaaatggttgtacaaatgagcgataaaatgtatgttgtgactctagacctgcaattggccaatattcttcttgttcaccctcaagcgcatctgaccattttattgctaaatcatttatatatacatttgtatatatgttttctactttatctcgaagtgccctaaaaccatctttatcttcaatctgatcgaatgctacataaaattttctatatgctgtgtctatattgtgatatttactctcgtatgctttaaataaatcaaatggctgtgattcagtaattgcattacccatttcatatatttgttgaaataactgaatcgcttgatacagtgcttcgtactcattacggaatacactaaaccaatgcaactttcttcttgccgcaattatttctatatatgacgtgtaatcatgaattgcattcattaattgttttgtaatataagtaataatgtttgtatcaaaacaacagaacgtatctgacgttatataatcttttatttctttactttgtagatgttccgtcactttcacttgtttttccaccgtatttgcgagctcattgtaaattacttcatccgcactatgattcataaattgattcataaatacaatagcattcattggtatagctgaaatgtatggttgccatgttttgggtatatctccgctcaatgtttcactaacatttgttaataagaagaaaataaggagtgaattaattgacttatcttgtaaattgtagccgtatgttttctctacaaggttccaaaatgtctcttcattaccaaactttcgaatgttctcccaatacttattcgtttcttttagttgttctctaaataacgcctttattacttcatctaaattcacaatattacatttacataaagatgctaatacaacaagatcaatttgctcttctgtatattcaggaactgaaaacgatttaaacaacgcttcacgttctttgctcttaaagaactttgtatatttcttaaatacatctcgcaaagcagcatcatttgttatgcctagctctcgcatcatgacagtcattttatctgttgcaaactcttgactatatttatacacatcaagtaaccaatcttctcttgctgaaggcttagccatatttgcataaattaaaaagttagaattcacatcatttttttctacttctaacttagtagcaaacatattatgcggggttaatttccaaatacgaacaccttctaaattcagctcatctatatcttcgataaactcgccagcttcatcataccaaaaaacaatatgacgcttctttccttctgttaactctttattgaacgtatcttgtaggacacgatttatttcttttgtattcatacctcaccaactctcaatagtaagaaatagactcagcgttaccgctgaatctattgtagttttcacatattataacacgttaaatctttgctaatagattagccttaagtggctttttgccttctccttgcggaagctcaacattttggaacttcgcatagtttacttttacaccatcatctaaatcaattgttattttttgatttgcaatatgagcaattacttgatcatattgttggcactcaagaagttgtttttgtaacttttctttttctttttttgcacgcgtcttatcctttgttgaagcatcagactcaagtaatacatcacgacgtgcaatttccgcttcatacttacgttgaagcgtatgaagataatcagtacgaacctccgcaactgtaccaacatcataacgatgcatataaacgagagctttaaacccatcatttttaccactatcaaacaaccaataaattggacgtttttgatacatcttcacatgatccttaaagaaatctttcaagaaataacgacgaatacattgacgagatgtttcattcgccttcttatttaatgcttctgcaataaaatcaagattctcttctagcgtctcttcactaaacgtaacacgaacaaattcaataaagcgacttacaatatcgtcttcaaaatactcatcatccgtaattggaatgatattatccgtatctgctttaaatgttttatatttactctcgtcaaactcaccaccagcaaatactagtccttcttggtctagtgaatatcgaccaagcatacagcctacggcgtaggagataaaggatttgatgtcgcgttctttgtctgctttccgaatgactatgtctttttcttttacttctggtgttaaatcatcctgtagatcatagatttcaataaaaatacgatttaattcttcctcatttgcttttaattgattaaattgttgttcagcgaatacgctccaataatctaatacttctgataaccttcgagaactatttttatgagtaagcatagggtgacgaatgaatccccaagaagtttcaaaactatcccaatctcttttcgaaatacttatacaacttgtgattaagtccattttagcttccaataaattattaaatgtcatcaatggaattttccgaacatcacctacttgaaaatgcaaagttggattgattttttctaaaaaaacaaatgctacgttactatttaagaatgccattaaataataatcatctctggtattcccagcacttaaaaaacaaccttcacaatcaaatattgttccttgattgtgcaatcttacccccaataaattactagtagttctagaccaagtaataccacttttaaaatatagttgtttagaaggaagacaattaccttgtttcgctaaggtattgtaactttctatgttgaaagaaattaaatattcattattcccataccatttcctaaatctcccccccttattgtgtggaaaccactttattttactttcgtgagcatctgagattgataaagcaccccaatttatacgtaccttatctacttcatgccataaacgtaaaaatctatcgttatctcctgttgccaatccttgtctaggatcgtataaatcacctaaaactttattttcagaaaatgcaactaacattttttgcgtagcccaatatgcaatttgatatcctggcacatttaaaaataaatctgccgctactatatacctttcttttttctcaagaaaagatagttttttttcttgagaatcattatattctacaagcctaataaatggagtttgataatttttaaccacctgtttttttaatacaaatgatgtcgattgaactacctcgccatttatttcttcaaaactgccagatcccaaatgaatcatagagcatatagtactttcagataagaaatactttctaatttcttcataactagataaaaacatccacgactgttgattgatgttcgaaatatatccgccttcttttgtgaaattaaaacattttaacataagaacagcaaataaatctcttttaccttttttaaagaattttgtacaatactttttaagttgttcattcatacctttactgcccatatacggtggattcgttagaactacatggtacttactgctcattatttttgcttgtttaattaactgaggtattttaataagtaaaatatcactatattgaagagaaaaaatatccttaacctcttgcatttcttgaatctctatcattcttttttctattgatacaaaatcaattgataacacttcaagaatagagccatattctttcgaatcttcaaaaactctaattaagtacgttatctcatccctatccaacgaatctcccacaaaataatcaatcgcctcttgtgggatcccattactttcctgaatagaacatacatttaattcaagcggcctacggaaaatacggcggttataactacgcgccttcatcattaacgcaaaataagcaagctgtgctgcacgatcatcaatatcgagtccatataagttcttctctaaaattaattgcggaatttctcgctcagagtaacctgcatgttgataaatgttatataatacatcaaatgcataaacaagaatatgacctgaccccatacacggatctaatactgtaatatcttctgggcttagttcattatttttcaatttttctagttgctcttgtacattgggttcctgctctgcttcttctaagtaatatttccattgctgttgtacatcttcatttggatgagattcaagccataagcgtcctaatgaattttccaccatgtattttacgatccattttggtgtaaagagctgtgttgcagctggaatgttttcttttgtgatttttttatttttcttcaaatcagcaaatacttcatctttcttctcagaaatatagtattgatataaccatccaataatctcaacttgttctttccagtcttcttcgtcaatcatcgaaactaaattacgtacaactgatccttccccaagtaaattatctggtagtaataattccgtataatcttgaattgtttcaaacatcatcggcataatttcaccgagtttgttacattgtttaattaaaatatatttaaataaatcttcagttttgttttcatcttgcaatcgatacacgatgtctaagtttaagtctaaatcttcagcaatattcgttacttcaccaattacatctggttcgtttttcccctcttgtgttgaggaaagaactcgtacacctgttggcaaatattcatttacttccatgaaacgaatagcaataaaacggttaaaccacgtgtaggaaacttcttcaattacttgtttatagtctttttcttcgattttctgaattagttttttacgttgttctaattcataacttctaaagaatttattattaattcggaagccatcttcatatgtttctggttctttaatttcagtttctgtaataccaagctcatacgctttttgctttacagcgtcaattaatttcatacgagctgatactgcaaagtttttgattgcagttttattcattatgtattcctccattttacttatagaaagggaggatagcacctcccctttttattactttacactaatttgataactgaagcgtcttctaattctttttgtaattgttttcgaatttcatctagtactgcttcaatatcttcttcattttcaattgttttcgttccgcgaagtattgtatttttactaattgttttctttttagctttatattcaacgatcggatcaataacagtagtacaggtagttcctgtacatggtgatgtgacaggtggtttacgtctttcaacttcatttgcaatgtcatcaatacatcttactttcaatcgatcactttctgtttgcattgcaattgcttcatagaaattgtttacacggttcaatctatcctttataccatcaaaactatttttaaatttgttaaagaacatacttttaatctcttcatgcttattaagttcttctaaaacagtttgataatcagattcaattacattcttaactggttcacattctttttctaacaattctacaaatagttcatcaaactctttaataagccctggcaattgatgaatatttttatacggttctttatgtttcacaatcttcgagatactctcaatgaaaccagttaccttttggtcagttacatatgtttgattcttctcaaagatgtttaatcgtttcactgcatcgtcataaatatctcgctgtgtttcaaagaaagcttttacaggctccacatcttctgcatagtccaagaagtcattttgtaattgttttactttattatagaaacttgtcgtatctgaaatgtttagtagctgttcaatcgattctttaccatcttgcaatacatcttgtcctggataaaaagtattacgatattgaactagcagtacattaattttatttttctcagatactagtaattctttaaatcgattcattaatccatcttcatcatctggtaaagcagtaacttcaaacacttcttttgaaagatctttaacaactttcattagtgcgggtgaaatacgttccctctttttcacaacgacacgttctacataatcacgcttcgttatgtaatttactaaatcgcgctcacttgttgttaaattactactattcaattgtaatttaatttcttgccctttaaacaatttaataataaatgaagcaatatcaagatctttccacccatatggttgttttgtaaaatgggttgtgatgcccttaatcgtaatctgttggttgcgggttgttaaacgagtgatatagtcatttacctctttaaccgctaactgattagcatcttcattatcgtccgacagcgttaactgcgttgtattttcaactaacaattcatttaattgcttcgctgtatcaataaatttcttcacataatgcagcttattatataaattatcaatcaatactttaaaagcatcattaattctctcaacaggatttttctctttcacatctaattgctgcgaattaacaaagatttgggcatgttttaatgcttctgttatataaatatgaacgcgatcttttcgttcattcgcttctcttgatttacgcactttaatatcttcgatcgcttgggaagctgctgtgccacttttgattttcaagtatgcttgtattcttaatatctctgtcatttcatctaaataagaagtgtcttgaggtaattttaatattacattactctcacgcatagacatcattttcaattcagagtcatttaattcagtcgttgcatcgaaatatggcgtgatgatcttcaagccaatatcattcgtctgcataccaatcggacgatcgtcaataattgtattaaaactaaaatgatatttaggagaataacgatattttttatcttgatagactacattaaaaatgacatcaccaattttttggataacttccgctgagtcaacatgcatatttttaatttcacggttaacatcttgttcatcatttgttaagaaaatatactcttgtccatttttttgaattaatgtttctttacttaatcgaattaatgaactttcaattttcttcttcagctcaattttatcgtcacttatgttttgaatcattaacgttgctaaattttctaggtttgcaggtagttcttttacatatttaattaagaatagtaatttcaatacttctacatcgtatgcatttaagcgtgaattgttttgagcatggatgattacagtacgaatactcgaatctaaaaatgcttcaattgtttgatagaacgccgaaaatgggataagagctccagtctcactttcagcatatttcattgctgattcttggaatgcactcaataaagagcgctccccttctgctaaatgctttcctgatgccccatgaattcgaatacctgtaaatactttttgtagtaaattaaattggtatggaataaacggataaacatctacgaaatcttcctcattattaaatattttcatttctgctgtatcaccagagaatgtaattaaattctttaagatggaactgttatcaccataaaggagtcgtaaagtttgtttaccaacttcgttttttaataaaatacgttttttaattacttcatctacgtgagcactagacaggcttaatcttgtatcaaaacgaccttgaattttcgaaaagtcgtttccgttaactttaacaacagagtcaatatcttgctgacttgttaccaatacccatacttttcctccgcactgcgttccgatatcttctactactgtttgcagattcaacattagttgtgaatcattaccgatatattgtcctaattcatctataaggaaaacaacatgatggttatttcctttcgcttctacatattcacgcacacgtttagcaaaacgatcgatactaatgaaataatcctcttctgcacgttcataccaattacgtgctgcatcttcactcattttcgttgtttttgacaacgcttctataatcgaatcttcttcataataaaaatcttctcgagcttcttcccatgtattacccgaaatcttttcaaattccgccttaaattcctcataacgcccatctttcaccatttgacgttctaaatcagctatccaagggatcgagccacaaaatccttgcatttcattaaatactttattaaacacttttacaattgcatttttatccgactttgaatccgattcgcttttagaatcaatattaaaaagaattacatctgttgttgtatttccggccagtttcatatctgcgaggaccatcggatctaatattttattattaaaaaacgaaatggcatctttattgatttcattttcatccattacatgtttattctctaataaataagaaaggatttttaagaagtgtgatttaccagatccgaagaaacctgaaatccaaactcccattttatccgtatgccccgtaataccttttttatatgatttaaagaattcacccatatgatgtaacaactcattggttacgacatactcatctaattcttgataaatatttttatcatcatcttgtccaactttaataacacccttaatatcacggttaatctctttttcaaacattttttgaatttgcatatactacctctcctccaattctctctattatttatcaatcaattgaaatgctctatagtaattatcatctttgatttcaccaaataatacgagctccagtccatcatatgtgcctgggaaaaacatcactaacggtacattgtcgactgctttatgtaagttatttaatatcgtatgcgagcgaatgattggaaacacttttcctactcctgtcaaaaaaacaatatcattaggttgtactctatctgtaatatactgcacaactaaatcattgttacttgttagacgcaaagcttttcgtgtcgcatttaagataaagtcgctcccttttttttgctccatatcgatatttttttgcaagtagcctttttcctctaatatttctagcatcacttcatataaatcgaattctcttatatgtagagaactatcattttttaaccgttcttgcatataaacaatatgttctctcacaagcatctcgtatttcggatcataatcaaaaatataaaaccctatctcattgcctaatcctttattttcacgaaaggatgcatctgtaattttcggtaaaatttcatctagacgttcatttattcttctcacactattcacctactaaaatatccatatatataccgtcacctaatgcgcgtatatgttctactacatcaatatttaataacggtctttcaatttctcgattacctttttgattctttaaataaccagcttcaaataatattctaatgtacacttgtttcaatttataaaatgtataatcattccatgatgcaaccttttcactttgctgctgtttattttcaaagaatatattaaaatcagcatctgtcagaaaagtttcaccaaaaacaaacttctctttaaacacttcattcataaattcaaaaaataaacggtctgttttcataatggaatataatacaatagccttgctggattctatatctccatgtccaatttccctaattaaataatcatctaatatttttaaacgggccaaaacacttgatgcaatttccttttttctcgattccgtattaacttgaaaaatattttctgaaatcgccttttctttcacttcgaactctttaaaccctttatttaataggattgaaactttcttcatctctaaaaacagaagtggacgggacttaatagttgacttataaacttgctcttttaccattttttcacattccttcgggccacttttttgatatttctattgtacccttttaagtaaataaataaaagaaatttctatattaaaataaaatctagcattatttacgtcacatatataattacttacagataaacaaatataagaatattaatcactaaacttaaccatccccccataccacccactactctcctccaaaaaacccctcgtctccccactccccttataaaacccctcccaaccccgctccctcaaaatccccttccaactatcactctcaaccatcttcttaataatgctatcccaataagcaacctcttcctccgtcatatcttttgggcccataattcctttccagtgctggaatatgacgttgattccttgttctttccatgttgggatttctggtagtcgatctagtcgttttggtgcggatacggctagtatttttattttgccggatttgtattgtttttcggcttcagatagggtcatggttgcggactggtcggacaaacactgttaatgcagcaatatatgaatcaatttaaacaatactcactgactccgggacaaatccttttaacgagaaatgatttttcgaaaagagaacggtatcgaaacgcgtatgctacgataatggaattattagagcggggcgtcattccgattatcaacgagaacgattctacatctgttgaagaattgacattcggagataatgatatgctttctgcgttagtcagcggattgattcacgcggaccagctcatgattctcactgacattaacggactgtatgatgccaatccaaatgaaaatcctgaggcgaaacgatttgattatttgccagagatcacgcctgaattgcttggatatgcaggttcagctggatcaaaggtcggcaccggcggaatgaaatcaaagctgttagccacacaaaccgcgctgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaagaggcgatgatccataatggaagcagccttttgcccgctggagttgtgggcgtgaacggaagctttccgaaaggggcggttgtggaagtcaggggaccgggcggcgtgatcggcaaaggccaaactcattactcctccgaggagattatggaggctaaaggcaaacgcagtgacgaacttgattttgagaaaacgtttgaggttattcataggaatgactgggtcaatgtaaaagactaggaggcggaaaaatgagtgaagtttctgtaaaagcgaagctggcgaaagaagcagcagccgaaatgatcatgaaaacaacagccgagaaggatgaggcgctcagcctcattgcaaacggactccgcaaagaactggattttctcttggcggagaatgcaaaagacattgtgaacggaaaagagaatggtttaacaccggacatcattgaccgtctctcattggatgagaaacggatacgcgatatcg

SEQ ID NO: 6140 - DNA, 19 bp, Artificial sequence
  Single strand DNA oligonucleotide
atagaacccgaacgaccga

SEQ ID NO: 6141 - DNA, 34 bp, Artificial sequence
  Single strand DNA oligonucleotide
aaaccagtaatattgacttttaaaaaaggattga

SEQ ID NO: 6142 - DNA, 24 bp, Artificial sequence
  Single strand DNA oligonucleotide
actacctctcctccaattctctct

SEQ ID NO: 6143 - DNA, 73 bp, Artificial sequence
  Single strand DNA oligonucleotide
gtttaaattgattcatatattgctgcattaacagtgtttgtccgaccagtccgcaaccatgaccctatctgaa

SEQ ID NO: 6144 - DNA, 21 bp, Artificial sequence
  Single strand DNA oligonucleotide
ttattaattcggaagccatct

SEQ ID NO: 6145 - DNA, 20 bp, Artificial sequence
  Single strand DNA oligonucleotide
agcagtcgacaatgtaccgt

SEQ ID NO: 6146 - DNA, 25 bp, Artificial sequence
  Single strand DNA oligonucleotide
ttcatacctcaccaactctcaatag

SEQ ID NO: 6147 - DNA, 17 bp, Artificial sequence
  Single strand DNA oligonucleotide
cgcggaacgaaaacaat

SEQ ID NO: 6148 - DNA, 20 bp, Artificial sequence
  Single strand DNA oligonucleotide
atctccactcaaccccacat

SEQ ID NO: 6149 - DNA, 22 bp, Artificial sequence
  Single strand DNA oligonucleotide
ctatgcgaagttccaaaatgtt

SEQ ID NO: 6150 - DNA, 72 bp, Artificial sequence
  Single strand DNA oligonucleotide
ctttcttcattagaatcaatccttttttaaaagtcaatattactggtttttcgcctctaaatactcatccat

SEQ ID NO: 6151 - DNA, 21 bp, Artificial sequence
  Single strand DNA oligonucleotide
agaggatgaagaagaggctgt

SEQ ID NO: 6152 - DNA, 24 bp, Artificial sequence
  Single strand DNA oligonucleotide
actacctctcctccaattctctct

SEQ ID NO: 6153 - DNA, 20 bp, Artificial sequence
  Single strand DNA oligonucleotide
cgctgattgctcaagtgctc

SEQ ID NO: 6154 - DNA, 20 bp, Artificial sequence
  Single strand DNA oligonucleotide
tcatcacttcaggcagcgtt

SEQ ID NO: 6155 - DNA, 34 bp, Artificial sequence; identical to SEQ ID NO: 6141
  Single strand DNA oligonucleotide

SEQ ID NO: 6156 - DNA, 23 bp, Artificial sequence
  Single strand DNA oligonucleotide
ttcgcctctaaatactcatccat

SEQ ID NO: 6157 - DNA, 22 bp, Artificial sequence
  Single strand DNA oligonucleotide
ctatgcgaagttccaaaatgtt

SEQ ID NO: 6158 - DNA, 25 bp, Artificial sequence
  Single strand DNA oligonucleotide
ttcatacctcaccaactctcaatag

SEQ ID NO: 6159 - DNA, 17 bp, Artificial sequence
  Single strand DNA oligonucleotide
cgcggaacgaaaacaat

SEQ ID NO: 6160 - DNA, 23 bp, Artificial sequence
  Single strand DNA oligonucleotide
gctcatacgctttttgctttaca

SEQ ID NO: 6161 - DNA, 21 bp, Artificial sequence
  Single strand DNA oligonucleotide
cggggttgggaggggttttat

SEQ ID NO: 6162 - protein, 8 aa, Artificial sequence
  P-Loop Motif
  misc_feature (2)..(5): Xaa can be any naturally occurring amino acid
  misc_feature (8)..(8): Ser or Thr
GXXXXGKX

SEQ ID NO: 6163 - DNA, 1853160 bp, Methanobrevibacter smithii
acaactcaacagcttcttttaacggaacattatctgattctaattgcttaactaatttttccaattcttctaacttttcttcaaaacttttagtcatattatcaccttttattttattttaaactaagtaatattaacagtactataacaatagctaaaaacagtactataattacatttttagctttggattttcttatttcatcaggatcttttacaacatatcccttttccagcaattcatcaggatttaaaatctttaatttttcttcaagaatccttaatttattttcattactgtctaatgtcttggtaatttctgcatctaaacttttatgtatttgagccattttaacaaatttatcgtccaatacctgacacggattgctgaaaacatgattatttttaattatttccaaatcatgaatatgcgaattcaatgtgacattaattgaattatttaaattattctcaattaaatttaaagaatttttttttaattcaaaagattcaatgaaattcatggatttcaaatttttaaagtgcaggttaagtttattttcatattctaacagacagttagacatgttattatccaattcatttttaaataaagtaattttaccgacttttttatttaaaatataatccggattattcagaatatatgaattattaaagttatcaagctgcagttcatttgactgaatcagctgatttaatgatttctcagcagttgtttttaataaaactaaatttgtttgatgattcttatactttgataaaggatcttttaaggttttattgtttttggaaatattgagtttatgtgttaaattatctaatttggaatttatcaaatcatttaatcttgtttcaatattttttagtttttcattaagttcaactttatttggaacaaccagctcagctgcttttgtgggtgttgctgcaactttatcggataccatgtctgaaagcgttttgtctgttgagtgaccaatagctgttataaccggttttttagaattagctattgaacgtacaatttcctctttgttaaaatcccataaatcctgagtacttcctcctccacgacctacaattatcacatcaacatctgttttgtttgccagtgcaatatttttagttatgcttcgggtagagttggctccctgtactgtagtgttccagacaattatttctgcaggccatcttttttcaatgttgtttacaatgtctttaacggcttttccgcttgcagaggttattactcctatttttttaggatattgtggaattacttttttgtctttaaataatccttctttatctaatttctttttaagcttttcaaaagcaatgtataaatctcccaatcctgcttcctgcatttttcttactctgaattgcaggtttccacgtactttataaaatgaaacttcaccactggctacaacatccacaccatttttaggttcaaaatccaaagattttgtagataatttaaacattacacaggaaattgaagagtttttgtcttttagggagaaatagtagtgtcctgaattatatgatccgttaaaattagttatttcacctctgattttaatctttttaaaatcatcacagtagctaatttttttatcaatcaaattattgattgcactgattgagtaaatatcattttcttccatcaaaacaccatgcaggttaaatttaatattgaatttaatttgtaataatgttttatcattaatctgatttaatcattgttatttaattgtgtcaactaaaaaaagtattactttaaaaaaattttttattacaaattcaaaaattgaagaaaatggtctttttgtagcagctaacctatatgtcctgatagttttttgacaccttcgcagaaaagagattttcagcctaattttatatataaagagaacgtatattttatgtaataatatacgaaagtaaaagaaagatacgaatgttttatatactaaaaaaacaaagaataaaatgtagcaaaaattgggattaaaaaatcataaactaggtgaaaaaagattatgattgctacaaaagaactttcaggatatttggatgagtatcttgaagaaaaacaagagataaagaacctaacctcagaaacaattaaaaaacaaacatttaatattaatcagtttatcagttaccttgaaaatgaaggaattgaagaactggacagcacaaatgttaaaaaacaactaagacactaccgtagatactgtcttaaaggtagaggcaataaaaggacaacagtgaaaacatatatgatgaatattttagaattcatcaactctgaggaagttcaagaagaaatacagcatgatcccattaaaatgaaggatatcattgaagttaaagtcgaagatcctgaaactgctaaaaaaagaattgaaaaaataagtttaaatagccagcaaagcaatttcctacttgaaacaatagaattaagcggaaatgcaagggattatgcaatctgttctacatttcttgactctggaattaggttaaaagagttggttggacttaataaaagtgatattcaagttccattagatgaaaatggtttttatatcttgcctgatgacgtaaatagctatatagaactacatctacgtgcagaaacaacaaaaggacagtctaaagaccgcactacatttataacctatgatacattagccagtcttaatgatatgatttatgaccgtataacaaaacttagaaaaaatacttacgatgtctacagacctgttattcagcgaaaaaaagctgaagctgaaaaaactcgtgaagaactttttttaaatcaaaagggaaaacgtataggaaaacgtgcagtccaagaagtgataaaaaagtatgctaaactaagtgatgagagaatagctaatgaaaatatagattgcccggtaaattacgggaaaaatgttagtgttcatattctcagacacactgcactaagccattatgctgaaatccttacagtagcagaggttcaaagtatagctggacacagcaacagtcaaacaactgacaaatatattcacgttgaccgtgagcatattaaacaaaaattaaaacttaataatatgaaagctatgtaatttagctttcttttaaatatttttttacaaaactatcctatatcaatagcttgacctatatcatgccaacccatttagctagtttttcttttataaatttcatgaaaattataaaatcccagccaaatatttgtttatgttctgatttaagataaatagcgatttaatatttgtttttatctttaaaattaaaatttaaatgtttaatttgcttaaatatcattgattaagcattaaaatataaaataagtttatttaaggtctttttttataagatttattaaattttaaatattatatgagtcggcattagtatgccgaatatttctgtatttacagataaatagtaaataagaaaaaatagttaaatagccattataagtataattactataataagtaagatagcaataatactattaatatatattatagctatttatattaaatagatattttctgtaaagtatataaataatatatactaccacttatacccgaatcatattttattaatttttaagtgaaattttaactaaaaattggtctaaatcatcagcttcatatatatgtaactaatacaaaaatactattttaatcaatactttcattaaatccatacttcaaatcaataattcgagcacttttcattaaatttattaaattttatagaatttattaaattttattttactggctgcagtgtaaaataatttctcatgataaaagaaaaaggaatttataaaatcccttaatcatcataatattctccgttgcttctgtattttactgttgagctatacatatcaatataattttgactgtgatatccatgtctatcaggcatatctccactacctataggtcttccagatgctttatcatataaaacataaccttttccatcactatcctgcttactgtaccatgtatcaccttcacaaacccaatcagaatgaggatctttggattgtgaagacgcagaagaatatgatttatattcatcagatacttggcaaacatcagcagtatcattagtagtgttattagtaatatttgcagtattatttaatgttgtattatttaccggttcgctgcttagtgaaacagtataaatcaaaccaccgataaggcagcacacaatcagtataattatagctataatagttctttcattgtccatcttgtcaccaaaattacatatttaaaatataataaaaaatatcatacttacaatattattatattgtttatactatttaaacacatattattcattagcatcagttaaaatcccatctatttccaaaagattattggcaaaatagattttttcctgcttatctgatgtggacaatcccatttcaatcatatggtccaaaagaactttcaggctatcataataaccattaagattatatacaatacatggagcatttatctgttttagggcaactttagtcattatttcagttatttcatctaaagtacctgtacctcccggaaaagcaatgaaagcatctccaagctcaatcattttccttttccgatcctgcaaatcactggttattataagttcgcttaaattttcatggtgcaggttatcgtctataaaaaactcaggttcaacaccaattgccataccttcagcattcagaacactgtctgcaagttcccccatcaatcctatttttgaaccgccataaacaagtatatgattattttcagcaatccacacaccaagttcccttacagcttcttttagaaaggggtcactgccttcatgtgatccaagatataccgtaattttcattaagttacacctattatgttatatatgcttcaaattctcttaaattccaaaaataaataatataaatgaaattacaggtataattacaccatgcttaaaagttttttcatcactgattaatttcagagacacataaacagacagcatgattgacaataacggatacagtaatgtcctgtcagagtttattaacctaacatttaaccatgcggaaagtacagaaattaaaagtattaaaactgtcaaataaccgattcctattaatgcatatcttttattttttttcataatcactgcttacatcagtttgagtatttgaatcagaattatctatttttgttccacattcctgacagaatttagaatccttttcaactaatacaccgcaattaggacaattaaccataaaaacatccctccagttgtttttatttatcttgttaacaatatataataattatgttttgaaaacagctaaaaacaggatttaatgatatttcgaaacttggattttttaaaaaacagagctgtcaaaacagcattttgtctgatttaacaaaaattaaaaatataaaaaaaggcagaaaaaatattttaggtaatttttctgattaatactgaagtattgtttgtattgcctgtaggcaggagcattacttccttatggaatcctctggtgtctttttcagtaaccggagaatataaaatagctctcataccagtataggttctataaagaacaggtgttttttcacttaccacatcccaaatattggaaaataccctttctttaggttctgcaaaagcagctaccatcaaaatatcataatccaaatcagctattgtattttcattacctataacaattttaatatcgtcgtcaaggtttaatttttttaaaacttttctggataactgggctacatcttcctgctgttcaattccaatacatttacatccgaatacttcattgaacatgattaaagttaaaggcagaggtccgcttcccaaaaatgagtctgtaaaattttataggcttatttgttttttaattttttacagttgaactttcattttgatgaaatttcattctaatttttctttaattttaatataaatgatttaaaaatagtaaaatactttaataagtgaggacaaataatattttatgaccaaacaaaacaaatctgccctcaatagtaatatagacttcatacaacttaaactttatgatttttttgatgaaaaaattgatcaagaaaaaattatttcaaaaagattgaataaaacacctaattttgaaaatactaatcataaactatttttagatgaaaataatacttttaaatatgataatcccatttgtccagtttgtggaagccacaaaataatcaaaaaaggcacaataaagaaaaacaaacaaaatactaatggaaaaacaacagaattcaaagaacagcaatatcaatgcaaaaaatgtggaaaaaaattcggaatatacaataatccattaattggtgaaaataaacaatttttacaagaaataatggataaaattccaggaataatgaaaatagggtaccaatcacttcgtaaaataagtaaatactttgaaatattccttggaatcagaatatctcatcaaacaatcaagaactggtctgacaaaaatcacgaagaaagcatcagcaatgaaaaatttgaatattctggctattatttatatgatgagcaatttttaagacttaatggaactagacactacagattaactttatttgatgcaatactcaatattccagtcacagaacgaatagtacgtcgcagaataccaaaaaacacgaaaaaatttatcttagaatcaacagaaaataaaccattcatttgcctaacaaccgatttattcccaatgtatcgtaatgtagcagatgaaatagaagtaaaacatcaattgtgcatatttcatctgtttcaaacaataaaccataaattaaaagtatattgtagaagaaacaagattaatggaaaacaaagagaccatatttacgaaaatgcacaagaattaaaaaactgtttcagacaaaactcaaaaaaagaagcaatagaacaatttaaacaatatttacaaaaatatacggccataccagttgttttaaaagatttcataagaaaacatatcataaatcacttccacagatacgtagaatatcttgatgatgaaaatatagaaaaaacatcaaataaagtcgaaaattactacagacaaaccaatcctgaaaaaataaagaaaatatacaaaaccaaaaatggaatcctgacatttttagactatcaaatgcaaaattggactgaaaaacacattaaaatcaaataagcctataaaattttacagactcccaaaaataaaaaggttttttcctcattgaatttagctaatttactttcattattaattaatcctatataacggtcataaaagtgaaaagagtcaagtacttctcttggattatctgagttaagtatttttaatgcattttccatttccagtctggcgccgacataaacgtaaaacttacggattaattttaatgccctgttcatcttttcatcatcaagaatatgtttagcagagtcaaaatcgattgttttatcatgcgcaataacttcaacttcatctaaaatctcaataacctcatcgatagcaacatcatccaaaacgttcatatcatcatcaagattaccgaaattggaaagtttatcagctatttcttcaattttaccccaatatttataacaactcataatatcacgatattttttcaaattaaataacaaattatatatagtattttctagtttattatatattaaagtttagtatatgataataaagtattactaaagctttaatttaagaaataaagtaatactttcattcttttaaaaaataaagtattaaaaatcgattaaaatttccaaaaaagtaatacatttaatggaggattaaaaagtgaactttaaaattattcaactgtccgacaatatttgtgaaaaaaccagaactcagaagtttttatttaagcagattaaaaaagaatacggatacggatatgtgccggaatatcataaagacataattaatctaaatgaatactacataaatcctagaaaaaataatttgttcctagcaaaaaattctgaaaatgatgaaataatagctacaatagctgtaagaggctatgacaaaaaattcaaagaatttgaaggattatataataaagaagatactgcaagcatttggagattatatgttgatgaaaaatacagaagactgggtcttgcaacaaaactgttcaaactagtagaatcctttagctatctaaacagctataaagaaatttatctccacacccataaaaatttaaatgggggattaaacttttggaaaaaaatgggctttgaaacaactgtagatacaaacaatgaccttcagacagtccatatgattaaaaaattacctaagttcaaactcaataatgttcaatccggctataacttagctattgaatccttaactcttttttaattatcattttatttaattattattccgctatcagttgttatgttatctgccatataattgatatgacctcttctggctgtttttttaacattgaaaaatatgtttagtttatgacctgcaactgaattattatattctgcatttaatttattatacatcccttcgcttatggtatattttcttccgtcatctccaacgatccagtaagctttggaaaaatcaggaccgaactgtgtaaattcatcaacagtaactgtgttattgtgatatccgatttcatctatttcctcattgaatttggcatcatgaagagtatccaataaaaatccgcttgcaccaaatattatggcaaaaagtattgctgctccaactacggaagaaacagagtttccaataataaactctttttttgaagtctcatttttataatctcttccattaacaataaatgcaaatataaaacatgcaaaaaatatatatttaatgcctatttctaaaaatactgcaaaacaaatcattaaaagaatgaaaatctaatatggccagactaaaatctactttcatatattatagttacatatgatttaataaatagtttaggcatatcttaacggaaaattgccatttttgagtatgataaatcagcagcacattacagtaatggcgattattttcagaaaattattttttcccctttcattggaataacttcataatattatctcattctagctgaaacataatattttttctaaaactttacctgcaactgttacatcttaaaataattcataaatttttgataataatgatttgtcattttttgagatttgttttaattgatttaaaatgtttaaatagtatggttgagtataatgtacttgtcctaaaccccattcatgattttcatccagtattctttcttttttaattttaagggtgattacatctttttgcttttttaatatattatctactttttttaaaagtttattggtgttttttgcattggatttaaaatttttatttacttctatcttattatcatctttaagtattttataacctaatcgaacgggatttaaaattatttgtgaatttggtgattctttttgaatataatctaaaaataagcccatattttctttgtataattttagataagtgtttggatcattatacatgttgatttttgtgtatggcttaatttcagtatgaaattttgtttttggcaaatcccagtaattatttgtaataaaacagttttcatattttattataccaaaaatcacttcaaaataattatcaattaaaatataatctggtttaaacttttttacttctgctaaaaagttcttagttaaatcttgattaataaattgtgttcctgctttattcaccctattttctggcaatatttggatatcctgatttttaaaggatactggttcttgcataagacttattattgaacctctttgtgatgaaatagagcaattaaaatattttttataatctggatttatgccactgtaaaaattatctctacttgcacatgagccaaaaacagcaatattgtatatcataatataatttatttttttattatattattatttttttatttttattttaaactactttaaaaaagattgtatggaagaaaatgtaataacattactttgtttgatgatgaatggattatctttaaatattttaattcaacagaataaagactattttttaaaggaaagtgaaaaaacatggagttaacttttaattaaatattttcgaaataaagatacaaaataaacaataacttttaagaaaagcatgttaaaactttggtttgcatttgtcttgagattataacatttatttgttgaatcaaaagtcaattccaaacttttatttactgttcagtcaggtattgtctatggcacacttatcataatataagagtcttccctctttcaattaatctatgagattatcatcaactaagaaatcttttcaattaattgttaacttttctttcattaatgtgctgatcaattccaattttaattgcatctttgaagcaaacatagtttaaaacagctaaatatcaatatatttaatttctttaataattggtgcaaactgaggatgtttttcaatgaactctaaagcaagattattatgatattctctggctttaactccttcaagggatctagctacaactctttcttgcctaatatctttaattaatttttcatcttccccaatcacatccgatctttttctattaaaattaggacaataatccataaccattaccctaatcctcattggaattggttctctaagatttattaattcatccatcaactcttgaggcatattctataaaaatttgtcatcactttttaaagctcttactttcattgattttcacatctttatatagtcaaattttaattccatatttttgaagcaaacatgcatattattcattcaatatataatattattaatccttttaaatcaaataattataatttatcaaataatgatgtgaaataagggtattttctaataaatatgtcaatttcataatccattaatttgtgaccattcattgtacttctagaattttcaattttatgttccaataatcgtttactcaataaatctttattggtagcattttttcctaactttaaagaataacctttaggtaactccattcgaattttatagggtatccaatcttccagttctgttaaatcttgaaaatatttttttaattcatttttattaactttatattttcttttataaaccatagattcttcctcttaaaaaagtcaaattttaattgcatctttttgaagcaaacatacattgagcatggttgggcaataacaaataaaggaactgtatcagggattttttcaaatggggcgaataaagaagtagctttatctactacttttttagaaattgcaaaggaagataaaggtattttatatttaattcataatcatccaaaatcaaaccccccattaccttcttctgatgatttagcttattttacttcattagaaataaaatatggtttagtaacaaatgaagaaggtacttttattcttaaaaacaataaatcttcacaaaataaagacaaatataaagaaatctatgaacttggtgtaaagattgaagataaaatgaaagagcatttttctactgatacaggtatggttcctccgcctactttgtatgagggtaaacctgttaaggaatatacttctgaagagttaaaatattttaaagaaagagataaatatgttaatgaacataaaaataaatataaaaaattatatgaagatgaattatcagattatggttttgaaattgaatttttatattagaaggagtgttgtttcatgagatactttgaagttaatggtcttgatgcgggtcgtcgtgttggttacgggacatttaacactgatcatagtgcttacataagaatccttgaaactgaggaggaaaagatggagcatatgagagggatgtataagactagtcctaaagcttttgctgaatggaaggaatggtgtatgtatgtacatcttttgactgatatttttggtactcttgaagatcctaaagaatttgatgaagaaaaactatttgcaaaagattaaacctttacatttttttatcttttttattataactattaacattggtgataattatggattataaaaaatggcttttagataattataccttttttgaagatatagttgaatttgaaggatcatattttcttgaattttgtttaaaagaagatgctatctgttttgttaaattatgttgtgatgttgaagtgtcaaagtttaattgcatctttttgaagcaaacatacaaaaattatatgaaaataaattatcagattatgattttgaaatcaaatttttatattaaaaggagtgttgtttcatgaggtactttgaagttaatggtcttgatgcaagtcgtcgtgttggttatggacaatttaatacagatcatacggcaaccatagatctgtttgataccgaagaagaaaagatggagcatatgagagggatgtataagactagtcctaaagcttttgctgaatggaaggaatggtgtatgtatgtacatcttttgactgatatttttggtactcttgaagatcctaaagaatttgatgaagaaaaactatttgctgaagactaaaacctactttttttatattatttatacttttatattaatcctaaatagacatcattattatttaataaatttcatatatatttattaagtgatagttgatgtgtgttgagaagaatgtttttgagtttaatgagtcaggattgttacgtcaaagtttaattgcatctttttgaagcaaacatacattttgataattttatgttgtcaattatattattaagatatgaaaaattatactactcatatgtcatattttaaatgaaaatttaaaaaattcattaattttatatgagattataattacttaaaactataaaatgattataacactaccacaagtacataaattagctgcaaatactttattaatattaaaagacggatgtggaaatagaaaaattccatatttaacttatgatataattaaaattgaaatttaatatgttccccaaattccatcaattaataattttactttaaaattcatcaaaacactatttcttaactttaatgcaataatattattaggatttaactctaaagctttattgacacatttaataccttcatcatatttatgtgcctcagtaaaatcatagcttttgttgcataaatggaatcatcatcaggatgaattttcaaaccttcatcaataactgccaatgcttcttcaaagttatctgaaatcattaaaatttttgtcttaagtgaataaacatttgaatcaaaaacattgactgaagtgattcttaaataatcatcacatgccgttaaagcttttttataatttttaagtgcgaagtaagcttctgccttaaaatatattgcatttttatctttaggattcaattccaatgctttatcaaatgaattaattgcttctataaactaaccatacctgttaattaatgaagaacaaatttttcagacaaatttccagatggaaattccaacatcaacaagttcaccaagacaaattccagtataaaatttttgcatctgttttttcaatcattacattaacgattttttgcttctatcacttaacataatttaaattctattaaaaaaatatcaacttcaatcatttaagtcattgaataaaattttattgttattattgtttatatttaactaaatgattttagaaataaatccattcatcaaccgtaagatattttgcatttctttatttacaaaatttaatctaataaacaaaaagccaacaaccaacaaatcgattaattaatataatacataataataaataattatgtagtgttttatttacactttattttaaggaggaaatgttcatggatagattaaaagataaaatagctatcgttactggttctacaagtggtattggaatcggtattgctaaattatatgctgcagaaggtgctaaagtagttatttgtggacgtagagaagaaaaaggacaagcagttgttgataatattacaaaagaaggaggtgaatcttcttaccacttctttgatattaccaacacaaatagtattgaaaaattaattgatgatactgcagaaaaatatggaaaaatagacattttggtaaataatgctgctaatgtagctctaaaagatggaaacattgatgaattaacaatagacatgtgggatgctatttttgaaagtgatttacgtggtacattctatgctaccaaatgtgtgattccttacttgcaaaaaaatgaaaatggtggatctattataaatattggatcaatggcatcatgtggtggagatttaggttctactgcgtatgcttgtgcaaaatctggtgttgatatgtttacacaatacaccgcactccaatatggtaaagacaatatccgttgtaactgtgtacgtcctggattaatagtaactcccgaaaatgaagcaaatgtacctgaagttttaagaaatattttcttaaacaatatcatggttaatcgttatggtggtccagaagatattgggcacatgtgtgtatatctcgcatctgatgaaagcgaatatgttactggtcaaattgttaatgtagatggtggtcttaattcccatgtatctacatcagcacaattcagagaattaaactctcgtacatggtaattagtactattaagtactaatttttatatttttttagggtgtctgccaaaattgattttgtgtttttgttgatttttttaaaatattgttatatcaagttttaattggtttttaatggatgttctttcatagaaatcttttaaatcttccagttgtatttttaatttttcttgttttaaattgtataatctgattaaattatatgctagtgcgtctaagttgattttttttctgttcttgtcattttccaatgactacttttttttctatttggaattgttcttttaagtcaaagtttaattgcatctttttgaagcaaacatacttatttttattttcttttttatactatttaaacacgtgttaattcttttttgaaaagtattattaggaaagtataaaagtattacaaaaataagggggttttcctaaaattatttaccagtttaaataaaacccattatattccgtattattaagtaatgattttactaatttttttgtttgattttcaatgattttagcataagttactttttcattttcaaaagtcaaatcactatgaattttggccattatttcgccggctaataattttcttgattctaattttaatgaattgtttcttttatcaatgtttgtttcgttgatttggttggtgtttattaatttgaacactgttttatcaacgatttgttgtctaaattcttctattaaatcaaaaattaagctttgtcttctttttaaatctgcatgcaataatccgcagtatggatcaagccctaatgttacaatattttttgcaatttctgaagcaagtattgcatatccataatttagcatagaatttacaacatcattttctggtttttgatttctttttttgaaattgatttcatcaggcagcagcaaacttactgcttcccagtaattaacagaagctattccttcaaatcccattattttatttttagatgtgaatatattgtcatttagagttattttaaagtttttgaaatcttttatgttttgtttaattttattttcaattattttaacttctttgatttttttatttttatttaatgttttaattgttgatttttggtttttcattttagatgttataaattcttttgaaattaaaagtcctttatgattttcactagcttgatattgtaatttttttaaaacaatattgttctgatttggagactctaaaatatagttgatttgaccaaagtagttgatactaattaatttaatattgttttttgccatcagatttaatgcatcgaatgttatatggcctttagccattatagttatatctgatactttgtttgcagaaattctatatatctcattgtctttttccatgactactatttgattgtctttttttcttagtgttttattgtagccatcaattatcaatttcataatatcttatatttttcttcttctagagttatttcttttccaaaatatgtgattttattataacatgcaccacatattggaattataattataaacccgttttcatcaggtattttagatattttttcttttaaaacaagtatttcattattatccaaatttccaatatatgttttttcacttatttgtttaaatgcattgtagtttaagattcttttaagttttaaaatatcttttttgaattttaaattaaataaaactagaattttcaattttatcacattttttaattaatatccatattttttaagtaattccaaatttatggctcaaatcagaattttaaagtttattaattattttttctaataaacttagtattcggttattttattcaaaaatacttaaagtatccaagaaaagtaataataaaatgattataaaacttatttctctctaattatcatatcttcatatgaaatatcactatcaacacatctgatacccaaatgtaaaaatattatttcatatatgtatctctattaagtttactctcctgatattttaggaggtaattataaaatcaacattatattttcactgttttccaatcagaactgtttagtgcatttatacaattaattgaaactattaaactaataaaaagtaaagatattaaaagtttctttgaaatcatatgattttaattgtattaacttacctataatattctgttaacacatgaaaaatcaattcattcatcgaaacttaagcagtttttttctaatttttatattttttaattttcacgttttttaagtaattccagacctatgtctcccagtttgtatttttggatttttccgcttgttgtcaatgggaattcatcaacaaagaatacatgttttggaactttatatctggctattttacttattgcatagtcccttacatcttcttcagttaaatctgagccttcttcttttattatgaacgctcctacgatttcaccgtatttttcatcaggtattcctgctacctgaacgtcctgaactccgtctattgtatatatgaactcttcgatttcacgtgggtagatgttttctcctccacggataatcatatctttaattcttccgacaatagaatagtatccgtcttcatcaatggtagccaagtctccggagtgtaaaaatccgtcatcttcaatgacttcttttgttttttcaggatttttataatatcctttcattacattaaatcctctgcagactatttctccttttttacctacttcagttatatcttcaccagtatccggatctataagcttaacttcaacattcgggaaaggagttcctacagtgtttacttttttctcaaatgtatctgctgcatttgtttgtgtcattccaggagatgcttctgttagaccgtatacactggtgatttcggtcatgttcattttgtctattacttctttcatggtttcaacaggacatgttgatcccgccatgattcctgttctaagtgatgacatgtcaaacatatcaaacataggatgtgtcaattttgcaataaacattgtcggaacaccgtgaattgcagtacatttttccttttgaatagctgaaagagctaaaagcggatcaaattcctcaagcattacaatagttgaaccatgtgtgattactgccatgactcctaaaactgaaccgaaacaatggaataaaggtacctgaatacataatctgtcctcttcagagaagttcatattttccccgatgtaatatccgtcatttaagatgtttctgctggtaagcattactccttttgggaaaccttctgtaccgctggtatactgcatgtttactacatcattattgtcaaattcttttttgatttcttttaggattacatcatcctgattttgacctaacaataataattcgttagtgttatacattcccctatgcttgtcctgacctacatgaataacatgttttaaacatggaaatttttctgaagttaactttcctctctgacatgttttaagttcaggcaccaaatcataaataatatcaatataattattgtctctgaatctgtcagttaatgctaaagctttcatatctgactgtttaagaatatactccagttcatgacttttataagcggtatttacagttaccaaaacagctcctattttagctgttgcaaacatgaaagtcaaccattcaggaacatttttagcccatattcctacatgatccccttttccaacaccaatagataataatcctttagctaaattattagccctttcattaaattcggaatatgtgaatctcaagtttctatcaggataaattaaaaattcatggtccggaagtctttctacttgtttttcaaaaaaatctgctagtgtatcttcactgaataacatttttttaactcctgaaattaaatttaatcgaccggtgtgtatattacagctaaaatctttgctgtttcatcatttgaactgtgtacatgatgtgatacaattgaatcatagtaaatactgtcaccagtttctaaaacatagttattttgaccataaataacttcaattgttccttcaagaacataaaggaattcttcaccttcgtgagagctaagttcatggctttcttcagcatccactttaaagtcaatgataaatggttccatgtttctgtcactttttccggcagccaatgagtagaactccaggttactgttctcggttttgttttcatcacctgagaagtatactactttgtcactttttccttttctaactactaatggtcctgtctgttcatcatcatcaataaaagtacctattctaacgccaagtactctagctatttttgttaaaggagtaagagatggtataatttccccgtttaatattttttcaactaattcaatgttaacatcactgtcattagctagttcgtcaagtgatacatttctaacttccattaaagttttgattttttctccaattttatttttattaggcattttttccaccttaactctttaatataaaataatatgtattttatcattaataaacgtgttttcagatatttaaaaataagagaatatagtaaaaattattaaaaaataatatataaactgtgtaaaaaaagaaagctctgcgacattttaagcaatgcaattatcgccagacgttttttaataaacagaaatgaggtttttaaactgataacctctaaacatgtttaatatttgtataatcagatatttcactattgaatgtagctaaatttgaaacattcaaatcatgaatatcactgtgtcctgttattcttgcaaaagttttaatttcttcaagacttgcattaagataattggttaatctttttgctccaatatctgtttttaatctggaacgcagttctttatcctgtgttgcaactcccacaggacattgccctttatcacataatctgtactgctgacatgccactgcaattaaactggctgaagctatagctattgcatctgctcccatagctaatgcttttgcaaagtcactggaaactcttaaaccaccagtaattaccagatcaatatccaaatcatgttcatccagatattttctggctctgtgtaatgcaaatattgttggaatacttgttgaatccctaactaataatgggctggctccagtagctccccctcttccgtcaactgtaatgaaatcaggtttggcataactaataaattccaaatcattttcaatatatcctgcagctattttaatacctatcggacggccttcagattttaatcttaattcatctaccagatcttttaaatctttcttagaattaatattcgggaatcttgatggggatattatgtcttcacctgcttttttacctcttactttggctatttcaggcgttactttatcaccaggcaataatccacccattccaggttttgttgcctgacctattttaatttcaattgcatctgaagtttttaagttttcatcagttactgaatacttgttcggaacatattcaaaaatgtatttgtatgcctcatttttaacttccggcagtattcctccctctccactacacattgctgttttagccttaaagcttcctttagccaaagcaattttactttccttagacaaggccccgtaagacatgtgggatacatatacaggattttcaataactaaaggtttttcagcatttttaccaattaccgtagtagctgacacttctgcatcttcttctaaaggcataggatttaactggtttcctaaaataagaatatcatcccaatcaggcattggcaattctgtagccattggtgctgtaatgggttttccggaatcgcataacttataaatggtgtccatatgtcttactgattcatcatttctgatgtactgtttcggaaatgaaattaaccaattgttttcatttgtttcagctggttcaaagttagatatatctgatccgcaatccggacattctttaaggtcttttaatggtattttttcagttttttcatcatgaatataattacaaatcctacactgatatattctatattctgttttttggattgctttgaattttgatagcggcgaaccgcataccgggcattttccaagtttaacaagtacctgaccctctttttcttcatcataaacataatgacaaacttcacattcatatgtcttataggccatatcttttttcattatttcaaaattagaaacatctgatttgcaatcaggacatttttcaagttctttaaaggatttgccttctttttcttcatcatgaatataaccgcatatctggcactggtatttcattttaccaactccaccataattaatatattatataactttaacaataatataaatatttttgtataatataattaattcaatgttaaaaaaagtaaaagtttataactgtttaattaaataaataaaacatactatgaacaacaaatctttctggaacagatatgcgtcagtttatgataaaattataggcaataaaataaacaataacgagatgtttaattttattttaaaatacacaggaaaagatgacagattaatagaggcagcctgtggaactggtgcttttacctgtttattatcaccaaatttaggggaaataattgcctttgactattctgaagaaatggttaaaaaagctaaaaacaaaactaaaaacttaaacaatgttgaagtttctgttggagatttaaataatataaattatgaagacaattattttgatgtggcgctggctgccaatgtgttgcacttattggataaacctgaaacagctataagtgaacttacacgagttgttaaggataatggaattttaatacttcctacttatgtaaaaggaaatacttttcagcgtctgatgcttaaaacattaaaattatttatttttgaaagtaatgaatggtccaaaaatgaatatttgtgttttttaaaaaatcatgatcttgaaattcttgattatgatgtgtttaatgcaggccagccgttatgtgtggccattatcaaaaattccaaataatttttttctacaatagatttttttaaaaacacataattttattttaatcaaaataacaattgatttaattggatacaatagactttttattaaaataattaaagctttcttaaaaatttaaaaaaataataaatgtatgaaattaaaatttgtctttgaaataatttccaagtttttccgtgaactcctgcaataggaaatataaattctgcaatcctattaattgaacataaaacaacaaagatgcattcaataatgcaaatgcatcaataattgttgtatagccggcagaaccaattttttaaaactaaatgaatccaaatctatctgaaaattcatcgtaagataaaaatccgtcacggtttgaatcaagactttcaaattcagaaatgattacttcttccggagaataaccgtcccaaaatgaatcctccattatatattcagttaattcttcaaattcatcaatactaagttttccgtcatgattcgtatccagttcattaaaggtatcagaataaggatttgtacctaatctggcatagaattcctcagtggtaagtgttgaatttggtgaatttttaactatatcctgaagtttcttaatatcactgtcttctttacagcttgctttaaaaagtttatcacctgcagagaaataaaaaacattaaaatcatccgaagattttgaatagatagctaaaacatcacggtggtacagagtcattttagtgaggcttgaatttttaattgtattttgctcatcaggcaatgagttatcctgaatcagatcaatgccaaatttgtcggtatggtaacctgtattatctggagtaaactccccatttgacggaacattaaatttaactcctcctaaaaagatttctttagatgaatcagctgcaaaaacagctgaaactgaaattaaaaatataactgcaaccagaatagcatgtgtttttttcataatatctcacctttattgagtatatatatcattaaagtaaataaaaattagtattttttaattaaactgatttgtttaattaattgatgcattatttaattgaattgaaaagcaagtattgaaaatataaaagaaaaaattaatttaagatatattaatatcctagtaaaattttaatgcctattaaaatcaggacagcaccaccaagaatttcaaatttgtctccgaaataatttccaagtttttttccaatgaaaataccggaaatactgaatataaatgctacaattcctattattgtacatggaagcaacagggacatattcagtaatgcaaatgtaattccaacagcaaatgcatcaatacttgttgcaacagccagcaaagtcaattccttaaagctaaaagtatccataatatattcatcatcactgtctaagctttcacgaatcatgtttaatccgatagccaaaagcaggaaaaatgcaatccatggagctacagttgatacaaatgaactgattgttgtaccgcaaatgtatcctattacaggcattataaactggaaaaaaccaaaaaatagtccataatataaaatctgtgattttgtcaggtttttttgtgtgaatccctttgtcagggaaacactaaatgcatccattgccagagcaatagctattatgatgattgaaattaaagatgtatccatattattctccgattaaaatactctcttcaatatacagttttatttctgatagattaatatagattattaatttaaaaaaaataaagaaaataagtaaatacttattttctttttacaataacaacagcaacaattataatcaatgctattgccaatatagctattggaaggcctgtagaagcatcaattccaatatcatttaagttttcatcagtattgttttcaatagctggcggttctactgcttttttacctacacttaaaggcacctgtgttgaattagccaaataattgtcatcaccactgtaattaacattaacgatatatgatcctttcgctaaatcaggaacagtgacagtagtttttccgtcaatcaactgattagtataacttttatcataaacagtaacctttacagaaccggtagcaccagcaggtaaaataacatgaacaactgcattttcaccttcttttacatccttagcagaaacggaaatcggcgcattatgttttcccacactaaaacttgaagtgtttgtacctggcagatagttttcatctccgtcataactggctaaaacatcataagaaccactagccaaattatctatcttaaaagtagttaatcctttatcaataggagcggaatatgttttgccgtcaacagttatagttacacttccagttgcatcttcattaacccgtacagttatcttttcgctgtctcccatagcaatattgtttgcattaacaataattgtagagtttgccttggttttttcattagctttaacaggaacagatgcagaagccccaggtttttctacattaaaactggaggtgtttgtacctggcagatagttttcatctccgtcataactggctaaaacatcataagaaccactagccaaattatctatcttaaaagtagctattcccttgtcaataggggcggaataatttttgccgtcaacagttatgttaataactccagttgcgtcttcattaacatgtacagttatcttttcaatatctcctacagtaatattacttgcattaacaataattgtagaatcagcttttatgctatcatctacagcaactattgttggaataatcaataagagcaaaatgaatagtaaaataatatattttattttgttcattttttaacctccactaataaatagtgattaaaagatattatgtttattataatattaaaaatttacttaaaaaacagaaaaagggtaaaaaattattcacgtttttttaatgaaatcagtatgtttaaagtcataacaatagaataagtgcttttaaatcaaattcttcataagtaaaaacctgtttacagataatttcagccaaatcattataatttttaacggtccatataaaattattcatgaaaaattacacttgaaaaaaatatattgtagacatacgtttcaactgtaaaaatttattgtatacaaaattattttataaaatcaaaaacaaaatatcactaacaacaaaaggaaataataaaatgaatattttaattaacggatcaggtgcagtaggattaggattaggtgcatctatgctttcacaaaaagcagatgtgtcattttatgcaacaggaaaaacagctgctgcaatcaaagaaaacggacttgaaaggacaggattattccagcattactcttttacaccagatgaatatcaagtatatgaggattataaagatattcctgaaaaaacttttgattatgtatttatatgtagtaaaacagtagctaatgatgatataagcagaaaattagccgaaaataaagaaatattaaaggacaactgtaaaataatcatattccaaaacggatttgccaatgatgagccttttttaagatacttttccgaagatgaagtatactgtgcaagagtaattaccgggttttcacggcctcaaagacatatcagtgaaataactgtatacacagaacctatacttttgggatcacttcaaaatgcagatcctgagtgcctggaaaaaatagctcaaatgattagtgcatcaggaatcaaatgtgaaacaaccacagaaatcgacaaatatttatgggctaaaatgctttataactgtgctctaaatccattgggagtaattcttaactgtacatatggtaaattaactgaaaatgaatactccaaaaatattatggacagcattatagatgagatatttgcagttatcaaaaaaagcgaatattccacattatgggattcagcggacgaataccgaaaactgttctactcaaaattagttccggatacctataaccattactcctctacatatcaggacattcaaaagaaaataaaaactgaaattgatacattaaatggaactgttatcagattaggtgaaaagtacggtgttgatgtaagtacaaataaaattatttataacctaattaaatcaatagaatcagaattttaaggtttattagttattttttctaataaactaataatcctgttattctgttcgatgagaatatccattttccttgtttgtgctgcaagcaaatgtccgttaacattatccagtcttgcaacactgtttttatcatatattttatataattcttcagctattcttaaatcccttgcataatctccagttttatattgtcctctttttttatgtttgcctatatttgatgtgggtttttttgaagaattcaaatcaaaaagtcttgatccgcagtcaatacaataattgctgttattatctccatatttactgccgcattttggacattctttcatttaatcaccttttcaatatctccagaatataaaataattatttctttctttacttggtgccggagcataatatgaatattcctttaccatttccttttcatagtcctgttttgcttcatttaatattccgtaaaatgtagctgtgtcataggaagaatcaggagtgttgattatgatttcttccatttcatcagtcatttctccgctgccccatgatatacagtatatcgaatctcctgatgaaaaataagcatgggacacattatgttttgcaaagttattatactcatggaagtatgccacatcatgtgaacctatagtcaggtttttgcctttgaaattataccagcacccgtaactgcttggaagataatcatcaacacataatataccaaatgtgttcaggtcattataatgataattagtacgggcagtattgatttctccgccctgatattttggaggaattttaaaatctacatcatttacctttacagttttccaattggaactgtcaactgcattaacacaaccaacagatataattaaagcaattaaaagtaatgataagaaaagcttttttgaaaacatactaatctatttgtactaactagtatataacattttattaacaaacattttaaaatcgattataaaagtttatatatctaaaaaataaaaataatatatgttcgtattttaatatatcttatttttttacgaatacgaacaatggtgatggttaaaaatgagtattcgctattactcctttagtggtgtttaggaggatgaatactcattatatatttaaattaattcatctaattttttaccgtattcttcaatcagcaaataatcattagctacaacatccaataactgaatcttataatccttaaatagcttttcatcatcaagaatcttttttttattgtaaggataactatttttaatattataaatttcctgattgatctgactgattgattttataaaaacatcatcatcctcaaaaattgttttgccttcaggaatcaaaatagccagagacctcatggaagttaaatcataagtttcaaaagcttccacaatttcttcaaacaaatctttttcataaatactttgaacaggattgaaagaaggatgcaatttataaattaaatccaaataaagactattcaaactatccaaatcatcttcagacaactcaaaatgagtatcctttcgctcaatagccagatccagttcacccatatatttttccaacatgccaactgattcttcaaattcattatcaagcatttcatcaattttagataaatcctccccctgattaaacagctcaatatatcttttaatcatttccaattcaatatccaaattatatgcttcacattcaagaaaaccaaaactgagcagatacatatcttcaatttttggacatatatgaaaccttaatttatcatattcaaaaattaattcagctaatttttcctttaaactaattgacattgttaaaaccttaattctatatatatgaattaaacatatttatagatatataggtgattttaaatggaaataaaagaaaataaccttaaagaattaatcgaaaaatacatgagcattgaagaaacagaagaaaaccatgaagaattgcatcaattgggacatgaaattgaccatgtaatctttgacaataatttttatcttgtaacacataatgacggtgaagaaaaagaaatcgtttcattaatagtaggggaagatgacgaatacttcataccattatataccgatgatgaagaagtaaaagaagcaattgaaatatttaaaaaagaagacagtgatgctatttttgaaacagaaatcgtagcatctacagacatattagaaacctatttggatgatgacactttccttggaatagctattaaccctccaaaatatgattttgtaatatttagccaaaacgttatcgaagatcaccaggactgctgctgaatttatatgaaataacttttcaatgaaaaaagagcagataatcttttttcaattttgttatttttaaacaccctattcaacagcaaaaccattacctttaactattaaaaattattttgaaaccaaatacttccattatttgaactctttttagctaattaacattaaaataagaactttttttagcaacacacttaaattataactaattttacggtttaacactctaaaaattctttaacaaaatttcttatttattgaaatatccgacagttttcataattaaaataaatgaaacattacacaattaaaaaccaaactattgtaaaattattaattaatccaatctattcaacacattaaatatatattttgaatcatgattttaatataattaatcaaatctttaattaaacattattcagaaaaataaaaaagtaatccgaccacatttaatctactatcagatatatgttttccatagcaaaataatggctaaaaaacatttataaacaaaaatattataaaacaaataatatggaatcaaaatatactcataaatttattatttataataaaaaaagaatcaaaaataattataaaggattaatagaaaaattagccaattttgacaaagaagctatacctaaagattttttagaaaatctaaatgattcatcagaaatatttcttaaaaaaagacagaaattttatcttaaaaatccagataaaatgtgcacaatcgatgaaattctaccatataatgaagaaattaatgttgaaacaaacaaagtattatcatttataaacaaatatcaagaatttgacagtttaatcgttggaattgattatttcaatggtgaagaagaatacattgaaaaatatttttcacatgaagattcctggtattttggaggtccctcacgaaatttttacattaaactcgcattcagatattattatggactatggggaactgaattagacatctttttaaagaatattggtttagaacatttaatttagggaatttcaagtaatgacaataacatactccatatcattacaaatgaattgttcgacgcataagaacttcaaatgacaatttaacattattaaaaaagcattaaataacaaaacacaggaaaatattattttctaatcagatattaactttattttgaatagtttcgtttgaaatattcaacttatttagtaatttattgaaaaatatggatccataaattatctttaaaattaaaatattcatacttccatatgaccaatttgcacaaaatcattgggcaactttgcactaaatcatatgaccaatttgcacaaaatcattgggcaactttgcactaaacatgcaactaatttaataaaactttatgaattgaacatgataatctgaaatatccgaaacatttagttaaaaatgtaattaattgcaacacctaaactaattatatataatttaaaaatgaaataataaattaattatactttggagaaagttatatgaaaactaaagatttagaaacttataaaaaagatggaactaaagcttctaaaagtcaaataaaagaatttataaagttatatgccaaaatagctaaaaaacttaaaactgaaaattcaatagaacttaactctgttaaagaaaatatcagaaaaacatactctgaagaggtttatttaactttgattgatgaagaaaaagactttgtaaaattcaatatcagccagggttccaaagaatatatcattccaatatttacagacatcagcgaatataaagaaggcaaagaaaaaatatcaaccttatttttagacaaactaacatgtaaagttttatctgcagaagatattgaaaaattagctggcgatgatgaaaatttcagaggtttggtgattaatccccattcacaaaactttatgatggaccgcaacggtggtttttaatatggaatatatctgtcctgttttaggtgaaggtgacgaaagagattttatagctattggccaagcagaaaacttcaaaatagcagtatttactaacttagatatgtatcatgaaggttgtaaatatttgggagtaactggctatgaaccaattaaagtttctgatgaattattcaaagaccttgctaaaaaagatgatgaattcacaggcattattgtaaatattcacaatgaaaaaaagattataaataaagaagaactggaaagattatgattcatcctctttctcaacttcttcatcatcaacaattgaaaaattattataatatctatacctgtatgccattttaaatccttcatccacttctctttttggccttaatttacgccttttagtagcagaaatttcttttttaggattttggtgtgctttaactaaattcttattttcccttacaaactgctgttgtctggttcttacacgattatatttatacacaccttttcttaataaacgtcttctagttgttaaaaatctaatcacaaaatcacatctactgtcttgaagcagatttatctaaagtagcctgaatttcatcaattctctcaacaaccactttaatagcttgttcaccttgacgagtagggttaataccttgctctactaataatgcatccctaatatctcttaacctatcaattgagtcaattttcataattgtactataaaacattgttgtcctccgatttattattaactatattacatttttatttagaataatttataaattttatcatatcaaaaataagtttatgaaatacaacatcaaaacaatctatgttgccggaggatgtttttgggaaatcgaagcatatatttcaagattaaaaggagtcatacaaacagaagtgggatatgcaaacggcataacccatgaccccacatatgaacaggtagcttcagataaaacaaaacatgctgaatgcgtaaaagtaaactacaatacttttgaaacaagcttggaggaaatcattaaagaatttttaaaaataatacaaccgagtgaatcaacacatcacagattaggaatctactggcatgaccccaaagatgcaaaaagcatcttaagactggtaaataaaaatccctctattgaagcccatgaactgaagggattttacctggctgaaaataaatatcagaaatacctggaaaaacatcctgaaataaactcaaacattaaaataaatatgaatcaaagtgataatttaactctgctttcatatcaggtaacaaaactggctatgaatgaagaagcattcagcggaaaatatgctgattttgatgaagagggaacatatgtagacattacaaacaatgaagagcttttttcatcaaaagataaaataaaaaacgattcaggatatgcgtgctttacaaaacccatcaaccctgatgcaattacaagtttacgtgatttctcatacggaatggtcagattggaaatcagagctcaaaaaagcggaatacatttaggttataaaaaaagagattactatgaaataaattctgctgcacttaaatttgtttataaatagctactccttttttaatagcttttaaacccttttcaagtaactgtcttggacaggcaatatttaatcttaaaaattcatcactgtttttaccaaaatcaacacctgcagataataaaacccctgttttttcatttaaaaacttgatgaattcctctgaagatatatccaaatcagaacagtcaagccataataaataagtagcatctgcatcagttaacttaatttcaggaatttccttttttataaaatcagctgcaaatttcttgttgtcatataaatactgcctcagttcatcaagccatggtctgccgttattatatgctgctattgcggcatttatagcaaaaatattggctctgctgacccattcaacatcaagagcgttgaaaacatcttccttcaatttatctcccacaatataaaccgcagcagtatttaatcccgctatattaaatgatttggtaggagaaattgttgtaatggaatcatggttgcttatacctgcaaatggaatgtattttttatcgggatcagttaaatcacaatgaatctcgtcagatattatagttacatcatatttggcacataaatcagctatttttttcagttctgttctggaccatattttaccaatgggattatggggattgcacagcatcatcaaagttacatctgcttcagctaatttttcttccaaatcctcaaaatcaatttcatactttccatttctgtacatcagctgattttccacaacttccctgttattgtcttcaattacatggaaaaatacatgataaaccggtgtttggattaatattttatcattttcatcagttaatttacggataatggtagctattgcaggcattactccattggcaaatttcagataatctttatccatttccaatccgtaatctttccaccagtcagcatatgcatcataccattcatcaggaattacagcatatccgtagagactttcatcagctttttttataatttcatcagatatttccggagcaaccttaaaatccatgtcagctacccacatagggagttcagtgtcaaataaatcccattttaagcagttagtgtttttacggttaataatgctgtcaaaatcatatttcatgtaaatcatttttaatttcttttataacttttgcctgatgccaacagccaactaaattgactttaaaaagtttgtctaaattatcagcagaattatatttttattgcattattcattagagcttcaatttcagcataatctattttcatttaaatattatattgaatatttataaaaaaagtagtttaaaaagaagagaatcaatcttcttttttaaagaaatcatcttgaatttcattaactatttcagtaaaccttttggttacatcagatttaggttcaattgtaaccattactccacctttattaggtgagctggatactttttcagttaatggcaaatctccaagataagtaatttccatttcatcagcaaaatcttttccatcacctttaccgaagatatggagtttttcattacaatgaggacattcatagtaagccatattttcaactaaacctatgttttccacatttaacatttcaaccatttttacacattttaaaacatcttcctgagacactacattaggagtagttaccataactactgcatcaatatctggaattgtctgtaaaactgttaacggttcatcacctgtgccaggcgggttatcaataataagaacatcaagaggaccccatgctacatcagctattaactgtttgatactgcctgttttttgtgggcctctccaaataataggtgtgtcaatactatctaacataaatgccattgacattactttaagaccgcttggtgcttcaacaggcatcatatgacgttcttcgttaatcatgatgtcctgatcttccacacctaacatttttggtatgttcggaccgtgaatatctgcatccaatatccctgtagtaaatccttctttttggaaagcttctgcaatatttgcagctactgttgattttccaactcctcctttaccactcataacagcaattttatatttgatttgtcctaagtttcttgagaggttgagttgttgttcaatcatttgtttttgttgttcaggagtcatttctcctccatgaccatgatgtccatgttctggcataatatcactctctaaaatttatttttatcaatataatatattatagtaactaaaagtatttaaaagtttacaaataaatgttagttaaatttcttactgacttcttctacagcaagtactaatggatcggtaaccatagatactggaggtgcataagcaaattcaacattacttaattcaaagcagcttaaaccttgggtaatagctaaagtcattgtatcaatcctttcagctaccctttcctcagcaattatttgacaaccaataattctaccattacagtcacagataatcttaatatccataggtttggcattaggataataacgggctcttgtaagtgcttccaccttttcaacaataggtttgatattgttctgttgagcaaaactggaagtcaaaccaacagcaccaaactctaatttacctactttagaaaccatagcattcaatactggattgaaattagattttttaccagttattgtacgtgctaatgttttagattcacgaaccgcagtagtacctaaatgactgatagtattggcctgaagaattaaatcctgagattcaacacagtccccaagagcataaacatcttcaacagaagtttccattttttcattaactaaaatagcccatcttccgatatcacagccagccattttagctaattccaattcaggccttacaccagtagctaaaataaccatatctgcatcaatacagcttccgtcaccgaaatatgcttttttaacttttccatcttctccttccaatttagtaataggttcaccaagcattacatgaatattttccattttcaaatatccggttaaaatatcagccatatcactatcaagagatcttggaacaatttgaggcatcatttcacttaaagtaacatttaaacctaattctttaagagcaaaaacaatttcaataccaattaatccggcaccagttacaacagcacttttagaagttttagcccattgctgaactttcctaccgtcctcaatgtttcttatttggaaaacaccctctaaatccacaccttccataggaggtacaaatgggtttcccccagtagctaaaaccaatttatcataatcaatagttttttcaccatctgcattttcataagtgacagtttttttactgctgtcaactgcagttacttcagattttattaaaacatcaatattgacttctttataatcttcaggtgttttcataataatatcatcaaaagaagaaatctttccagacaatacataaggaatagcacatggagaatatgccacattttcatcacgagttataacagtaatttccgcatctttatctaaacgcctaatatttgaagcagtagacattccgcctgctcccccaccaacaataacaactttcatcgttaaaacaacctttttttaaacaaattaacaaaatatttatgaatttaacattaatatttattaaaatataagtataaaaaagtaactatcaaaaaaagttcaatttaaaaggtgaaataaatatgaaagaaattgattttaatttaaatgaaaatccttttattaatttccagtcatcaagatattcaatgactgccagaatcaacgttgaaaaaatgtggaaatattcaaaagaaaataactattcattttttgtattgtctttagggtgtttaatggaagctgtaaactccatacctcagcttaaaagaagaatagttaacgataaagtaattgaacatgattatttagatggagtctgcccaataatggatgaaaacaatgaaatctataaagaaatgagagtaaaaccacctgaaacatttaatgactttgaaaactggcataattatgttaaaaaaacatcagctgatgtgttatccagcaaaatagatgaattcaatgttaaaatggaaaaacgagactgtgaaaatatagctaattactcctgtatcccatgggttgattttgaatcaataacaagtggaatattaactggaaatcaaatacagccattaataacctggggaaaagtaaataaaaactatgaaatgagtgtagctattactgtaagccatatttttgttaatggcagagaattaggattattttacaaaaaagcacaggaaaactttaatcatctgaagtagattcaatatcagtagtttccaatttaaatataactggccttaacccatcattacaactgacaatagctatacctggttttttaatccaatccccataataaaataaattatcaacaccgtgagacaatgcaaatacatactgatatattgctttccatgcttcatcacaaaagccttcaggctttgcccaatccccataataaacttcaccttcatttagaatcggacatactcccaaatcatcaataccatattctttagccaaatcctcttggaatgttgtttttaaaactgttatttttacttttttcattgtaattcaaaaaaaataaggtaaagattttattcaaaatcaataccagttattctaaatccaccataatgagatttgaatttaatgttcataccaattagcaatggggtaatagattcaattaaatgagctttatttaaaggcccaatatcaatagatcttaaaccaggtattttttcaataatatcactagctatctctttagcttccttatcatcaccacaaatcaaacagtcacattcaattgggtctggaatatttgccaaatgagagttactaatattattaaatgctgcaacgactttaacatctgcatcttttaagatttttgccgccctttctgctgctgaacccggatttatatgtaaaggattacttaccggtccgccaatagctgtttccaatggtacagttgcatctaaaagtacttttccttttgcattttctttaatagtctttaaagttgcactttgagcctgtaaaggtacagttaaaattaacacatcagctgcagctgctgcatcttcattagccataccaactaactctttaggattgtgctctttaatttcctcattagcttcaccaacaacagttaaagctttttcttctttacgagatcccacaattacatcttcacctgcaatagctaaacgttttgcaattccaagaccttgaggtcctgttccaccaattataccaattttcatttttttatcctccaaggaaagttattttttgtcatagagtaaaccaccgacaaaaatcatatattcaggtaatttcccatcttttgcatagatgattttataaccaaaagtatcttcaattgttctgtcaacatccccaccaagtgattcaatagaatatcttaacttaaatggcatcttacaaggcataccaattgttttagtgcatttcatacataaattacagtgcccaataaataaacctaaagaatcttcactttccaatgcatatatgtcattcattaatttgactttcattcgctcaagtctttttataataaaattcaattcattaggggtatatgttctgtctaactcctcttgtgaaaaatcaaatttaaaagcaattattttaagtttattatatgaattccagatttcatcagggtcaaaatcaaaaggagggcaaccccaattgttgtcatactgatcacattctttacagatttctaaaaatttttctatgtcaacatatttatcataatattcagacacgttaacatctgctgtgagtttacttatgttaaccataatattatttaaataaaacagtataataaaagtttctaaaaaaagaaaaagataagagattagttaaaatctcttaagcaattgttatagttcttccaacttggtattcgttccagatagatgtgataatatatttacctggatttaatctaattagtaagttagccataccattttcatcagttgttctgttgtagaatacaccgtttacattaaatgttatgttttgattagctaatggtttaccttgaccatctaaagtttttgcagtgaaattgctgccgtcttggaatttcatgtctaaatcttttgtaattaaagttggcaatacagtaacattatttccaactgcatatttaccatacatagttgtaatgatataatcaccaggatataaattaatatttaatgtagcagtaccattaataacctctttagtgtagaatacaccattaatattgaaggttacatttgtaccattagctggtgttccatcaccatttaatactttaacaacaaattgtgattcatttttgtagtattttactaagttttcagttattacagttgataatacagtaacattaaatcctaattcttcacctgttacagaattgaatgcagttaaaacatattttccagggtttaaccaaatacgtaatgtagcagtaccattagtaatatttgctttatagaatacaccattaatattgaatttaacagtagtattatcttttaatgctgtaccattgctgtcagtgaattttgcaacaaaatgagtatcattacgatagaatttaacaatatcattagctaatatagttggagttacaattatgctagattctacagtagtattttcataagtagcagttactttgtaagatcctgatactaaattaatatccatagatgcaacaccagttccattagtaagttttgtataatttctgccattaatattaaatgtaatattagcatttgctataggattatgacttgaatcagtcaaaatagcaataagtttatcagcactgccataaattttaacaagttctggaacatcaattaagaatttaggaccattatttgctacaatagttttattattagcctgaacagttttatctcctaaaccaacatttgaaactaaagaattataagttacagatcctgcaccagtagtattaactgtgtattcaccagtagttttaacagtacagttagttacagttgcattaccataagcaattttaacaccggtagtttcagcaatgatagagtcaccgcatttgcttgcattacctatattattaccattagtgataatatcatttttatttagggttacagtacttgcactagatgcaacacctgtagtaaagttaccaacaagagttatttcgtttccaattaaagtttcattatttccacttacataaataccataaatgtaactggagttacctacaacattattgttgttgtatgtaatgttattggccttgtcaccccaattacttgagtaaataccatatgcaacaactggagattcaacaaacacttcattgtcttttaaaataccatttgaattgtcatatatttgaataccatcagcataatagttatcagaatcagagtaaaaagcatttgatgctattgtaaagtttttaccactaatagtaataccgtaaacataggtatgacctttggtacttatattgttgttttctataattgcattatttccaccttcaatgtataaattatgaatagtatcatgagctccactagcattgttatattcaatagcaatattgtttgaagctatatttaaattagcagatccttcaacataaatacctgcagacattacagtagcagcccaagtaggaggcatataatttacaggaactgaagggatttcagcaaaaatataattatttaaaatattcacattatcagaatcaattattctaataatattattaatgccattgccattagttttaccggaataaacaatagtgttgttgttaatagttaaattaactgcattttcagcattaattacaaaactgtttttatcaaaagcactattaactgaaaatatgttggcatttatatttgcattagctcctcttacatcaattgctgattcaacaccactagtgttagttaaaacaatggcaaaattagaaacagaaatattatctgctttaattacaagagaaatatcctttaaaatagctttttcaccaattaaattgatttttttatcaatagtaagggtacttaaattaagtccactgaaattacctgcaaatattaaatcagaaaaggtaatatcattatttaaaacaccatctttcccaaagtaagtgaaaaaggtatcatttgtaacagtgttaccagttacagtgaaagtagtgttaatagttttattagcatattttttatcaccaaagtaaactacagtagcattagtatttcctgtagctaaatttggtatagcaatagtagttttaccactaacaagttttccattgtaagttttattgccaatagttatatttacatcaccagttgcatcttcaggtaaagttataactgcagaaacattatttccatagaatacagcaggtgcatctatagtcatgttatacacagaaattttatttacattaaatacaaatggggtggaattagttccattataacttgcaattacactatgtttaccaatttctaagtttgtaaaaattacacttgcactaccattagcaataactccagattgattgattttattatctaaactgaatttaatattaccagtagtagtatttggaattattttagcttcgacagttgcattttcaccataagtaatatctttagctgtaacatctatagatatatcattagttgcttcacttacaactgcattatcatcataagatgataatacactaacatcatcagttgtgttatcagcagcagaaactgctgaaagtgaaagagcaactatagcaacaagaagaaaaacaagtatctttttattcataattaatctctccattatatataagaatattcttagcatccatattatgccatttatccaactatatgaatgcatgtaatatatatttgctctaatacaatataatccttttgaagataaaaacaaataatatcgcctatacttcaatataacagcattattaaagttaaaaagaaaaaaaagtaaagaagaatttaaaatcttctttttttaagcaattgtaatattgtttccaatttggtattcgttccagatagatgtgatgatatatttacctgggtttaagcgtatattcaagttagctatgccgttttcatctgttgttttatggtagaatacaccgtttacgttaaatgatatgttctgcttagctaatgctttgccttgaccgtctaatgtttgtgcagtgaagttgctgccgtctaagtatttcatatcaagatctttagtaattaaagttggcaatactgtaatgttgttagatacccagcagccttcatattcagctgttacgatgtaagtgcctgggcgtaacttaatacctaagctaacgataccattgtcatcagatactctgtggtaaaagactccgttgatgttgaaggttacttcctgaccagctgctactttaccgtctttaccaattactttaagagtatagctggattcatttaagtagtatttaatcaaatcagagttatcaacaagtaatgatttgacagttactttatttgagttttcctcaccggtaacaagattataattggttataatgtattccttaggaagcagttggatgtttaaagtagctataccttcaccattggtagatttagtatagaaaacaccgttaatgttaaacttaacagtagcgttaactaaagccttaccgttgctgtctaagaatagtgcagaatactgagttgcatttctaaacattttaacaatatcatagccaataacagtagatttaattgttactgttgagctaactgttgtgctattgtaagtagctgatgcattataaactccggcttttaaattaatgcccattgaagcaacaccactcttattagtgtatttagtataattcacaccattgacagtaaaaacaattgatgcgttaataattggatttccttgaccatcaattaaagtagctataagcttgtctgttcctccctggaatttaataagttcattaatacttaacttaaattctacaggaattactgttatgtttctaatcaaagtagcagaagcatatttatcatcaccactataattaatttcaacactatgatttccactagttaaattattaataaccactttagcactaccattgtttacagcaacactttcttttttaccatctacactaacaattacatttccagtagcatcttcaggtaaaacaatacttacacttaaatcattgccactaacatttgtatcagctttaatatcagatgaatatttatttattttaaaagttgtattagctgatgcagaaccatataaatcattaccatcatatttagctataacatcatatgttccactacttaaattagctatagataaaatagctttattgtcttttattaaaacaggatattccttattattaacaataaatattatttctccagttacaccatcagtaacttccgctttaatagttacatcagatccaacataaacatcttcagaagttaaatttataacagacgggaatttgttaactgttaaattgtttagtgtttttgacggagcataatatccgctaccttcaaagactacttcaatcaaatgagttccaacacctaaactagctattggtattgaaacattaccaaattcatcagtaacttccttccaaactttatctccacatttaattataatattcattccagacaattcttttccatgaatatcagttaatgagattgtataattctcatttataaataattcatcatctttaactacaattactgttgggaatgcatcaggagtgttattataaactttatttaattgtgaagcattaacagatttatctccaaggaatttgccagataccaaataattgcccgtaactgtatttacctgagtattgcgtttatcaatcattactgtataatcaccattagcaattattgtattgttataagcttctaatttagagtattttacactgtttttatctccagtaactataattccagtatttgctcctccaagaacatcaccaccagtaataggtccaattccacttcctaaagatttaattgtattattaaatactttaagatttttagaagaagacattatacccattgtaatattaccttttgagattattgtatttccagtgaccttttcatcatttcccataagctccatagcataagctgtatgagcattagctaatattgtattgtttatataatcaacattaaccgccccatttattgcttgtgaatatattccataaacaacatctaaagcttcaacactaacagaattattaaataatttacctgtgatagggccgtctacttcaatagcatttgcatagtaataatcacattttgaagtgatgatattgtctgcaacatttatgtttaaacatccgacaacattataatcactgtccattacacttacaaattttaaagcataggtataattatgtcctgttacatcaattatatttgatttgacaacaggatttttagaagctcttattaaaattccttcaatagtatcaaacattccgccgaaagtagtatatgcatttgtaactctattatttatgactttaacattatcactattgtctataaagactgctgcactgtaagttatagctgcataagtaattttatcgtaatcaattgcaagagaaggcattttagcattgatagtgttattttcaattacagcacctttacaatcatcaatatgaactggatgattaagagttttgcctttactttgaccagaatatatgattgtgttattaactaactgtaaattacttactccatttgcataaatagccattgcatcagatgtaccaacatcattaaaattaattaatgaatttttaacaataaccttatctacatttgttatataaataccataattctgtttatttatatttattgtaaagttatcaacagatatgccattaccgattaactctaaaaagatattatctaaagtagttgaattagtgcctttaagcttaatagctctgtcaatagtaattgtatttactccaaggccactaaataaacctgaaaatattaattcatttgcatcaatactttctttaagcataccatcattatcaaagaagttgaaaaatgttgaatttgttacaattaaagaagttgaaatgactttaaggactgctttatccatactctgattataaacaccattaacatctccatattttgcaactatattataactgccttctgcataattatttgatagaactaaagtagctacaccatttttaacatcagcactacctaccagtttatcattaatataaaactcaacagcacccataggaatattatttccaattgtatcttttatgacagcagttaaatttatatttctacctaaattaacagtagtatcatttatattaactgttgtgtttgttttagctgaatataagtaaacagattgactatctatagtagctgaaataatagttactttttcagggattgtgtactcaacattatactgattactgaatgtttctgtaggtgttacaattgttacaggacgtgcaaattctaatgctttatctaatttggatccgtcatttaaagtatctaaagctacaattaataaaactttatttccttgagtaatgggagtatcattagtaaatgtcattacaatccattttgaaacaatttcaccattgacaaatgcagacggattgttattagttccccaccaattattatctgctgttattttggtaatgacatagctactaactcctttgtatatagctgtgtttccattattgattaaagcagagtatgatatatctaaagttgaacctctgatatagattgctccagctacattatctttattgtcttcaaatactgaatcagaaatatctaatttacccattctttcagtgtttccaccaataaaacatattgctcccccaccataattttcaggtgaatttgcagtgttattgatgaatttggaatttgtaatttttattccatcaataagctgaagggcatgaatagctccaccagcaaagtttttagaaactgaatttgaaataaatgaacaattatcgattaatatttgtcctccaacagcttgagcataaatagctccacctgcatgattattctctcctgaagcttcattatctttaaatacaacattttggaatttgatattgtaattgtaatcattgaatttatcaataaatatagctccaccaattgttgctttgttattagctattgtagcattaattactgttaaattacctgcattataaatagctcctccattcttacttgactttgaattggataatgtagtattgattaatgttaagtcaccagcatttccaattaaagctccgctttcacttaaagttcttccatttgtaaagttaatatttttaattattacttttccttcaagaatatataaaacacgctcaacatctgcaccgctaagggttacactgccttcaccagcaatattgtaatttccatcgatttttacatttctgacaatataagttccattaagaattataatattaccatttttattaatagacaatgccttttcaagagaagctacaggagaatctatagatccgtcatttgtatctttaccatcggtagaaacataagttgttccattataataatttgcatttaaatctatagtaattgtctgattatcaaatttaacaacaataatatttgctgtttgagttaaaacactgtattttgaaacagccattccattagaaataattgctttatttttagttaaataaccggttgttgtatcaaaattaacaactaaaccatcaaatatatgattatttaaaacagttccatttttaccgtcttttgtaacatagtaatttaaattagcttcaatgtcaaattggtcgtaaagaacaggaattcccctgtcatcataagttacctgtaaaataatccagttatcaatattaactccatcgccggcaatatctgcaggatttttattagaaccccaccagttagtatttgcagttatataaataccgctagatttagttccatgctgaataacagaattgtctccattattaaaaatagcacagttatttatatctaatgtaatgtttgaattatctgaagaagatttatcattataaactgcaccattagtattattataaattcttgaattgattataattaaactagtactaacactggataaatcctgatttataacagctgctttagtaccagtattattagctattgtagtgttatcaattgtaattttacttccataattctgaattgcacttggataattaattgctttgttaaaacgaatgaaagagttggtaatgtttacagtggatgttcttgcataaataactgcattattagcagtattattgtagaagttacagttatctacaattatatttgcattttcaccataaaatgctcctccccatttagcagtgttattgaagaattttgaatttttgattattaaatcagaattatatgactgaattgttccgtcactaagagcattatttgagtaaatttcacaattttcaatagttacttttgatgaagcagtattgtaaatagctgatcctcctttattccatccggatttagctgtgttattgttatgatgtaatttagaattagtaattacaatagttcctttgttagtattgtaaatagccccaccatttcctgctatattttcatataaattaacagaatccaaataaagattagctccattattgtaaatagccccaccatctttagcattaactgcatttttaacatttaaattttttaaataaactgtatttccggaattaatagtgaaaactactcctgaagcattaccgtcaacaacaacatttccttcaccagttatatttacatttttatttacaataacattgttttcaacatagtttccctgaagaagaactattttaccagtatttgcaagttcaattgctttagctattgttttaaccggacttaatttagatccttcattagagtcatcaccatctggagatacataaatagtatctaaatctttagttacaattgtaatatttgttttttgattattcaatgttgcccagacaatgttttctccacttttaactacataatctattttagccagtccatttttaataggtaccacttttttagttccatcctggaattcaaaagtaacatttccataatctggaagtttatcatttaatatatgtatatttccgtcaacatcagtatatttggttaaaccagctgcaactgtaattgtgtttccaggttttatattagttgaaggagtataatccatatctaaaatagcccatttattaactggattttttgtatctttaactaatgtagtaaaatcaggattatcacttccccaccagttataatcataaaggcttgttcctcttgaaccgccatttacaatagtatttccatagtaatctgtattatttacaaaaacagaatgagttacattaatataagagttaacttgctgaataacaccaattgctccattaatacctttattatttgcaaaaacacaatttgtaatgttaaataatacatctgttgtaataccaacacgtataactacaccgtatttatcagatgttggtgtaaacattccttttgcatctaaagtattgttaataaaactgcagttgttaattctaaaatctgctccaatagtacttactccaataattccaccagtattagcagtagaataaaaattttcaaaagtacagttttcaattagtgtagggaacttatttctagaaaatgacaaaatagaattaccatatttaccattaataaatttggaatttgtaacagttgttgttctagaatcttcatcagcattaacaacacaacctaaactattgaagaaactggaattatcaatcaataaatctccattattataaaatactaatttattattaataaaagtagaatttattacatttaatttgtttttattgttaaaagctgcactatcaatcatatctcctttacaatttacaatattgatatttttaagagttaattccccttcatttgtaatgaatgtagaatatgagcttaaacctgttaaattaacatttccttcaccttcaattgtaacaattttagaagaaggaatagaaatagaactatatgaatatgctccatcaagcattataatatttccgctatttggaacaacatttaaagcatgagttaaactagctaatgctttgtcttttgttgaaccatcatttgaatcactaccagttttagaaacataaacagttcctgaagttggtgattccaaactagaatcagtatcaccagcagcaatttcctgagaagaatcaatactacttaattgataagtagtcgaattatcactctcctcaacttctattgcacttaccatgttaatactaaagattattaatattaacaggaccagtataaaaatcccctttgatttgttcaattttatcacttttcaattaattagttaataaagtaaaaaatactttaacattaattaattatattttatttactaataatcatttctaattgaattgaattatagcaatgaaatttaaggacaatccaaaattaaaaaaaagaattatctaaataagtatttatttggatttaaaaaatcatctaaaaaagttacgaaactttcattacttaaatccaaatcatctaatgaaaggagttcatagctggtaattatattatccaaaagatttttacctacttttattaaggaaatattttcataacttaaaacataattaataaaatcagaagctgttacaaattcccttgagattttagaaacaacaaaatcatctaaaatatagcagttttcaattccatgcttgtcaataaagttttgtgagcctcttttaacaaaaaccttcggaccataatggatttttgtattatttaatctggacacagtcatctcaaaaagcaaaacagctgtattttcctcatcactccagtaatcagattggtaaacaggaaaatcttcatcatttaatttctcagctaaagactcggttgtttttctaagctgaggatgaagggtatccaaaggaatgtcaggaatattaaatttaacagctattacatcactgcctcttttttgaaattcttctaaaatttcatctttagcaaatttattagctaccgggtaaaaatactcttttttattgttgctggctaaataatttcttgcagattggataaattcagccattttatctaatcttaatgcagccccaacattacggttcatatcagtgggatctattacgattaacgggtcattaaacaaagctgcagtaccataaccttccaaatcaacagtatgaccatatctccattttgaagcttcctttaaagtgttttcaaaggtcccatattttaaaatcagcagttcacacagataacctgcaaagccccctactttaaattcagagccatatgttcctgtcatgtccatgaatctttttaaaagaagaacttcttcattctggtcttgttctaaatgagatttaatatatttggtatgtaaaattgtcctgtcaactgcagatttcagctggcttccgtcttcaattttatagcatggaacaaaatccacttcaaaaccattaatctgactagttacatatgggtgagatgcataatgttcactggcatctccattaaaataatcgctgcatttatatcccaaatataaacctatttttttaagctgtgcaacatccacatctaaaggaaaggaaataaagatatcaatatctgattttccgcttaaataagttttcttagctacagaacctacaagtgaagcactagcagtgatgccttcatctttgcagacttcatttaaataactgattaatttatctgaagtcttaagaatttctctgctttcctcttttgaaggtttaatctcatttaaaatctgtttataatccattaaatcacaaatcgtaagtttttaaattttcataaatcggacctgaaggctttaaagtgcttttcttaaaagcaatgtttgaaatattcatttccccaatttcaacattttcaaactcttcaataatatctctaacctgattttttcctttagctgatttcatacggccaatagtaagatgtgttgagaattttttatccttatcaaaacctatagctgcgaattcattatctagcttgtcatgtaactggactaaaagttcgtcactttcaactccaatccagataacctttatatgattattattcggaaaagctccgcagccacttattttaatattaaatggttcaaaatcatcagccactttttcaatttttttagaaattaaatctataccttcagtatctatatctccaaagaattttaaagtaaaatgcaaattatttaaatcaacaaatttaatatttgcatcaatctttttaaattcttttatgattttatttactttaggtttaaaatcatcatctaaatcaatagctaaaaaagatctgatttgagacattaaaacaccttactgttcaattattgtttcatcaatagctataccaaaatgtctggcatttgattcaacatatactttaactttatcccctattttgatatcagctacggatagaggattattatcagcatcaactattctaattgtttctgcattctgaagaagtgttctgattgttttgccttcatattctgcttcaatcaatattaaaggccttctttcaattttacttcttccgacatatgcagttcttgtttcaccttctgtattgacaattaaaacttcgtctcctgcaacaagttctgagaggtatcttgttttatttcccggaaccattacatatgcctgaacaggacctgcatttactctgaatggtcttgatgctacatattcactttcaagtgactcgctatgtactaaaaataatgatttggaatatgatccgattaacataccttctccaggtttcatcatgtcagtagtgtcaacacatactctgtcacctgaacctaatggtttaacattagtaacagtagctactttcaaatcatattttattttagaagcgtctacaactaactgtgctatttttttaatctgattaaaatcatttgcttcaaatattactccatcagtaccatgttccaatgtttcaatagccaatttagctccgtcttcatcggctactgcagctattatttttacatctgctttctgcaggtctgcaataatattttccaatggaataactgtccagtcagtacttattaaaataatgtaatcagcaacagaacctaaactgacagctaattgctcatgatttttatctgtgatttctacataagcacaaacagttttgccttctcttttagctttttttgcttcctgtaaatcttgtgattggtttaaatcttcactaaggattaaagatccgtcaccttcaccatttattccaacaagataaatatctgcatcatcactgttagctactatttttacatttcctaacttttggattttatcataatcatctaaatccaagacatagctgatgcctgattccaatgcagttgtaatcatttcttttttatcatcccatggcttgtttggagtcattatccaagcgaatttattttccacaaaatcaccttatttcaagaattttaaagcttcatttacttctaaatcattatgcactacttctgaaatagctttagttattttacctgggttttcagcctggaaaaggttacgtccaaatgctactccagctccaccaacttcaatagaatcttttaccatctgcaataattcttcgtcagtatccacttttggacctccagctattactacaggcactaatgctccttcaactacttctttaaatgaatcaggatcccctgtataattggtttttacaatatccacaccaagttctgaacctacacgtgcagcatgtttaactaactccacatcatgttcattttctaccttttgacctctcgggtacatcatagctaaaagaggaattccccagtaactgcaggtttcagagatttcccctaattcctgcaacatttcactttctgtttcactgcctaagttaacatgtacagatactgcatctgctcctaactgaatagctttttcaacagaagtaacaattactttattatttggatttggtgctaaggaagtacttgcagacaaatgcacaataagacctatatctttaccgtatcctctgtggccctgttctacaatacctttatgcataagtattgcatctgccccaccttgtgaaatgctttcaacagttttatctatatctataatacccttcattgggccattagaaactccatggtccattggagctattacagttctaccggtatgtctgttaatgattctttctaaacgaatctttttaccaatcatcatatttaatacctcatttataactatgagtaatattatctttaatgcactatataaacattaatacatcatataaaaaaagctaattttaggttaaaaatataaaaaacattagttaaaaaaagttaaaaaagtatcaaattaatgatactttctatttattctcttttaaatgatacaccaataatagagaataatgctaatataagaatagctactggaataccggtttttgctaaatcagatgaagaagtagtagcttgactatcattaaatactacatcatcagcaccatcaccagtaacatgaacactatttgaatcaggagtattcacaactgtatcttttgaattatcatcattatctacagtagtgtttgttgaattatctccagtgtctactgtagtattggttgtatttgtattgttaacagttgtattagttgaatttgtagtgttaacagtagtatttgtagtattagtaccatttacagtagtattagttgaatttgtagtgttaacagttacatttgaggaattggtagtgttaacagttacatttgaggaatttgtaatatttacagtgacattactttgatttgtaatatttactgtaccattagttccattagtaacatttaaagtaccattagtagttacatttgttgtatttccagttgttatattagtggaatttacattatcagtactgtttgatgaattagtagtattatttacagtacttgcatttttatcagttacaacagattcatttccatgatctggaataactggagtattattatcattatcgcttataattgcatcatttacagcatcaatatcaactgcacctacagtacttaatgaaagtaaagctacaattaaagcagttattaaatatttcatattcattttttaaaatctcctaaaaattaaaatacacataaagtatacatgatttatattagtcaaaataatatataaagattatggttaatttattttaaaattatcaaagtgtaatcagataaatctttaaaaaatttttatacaaacaccccattaacaatataaatagcatataatatccaaactaatattttaaaagaaataaagcaaaataaatgaaaaaatattcaaagttaaacacaatataaataaaagttaaaaataatatatgcaactatgaagatgatattaattcattcaatgaagattacaatttctacaaagccaaaaaaataaaaagaaatccaaattaatgaatttcctttaatttacataatctattccacaaattcttttaaacgcacatttattacaatgttgatctttttgacgaggatatttattttcatcaatattctttgccacagtatccatttcttgcataatctcattaatcttatcataatccacaggaatgcccactaatttccttgatttaattgcataaacttttagttcactaatttctttatttttccattcctctaatgattttaaaacaccaacataaacatacaactgttttttatgccatttcatatatttagcttcagaactagtatatttataatccaataaaccaattttaccatcatcagtttcatatattaaatcaatagctccggttataccataatctttattttttacattaaattgaacttcagaatcaattacttttattttatttccaaatgtatgataataatgaataacattatcaacaatatcatctaatttatctgtttttaatttctgttttctatcataagcaatgttgggatttgtgtagaacaagttttcaacaatgtttttaacctcatcatcacccaaatattcaccagtagcttttatgcgtttattaattacttctaaagctttatgaattactttaccataagtaatttgagttttatcagaaattttaaaatgaaaatgatttaataatttgtttctaaacggacattgaagatatgattttaaagaagtgaaacttaactctaataattcctcttcaaaatctggttttttacaaacggtttttggaatttcaatttcttttgcttgaagagacatagcataattcttatttataagtaaatcttcaactaaagaagaacctttataagtaatttcattttctttatctgatggaggaacaagtgaagataaaactaaaatgtcttgagctcttgtcattgcaacataaattatcctattttcttcttcttcatgaattaaaacttcttctgactcattttcaaaatctttatattttaaaaactcatatggagtaaaaaaagcaggttttccatgaatataaccattatcaggatttggacttataaatttagatgggaattttttatcagaaaatgaagctacaataacaactggaaactccaatcctttagctttatgaacagtcattaattgaacaccattaggatccacatttgaagatccataatcctcaatattagtatataaaaaccaaaaagcaccacgaatagctttattataatacatttgctcataattatataatgtatttgatataaaagctaaattactaatttcatcttgattattaggattattgatgaaatctgcattaaaataatcatttatctctaataatcgcatataaatttccaaaatagttaatttgtttttatattcaatatcttcagataaaatattttcacgaatttcaaataatttatcaaaaaaagccaaatcatctttattcttaattccccacttttctaagttttgaacatttaaataaggaaaactgactttatttacaatatcttttaatatttcttgaccattttcaaattcaggtttattatattttttaaatactccaccaaaacttctaactctactttttttaccagtgacttcaatactcacatctttttcagctgcaacaacatcattttcatactgttcctgaatattaaaaagaatttcttttgtttcatcagacaaattacagagcttcattttaaaatcagtgtcagtaaatgcctttaagttaagccatttcttttcccaggagttcattatatgatgatctttatcttctgaaataacataataaatcaatgttaaaatagatttaatttcatctttatccagtaaatctttatttcctttaatagcataaggaatattattttcattaagtaaattcattaatggtttaatacaattaccattactagtaacagaccttgttaaaacagctatttcattataattatcaattttaccagtttcttttaaatatttaataaattcgcagatattttctgcttcattatctttatcttcattagaaatataataaatcgggaaatcaatgtccctattaccttttaaatccttttcagaatgaacatctctttgaggtttaataagtgcttcagacacatcaattatctgattagttgaacgataatttgtatttaaacttattcttttaacatcatattcattagataactgttcaaagtaattgtcataagaacctctaaaaccataaatactttgatcaatatctcctacaaaagtagcactatcacaatttttcattaaaattttaaaaatttccatttgaataggatcagtatcctggaattcatcaattaaaatatttttaaaaacagaatctggattttctctaagatattccagtgcttttagttgcatatgaccaaaatcaataacattttctttttccattaattctttataaattggataagatttagctacttgtaaatacaaggcattgtaataagattgtttaaattccttattttccttaacttccattttaggaaatttaccttcattttcttccatatattgttctacaaaatcaatgtaatcttgactaattggataattatcttgaatatattttataagattttgtgaatcaacaccaaaagtacaatattcctcatatttattaataatgtttttagcatcccttttagaagcataagctattccagtgaatcctaactcttcaagatgttttctaacaaacatattaattttttcacctaaatcatcaccaataatacttaaattaacataccctgctttttctaaaattttagcacaaaaaccatgaatagtagatatctgcattttttgaacatctaattctgatatattatctgtttcttcacttaatcttgtttttaattcattagctgctttttttgtaaaagtaataacaagtaaactttcaggatcaatacctttattatttaaaagatattttaccctttcaattaaaactgtagttttaccagaacctgggcctgcttcaattaaaagaggttttttaccatcatacataacagctgcttcttgatcttcatttaattttttaggttttattttttgttttttaggtttagatggaacaaatttaggttgattttcaattaaaatttcttcaggaggattgtaaatttcactaatttctatattatgagtttttgcaaattctttaattgctaaatcaatatgcttttttaaatcacttttaggaacataatccttaataattaaattttcaagctctttattacttttatccgatgtttgctcgttaatactatttaatttagattcaaaatcttttctcattaattcattttcctcattaataattaacatcattttttctaaattaagtttatcctcatctgattctttttttaaattttcaatttcattagaaactatcttataaatttcatcttttggagcataattatctgtaacaaacttgcttaaatcagcattagaatattccattgttaaattgtcaattttatcttcaagattttttcttgaagaatcatatttttttgaaagattaagtagttcttttttaaaattagctttatcttcactagattgtatcatagccaaattcacagcatcattaactattttaccgacatcttctttagaataataattatctgcaataaaatttaccaattcttctttattattttcagaataattgattttaagatcattaaatttagattcaaaacctctttttaattcttcgttttcttttgaaagattaagtattttattttcaagactagctttatcttcactagattgtatcatagccaaattcacagcatcattaactattttaccgacatcctccttaagaatataattatcttcaacaagattaactacctcttcttttttacgatttatttgttccatcttaaattctaacatattcaacaatttattttcaaatttttctatgtcttctttagatacttgactttctttttcaatctgggttaaaatatttgtatcaaaatcagaattatgaataatttcattattataatcctccataaaccatacagatatattaaatataacttttaaaaaagctaatgccactctttcatttgacgaagaatcactatgtctatcatcattacggtattttcttgctttttgaagcaatttctctgatttggaatcaatgactttcttattttttaaatcaattattttttcaacatatgtttctttaggatgaattctggcattttcaagtaatatatttaaaattctttcaaaaaatttagaacctgaattaatagctccattagggtcttgtttaacttttttttccatgtcatgagcccaatcaaataaatcaggatagtcttcttttaaaaattcaaaatttgttggcatactgcacctataaataacctatttaaaaaatcaagtaaaaatttacttattaatcaataaatatacttttgttaataaattatttataattagctattttttccttaaagaaggtgtccataattcaaattctttaatttgaggaggaattccttcatcaatgtaagattccagatggccttcatgagatttaaaatccttgcagcttacactagctgaattacaaaaatcaactaatcctttatttctaattattgaatgaactggtttgaatgttgatgaccaaatgtaaaatactttaaaaacagtgtcaggatgatatcctccacctaaatcaacagataaaacatcacacttttgagttaacctaaaagcttccagaagaatctcatggcgtcttacatcaccagatataaatgttaaattggaataatcatcagcaagtttttccattttccctacagcttcaggactattatcaatagctattatttttacattgtcaaatttatccaaaattagttttgtagtgtttcctacatgacatcccaactcaataatggtatttccgtcatcagctatattaaatagctcttttctatattcctttatattatagctaatgtttatcatattttataccaatattatccagttcatatatatttaagccttcaatatccatgtttttaaaaacatctctattagatgcaaaggcaaatacagtatttccaagcattgccattgaagaacctaaaatatcatccaaagaattaaaataatcaataagttcacttacttcatcagacatcagatttgtcttttctgaaaattcaaaagaaaagtctaaaaaattcccaattgacggattttctacaaatctgttttttaactccaaacctgcatctgaaattatttttttatattctggattctgaataacagatgcagtgtcaatttcaccaaatgttttagtagctattatgatttcttcatcaggaaaagattttatttcaccaatccccggagctccagcctttgttcttaaaactatgcctttacccatttgagctattacatcacctaacccggaacctaaattaatttctgccctgtgagctatctgaccgcattcctctaaagtatatcctaaactgaaaaattcatttaaagcaatagccagacctaatgcagatgcagctgatgttccaaatcccgctccaattggaagctgaatatcctgagtgattttaaccggtttttcaatctttaaaatcttcaaaacttcattaataactgtataatctccctgattaacttcaatttccaaagtatcacaagaagaaatatctgttaaaacacctctgtttactaaaaaaccagctccacaggacccattttttaaaggatttgcattattttcaatgctaaaaaaaccggtaatgtgacccggaacaaaaactgaaatatccatactataaaattactttttaatattatttaaatctcattacctgttaaaaaatttataatattaagatgtttaactcccatataagacatatcaaaatcatctaatgaaagaacatattttggataattgtcatttacctttaaaagtggatcaaattctcttttatgaatttcttcattagctagaatataagttacctgaatataaattttttcagaaccttttctgcaaataaaatcaatttctttagtattgtatttaccaatattaacttcatatcctcttctaagtaactcaaaataaacaatattttctaaagactgacctatatccaaatctttttttaaaatagattctctaaaacctaaatccacaacataatatttctccaaatgatttaatatttttttaccaattaaatcctctcttttcaccttatatatcaaacaagcctcttcaagataagaaatataattataaacagtatttacagaaacatttatcctatcttttttaagatatttaacaatactattagctgaaaccaactgacctatatttgatactaaaaaatgagttaatctaattaacaaatcaacatttttaatatcaaacctttttacaatatcattaaatacaattgaatcaaataagtcctttaaatattggattttattattcaattcaaatgatgctggaaatcccccaaatgttaaatattccatgaataattctttttcggacaaattagaatctttgttgtattccaaatattcaacaaatgaaaaaggaaatattttaatattaatataacgtcctgtcaaatatgttgcaaattcaccacttaataatttagaatttgatcctgtaacataaacatcaaaattatctaatgaaaaatatgcatttacaagtctttgccaaccttcaattctttgaatttcatcaaaaaacaagtaatatttatctgttttattagatttgctttttatatattcatttaagtcatttattgttgaataactaagaaagtctggtgattctaaatcaatgaaaataatattttcctcttttattccattattttttaaatgattaacaacctgttgtaacaatacagatttgccagaacgcctaactcctgttaaaatcttaataatatccttatcaattaaatcaattatttgatttaaataatgttctcttttaatcatattttaccaccatttctaataaaaaaaatattacctatagaaaaaatatttaattaaatgaaattttttctttgtactgaaaaaattattaaaaaatttcttttttttcattagacaatataaattttataattaaaagtagtattttaaaatatttaaaattatttaaattataaaaaaatattacataaaacagcaataaataaaaaaaaactttaaaaaaaattataaattatcattaatccaacatttgactttgtcttttgaacctaaaacatcactgcccttaatttcaagaccatttctaatatctgcacctttacatagcttttttaattgttttttagattttccaaaaccggaaccctcatgagtaacaaaaggttttacaactttacctttaaaatccaatttatctaactgagattcaaaaacaatcggcatttttccccaccaaatgggaaatcctatataaaccccttcgtaatccccaacatcttcaagggtttcctttaatactctgccatttttctcatttttagttacttcagtacattccatataatcttcaggatagggaatttccggttctaccttaaaaacatccccattagttatctctttaatataatctgcaactacttcagtgtttcctttttcaactactttcaaatcaccttcataataattttcacctgcacgtgaaaaatataaaatcaaatctccagacataaatatctccttattatctaaatataatttatataaaaaaccgttattaagtatattccattttaaaaaaaataatgggcaatatttatttattatatttgatataactcaataatataacaattatactggggagaaaaactttgaataaaagaatagatttacatatgcacagtttatttagtgacggagaattattgccttcagaattggcccgaagagctgctaatttaaatcacgaagttatagctattaccgaccatgttgattactccaatgttgagcagatacctcaaatacaaaaagctattgacgatattaatgccaattggaacatcaaggttgttttaggtgctgaagtaactcatgtacctacagaatctattgacggagtagctaaaaaagcaaaagatttaggtgcacaaattgttgttgttcatggtgaaacattaaatgaacctgtaattgaaggaaccaattatgcggcagtcaacagtgaatatgtagacattctaggccatcccggtttgattacctatgaagaagctcaaattgcaaaagaaaatggaatctatctggaaataagtgcaagaagtggccattgtcttggaaacggtcatgtagccaacatagccagtgaagtaggtaataaattacttgtaaatacagatacccattcaccggataatctaattacctttgaaaaatcttatgaaatagctcttggggcaggattaagtaaaaaagaagctatggctgctattgttgataatcctcgggaattacttaaatctaaagggattttatgaaagcatcaaaattacttaatgaaataagagaaaacctaaaggattatccaattgattatctgaaaaacaaggtaactgatgatagatacaaagatccccttaccaaatcactggccaaatataattctggagtttatgatgaaatctatgaaaaagagcttgaaaatgatttcaaaataaacgatggagtcgttcaaaaaataaaaggagacattaacttttattttgacaaatatgctccaaacgacaatgaaactaaagaatttacaaaatacatttcactgtatctggcactaatagttaaaaaacctctgcatccttatggaaatgaccctaaaaaggatgaggtttacatgaaaaataacagctattactgtaaaggaagagcaaaatttataaaagaccagaaatctctctgcagatattgcatttgcaaaaatccgccatttgcatttatgttttaaaaaaatagcataagtgaaaaaaatcacttattcaaaactttatactgcaatattaagtcatcacctaatttaaatgaatcaaaaagctccagtcttaccccttcatccattgtgtcaaatccttcaccgtcaaataatgtatgtgaatccttacccccaacaacaaaaggagcgacacaaattcttatttcatcaattaaaccctctttaatcattgaaaagtttagagttgaaccaccctcaagcatcagtgttttaataccgctttcataaagataattcattaaatcttttaggtcaactcttttatccccgctgaaaaagaagtcaattccccttttagtaaaattggcatatctgtcacttacaataaattcaagtttatagtcattagctcccgctattatggtttttgcatccttatttgttatgcgtgcagctattggagttctgcatttgctgtctaccaccacacgaacaggattgtcttcaggatttgcatctattttatgaaccgttaatctgggattatctgcaataaccgtattgatcccaaccattattccatcaacttcacgtctaagttcatgaactcttttcaaatctttttcacctgaaatattggaactgccagttttagtggctatttttccgtccagtgtcatagctgcatttaaaataacatacggtttcattcaaatcatcctaactgataaaagaattccttaatctgcatgaaattagccaatgtctggttttgaagcacatcaggcattactattgcaacaattataccgattaatccgcaaacaattccaatagcccaaattattttaactgcctgcttttcaggaatcggttttcgcagtacaagcctgattaaagatttgaatccgacttcaggccttaccagatttccattttcatctacctgagtcggtttgaactgttgcctttccataactcctgcactgtaaaatttaagggctgcatcaataatgttaggcaaaagcacaatcaaagcaattaattttacacgacctataaaagctattgaaacaattgttgcccctataattaaagttccagtatctccagggaaaatctttgcaggatatttgttaaagtacaggaaagctattaaagctccaagcatactcatactgataattgtaacatcatattttcccaaaataatacaggatattgttaaagaggtaagtgcaattattccaagccctgattcaattccatttaaacctgccagcatattggttaaattggatccgattgaaatagctatcggaatacaaataagatatacaattccaacatttggaggtgctgcccatattaaaggaatacctgccaaaaacaataggaacagcttttcttttgatgaaagcacaagcaaatcatcagcaatacctataatccctacaagaagaattacaattaaaacaatgcataacggaaatgtaagaatgtcatgcatacatattcctgaaaaaatacctattataaatccaaataggataccaaatccacccatttcagccacaatcggcttccatgatttatgcaggtccttacctacaatatctgccttttctaattttctaataattctaggcattgataatcttgttactaaaaaagataaaataccacaaattattgctattgcgtacaacggaagttgtgggaataacatcataataatcactttataaatatttttatcacttatagaataataaatttatgataaaactagctaaagttcactattccaactaaatctatttaaaataaatcatatacatttcccaaaataatttaacatcactatttccatattacaattataatatttatttacctttaaaattttatattaagacctaaaaattgttatttttaaaaactaactattttaaatactagatagttcataatacgggatataactaataaaaataagaggtgaaaaaatggttcatcaaagtgaagatcaattattcaagtatgctacaaaagaagatgggtttggattattgaaacttcttaaagaatcaaatgcaaatataaaagaaatagactttaaatccgaaaatttaacatataatcctacagaattagtagaattaggtcctaaaatatacaaaacagacatgatactggaattagatcatttaattgtattaactgaattccagtcaacaattgtaaaaacaatagatgaaaaacgatacaggttatacactgcccttgtagattatgcaaaaagaaacaataaaccactaatactaatagtcatcagtactgctgagaaaacaaaaataaaacagtacaaaataaataaagactgtgtttttacaattccaatagtatcactaaaagactttgatggtgataaaattataaataatatagaaaataaaataaaaaataatcaaaaaataacccgacatgaaatgctaaatttagctttagctccatttatgagctcaaaaaaaccattagacaaacaaatagaaaaaaccgtgaaaacactagatgaagtaagaaaatcaatgaaatgcagcagtgattttgtatttggaatagaattattaatagtggaaaaattcatcaaaaatgaaagacagcacaaaaaattaacaaacatactgagggataccatgaaaataatagatgaatggagacaagaagactacgaaaacggaaaacaagaaggaaaagaagaagaaaaaataaataccgcaaaaaatatgctaaaagaaaattacaccataaaacaaatagcaacaataactcaattaaacattgaatcaattaaacaaataaaagcagaatttggaaaataaaataaaaaacttttaaaaccaaaaaataacacaacaaaactaatttaaaaggagatcttattctcctaaaactttttttaataactaaaaaaaacctattagtaatactttaccaaatttacaccagaaaatattcgttcaccagactttcgcagaatattattaaatcaacaatttttctttaaataaatctattaattcgtttaaatttttatatactgatttatatctataaacattgtaatattctttgtactcatcagtatttatgcaatttcagaaagacataaatgtttttcaattttattattaaatttctctatgaattactatatctcatcatattcatcgcgaaaaaaattcagactctcaaaataattttatatacttatgaatcacttaatcaaaatcatcactgtcatcaaagtcattcccccaatccagactatctgataagtcagatccacattcatcacatattgctcttgatgaatcattcagatggccacaaacattacatgtaatcatcataatacctccattaaattagtttaaaaactatttcaggatatttatctattaaaataactgtgaactaatcaattaaataacctttcatttccccataattatcaaaatataaaataatcataactgatatttataatattatatatggaagaacaagtttatatttattaagttattgttgtcctattgattttaagataatttaaacattatttatcttcatcaagtcctttccgattattaaaaaataaaatagctatttattatttaaaatataataaactgttctaagaggaatatctaattttgaagctatatcctttggttttaaaccttcttcttttaaagatttgacttcctcatgatcatgttttttagaataattactgaatttaattccctgtttattttttctaaggagataataaactttattttgagaaatatccaataaacctgcaatctcctttgcctttttaccttttttaactaaatccaatacatctttttccaatgatgagtatttagatttagctccccagttatactttttagaaacagtaatatcaagctggtccaaagcatcaatataattcttggaaatcctattaaaaatactgggacaacaggtaatctcttccagattgggatattcttcaattaaatccaaaatagttgaagaagttaatccttttgttatatgtacagaagtaacatcctcatccataaacatcacttcttaattaaatctaaaaatttcttggattttgcacttttcggttttctgatatgattaatatttttaagttcctttttaattttagaatcattaatatttaatacatttccaatagtttctatttctatattaccatgttcatgtattaaaccagcacctaaagcaggatagttaaataaaatatttgagtttttggactgtttttcaaacttgaatttttcatataaaataagatccatatctggaattgaaattatttttaagtctgtaaactcatttaaaaccttgataacctttttaaaagtagtctggaacactttacgttgttgacgatcaagttctgctctaatatatggaaatggaccattgctaatcttacggttattgtgtgatgttgttaagtaatatctgaaaatatcccacatcattaaagtaggagccatattttcaaatatggttttttcaatattttcccttatttttaaatctctttttaaagaacggttgtaattaccgaatttatcaatgaaatgaagcttttcaaattcttctgtaatctttgactgtctccaggattctaactctccaatatcatattcttcgataaatcctggaatttcattttcatatttatatctgatagcatcatatttattaattcttttaaaatcagacagtttcctttttaaaatagaatctttaatgctggaaataatgtcttcactatatttaacataactgatagccagtgcatttctgacatatttatcatcaataatagcaggtttggttctgtggaatcttaaaacttcaattctgacatcttttccgtatctgtttctaacctcttcctcataattactgatatattctgaatccagagttacattcttacgaatccaacgtccattttcatctctaaaacggataactaaagaaatagtttttacaagacctttacgttcttgtttaagaatatttaatacttttttaaatgaatttcttccataacctgacaattcactcatcaacaccaaataattgccggacaaaggcaaatatggaataatttccaatctgtaggttgcatccttatttattttaaaagagaagttttcatgaccgcagctgcatttttcacctttaagtctgaactcgctgagggaatattttttataacatgaatcacatttaagataaccgcattgttccaaatgtccaattgcaattttatgagcatcaatagctgattttactctgtccagaacattttttttagcattagctttcattctaaacatctgattatgtctactgttttcactcatttcctcaagtgaaacttcagctattgcttttgtaccatatttatttaaggatgtaaaaggagtggtgtatccctgtgcatccatactctcttttaattcctgtaaactgtttaatctgtcatctagtttatagtataatcttttgaaattttcaaactcttcaatattatccaatctaatactgtcatttgaaatctctttgagatatttttcagcctttgcaactagagcagattcttccattaaaatcactgaattaaattaagattattgtattctttcaccgacttcacattcgtctggagataataatgctgcactttctccagttgcaagaatcattccttcagataaggttccgaataattttgcaggttgcaagttaacaacaacagccacttttctgtcaattaattcttcaggagcatactgttttgcaagacctgctacaatttgtcttgtttcatctccaatatccacctgtaattttaataatttatcggatttttctattttttcagcttcttttacctgtccaattttaataactactttgtcaaaatcatcaatactaattaaatcactcatattttcatcctcactttcttttaagtttttctgcaattcttctttttgcttgttaattacatcatcttcaatttttgtaaataacggtttagctttatttattttgtgtccttcagctaatgggactttagcatctttccactcatcaggagtggtcagattaataattttagctatagcatcagctttatttggaatataaggtttaagtacataagccaatgttttagctagttgatttgataaatataaacagttggctgctttttgcatatcttctttaacagctttccatggttcctgatcattgaaatatttattaccaattttagctaccctataaatctcaagcaaaccgtctctaaattcaaaatctgaaatatattctccaacagtatcaggaagtttttcaatgatttctttgaatttgttatcttctgcagagggatttttatattcaggtatttcaccgtcaaagaatttatgggtaaatgtaaaagttctatgtaaaaagttacctataacatctgccaattcatcattgtttcttctctggaaatcatcccatgagaaatcagtatctttgtttaaaggtgcatttatagttaagtaatatctaagtaaatcagggtcaaatttatcaacaaaatctgctatccaaacaacccaatttttactggtggacattttttctccttccaaagataaaaattctccagcatatatgttatcaggcaatttacatccgtatgccttaagaagacctggccaaaagatggaatgatggtaaataatatccttaccaatgaaatggattgcagtatcattccaataatcttcccatttaatgccagtttcccttgaccattgtgcagctgatgagatataacccaaaaatgcttcaacccaaacataaagtactttgcctttagcttcatcaagaggtaaaggtattccccaatccatatctcttgttaaaacccagtcatttaatccttctttaagccaatttttagcataatttctaacattggcaggaagattttcattattatcaatataatctttcaaatcatcttcaaactcgcttaacttaaagaagtactgataagtatccttaataacaggagtggaaccgcaggttaaacatttaggttcatcaagttcagtaggttccaaagcccttccgcatttttcacaatggtcaccgcgtgcttcagatccgcaaacaggacatataccttcaacataacggtcaggtaaaaacttattacacttttcacagtacagctgctgaatatcctttttataaattaaccccttattatataattctaaaaagaaattctgagcaatttcataatgtaaatcatcagtggttcttgtaaagttatccagggaaatattcattgactctacatcacgaacaatcatgtcatgatatcttttagcaatttcaatcggttttttgttttctttatccgctttaacagcaattggagtaccgtgttcatcagtagcacaaactaacagaacatcattatcaatcatacgattatatcttgcataaatatcagcaggcaagtaagtagaacgaatatgacctaaatgacagggtccatttgcataaggaagcgcacatgaaataaaaattttagacattaatttttctcctaacttttttaagcattaataattatgtcattcatataatataaaattaatatatgcgaagttaattaagaaatattttaaaacaaaatgatttaaaagataatttaaatccaaatattgaatttccaaattagctattttaaaataaattcaaatatcccaaaatcgttaaaaatgaaaatagaaaaatgataaataacctcaggtcagatattaaaaatcagttatatctgtttaacagtatcattttctttattttttaagcgtatcatccagaatagctacagctttagatttggcatatttatctgtttttttaacaccaatcattttagaaaatcccggaaaatccaaatcggcctcatcactaaaccagacttttcttaaaaagtaccatgaatgaccttcatcatctacaaaacaccattgattcatagttttgggattgatgtttttgagatatttagttaaagcttttttatttgacatataatcaaaaaacggacatattttcatggttttggataaatccttaaatttgtccctaactttatctttattgaatttccatattccgctatcagtaatttgaccaaatccatcatttacattaaaaatggaactgaaatattcttcaacatacttacatgggaattcagcaggatttgaatctccgtatctgcaacagtaatccctagacaatccgttattttctttttccagagcacatgaaaatacgtcacagacctcatcaaggattacttcttccccgtcaagcttaattaagatattttcattatttaaattgtctatttcatttttcagatgttcaaaatcattaatcattaatttatctgatttaaagttctctttaccattttcatccaggttaaataactccagtttaattttattttctttaaatctgtttacaaatctggacaatgagttattggatttattgaaagcaaatatttcaacattaaagcctaaattcaataaaaaatcaatccatagcacttccaaatcatcaaagtgttttttagattcattccacatgaaaacaaaaagtatatcttccccattgaaagctaaaaacggattaaaagagttgaaactttccttatttaaattcattctgttgataattgacagcagttggtctttggaaaatttggaaaatatggagtttaccacatccattgcagaaaactttaccttgataccgtgtttttccaattccttatcaatgaatttaaaaaacttattaccgaaatatctctcgaacatgataaaataatcatacctttttctttcatcataatgggctttaagatatttgaaaccgtgggaatgcagaaaagattttctaacctttttattttgtttatcgaaaaagacttccataaaattttcaaacaggctcaactcttttacatttatcatattgaacaaagcatgctcattaagatttgattgaacagtgattatcttagaaaatgtgtcaattctttcggaaatatcttttatatcacatgacagaggaatcttatcttcataaaactgagaaggaatattcttaaaatcacttttggaaaattcgctgccagttatatcctcccaaaaaatacaatcaaatagacttttccaaaaagaactatttaaaaaagtataataaccagaataagtataataatcagttaaaacctgaacatcatttttaatgtcgccatcaacatcataagcctcataaacttcattataatcacattcaaatgattgaaatgttatatttcctttacataccatgtatactacccttaaaaatcttaattattattttaataaaccgtaatattaacagttttctattaaaaaagcaaaaatgaccttaaaaataagataattttttaaaacatgaaataaaatataaaaaacatggttgaagtttcatttattaatccattgtccaatgaaggaagacaaattgttaaagagtacggagacttaaataaactctttgatgaagatgaaacacttgtaaatgaaataatgcatactgcaaatcagaaaatatccgacgattccttaattcctaaatcctataaagatttagctataaaaagaatacaatgggcaattgagaaaaaaaataataaaaattacactcaaagtgaatttgaatacctgttaaatagcagtttatacagacaggatgttgtaacattccacatcctatgtcaggctatagctattcagtttaatgtaacttcaagagaaacccgactttttattgaatcccagggaaaaataattgaagaaagactggctaaaattccgccaggaagcagaagcgaaatcattgacgacatcttaagagacatcaaaaccgacggattcattaaatggaaagccctgaaagatgtaatagcctctaaaagattatcattaactgatttgttaatcaataatgggaatattattttagaagaagatgaatttttggaagagtattctgatgagtttacagatagaaaccctgacagaatgtataatatactggtcggaaataatattaaagaactgattctttccagacttattatgcaaaaaacagaagaatacattaaaagaatcaaagaaatgtcatccagaattgaactccaccctgccattactgaaatcggagaggaactaaaagagttcattcctgaagaaatcagcaaatacaatactttctatgcaggcagcggaggtatttacggtacagttaaaggtggaaaattacttagagaagcatttccaccatgtattagaaataccattgaaggagtctcatccggtggacgtaacgacgctattgtactattattaacttcatttgcatcatatgcaagactatatccgagaatctttgcaagtgatgaaagtgttaaagtatcagatatggatcccgatttatcaataacagaaaatgaaatcctgcctctgatttatgaagccgcagataactgttcaccaccgttatttgatgaccagcctcaagaaaaaatcaatatcatatcaaagttgggttttggtatgcacagtgaagttgacatcaatcatgaaggagaaaccaaatggtatactccaatgagctgtgaaaaaattaaaattcatttaccccagttatgtaaacctgacagctcatgtaaaggaattaataaccccctatcatgttacggacgtaaaaaatatcaaattgataataaaaaagattaaaaatcattatccatctgtttaaacggattataatcatccataataacatcataatatttatttaaaatctttgattcccattgattgtagttgctctgttcatttttttcaaatttataagctaaaagaccaattttacgttcattttcatcaataccctttttttgacaaaaatcagaaacaatatccggagtgtattcacagacttcatcatctttaaattccaggtattcctcatactcctgaggtgaaaaaagctcttcaacttcaatcgggtcttcttcccaatcaattgaatacaattctatataaacagtgtcaacaagaggtaactgatttaattctatccctaaaccatatattttcccattttcaaggtttaaaatagtatgtcctgttctttggcaaggataccattctttataagcatgtttaacaatatcttcaggggttaaagtagataaaactgtttttaagtgttcaacaccaattacttctcttacttcttcattcataatatgaattatagttaaatttattatataatactgtgcatttgcacaccataactattattaaatactttaaaataataatcataatatatctgattattatgttttctaaagctacacttaaagaaagaaggcagtattaccgtgaggaatggtccactaaagacatgcctgactttattcttaaagatttaaagaaaagggaattcggttttgaccataatggaaagggaccaaatgaccggtataaagtatttagaggaagcgagtccttaaagaaatttttaagatataaagctccttttgcagcttatatctctgtagctttttataataatccaagaagacgagaagattggcagaaagcagaatatatttttgatgttgatgctaaagatattccaattagaagttgccagtgcgacggtgtgtgtgaagtttgtttaggacaggctttagaaattgttaattcattaattgatacactgcaggatgatttaggcttaaataatattcacttagtttactcaggaagaggatatcatatcagaattcttgatgaagaaatgatgacctctggaagtgaattaagatcagaagttttaaaatatgtggcaggtgcagaagttccaaaatccaactttttcaatccagacatatcaaataaaagctttaattttgagcatttcagcattcctgtcggatactccaaaatttttactgataaattaaaatataatattcaacatttagtaggaaatgaagaattagatgaaattaatcctaagctaatgaaggacatcataaaatataggcatcatctggataatgacaactggggatattttaaaagagatatcggtcctagaagatataaaaatttaacagaagctatggcaagagttaatttgtccactattgatgctaaagtatctatcgatttaaaaagaatattaaggcttccgtcatcacttcactccaaagtaagtatgaaatgtatggaagttaaaaacagagaaacatttgaccctctgcaggaagctgttcccaaatttgttgaagaaagaggagagtaagttttatggacaatgtgttaaaagatatttttcgtaaaaatccgtattttaaggaaatgaatgaaaatagttttataccgcaatacagcgaactgataattaatggagtagtacttcataaagtaaattggattacatttatagacaaagagcttttatttatgaatgaagatgctcaaaatatcccaatcagttcaattaacttagaaaaccttaattccataatgattcacaccaatgaaggaataaaagaagttttatagtttttcttttatttcatcattaactttagctatgctgttatctgcatctataatattccagtcgtaagtaactttttttgatttgattctggctttttcaagctcttccatattttcaaacatttcagtttcttcgctacgattatcaattctttttaaagattcttcaggacttacatccaggaaaaacatatactctgatgttggaagaacaaatgaaacaaatttataaataattatattaataacatttggaagataaacaacagacataatatatcttgaaaagattaaaacatcaatattatcattattataatattttctaattgatctgattgcatccaatccaaaataaacagtagcttttaaatggttaattttaccagtttttaaaagtgcctcttttgattttataccatatttattatccatagacggatgtgaacgtacaacaacattttttccctgtttttcatacatttcagcaagcagtttaacctgtgtgtcttttccggaaccatccaaaccatctataacaatgaacttgtccattaaatcacaccatcaaaatataatacaaaatcgcactgacagatgaaacacttaaattatccagacctcttggagtaacggcttcacaaacagtagctattaaacttataaatgctacaaatgcaaaattatactgtggaatatcatatccaattgcaccgtaaactaaaaataccatactgcacattacacaaaccattatgaacatggtaagtgaaccttcaacggattttacatcaccggttaagttaaaatgatgtcttccatatttttgacctattaaagacgcaaatccatctccgtaaaccatagctccaacagctactcccactatccacagtttatcaggaagtaaaaatattaaaagtgtccatattccggcatagtaaactaaacctaaagcatgcccagcatctgtaactccactcttaattttgattggagagtatttagtcaataaaaatgcagctattgtaattggaagtgttaaaaaccacaccatagcataagggtcattgaaaaacggcattacgaaaatacagtttcccaccataatatgaacaaaacggcgggaaaaagacggcaggtcttttaaaaacttctctgaaacaacaaaaattgcgataacataaatatacactaaaactaataaacctatatctgccatattcatgttatcatctttaaaactttattttgatactattttcacatcagaacttttagattcaatcggataaaattctgtgtattttgaattcctctcaatagggtttctacctaaatctctaaccatattacttaaagtatcaatagatgcctcaactccatcaggtgctcctgaagcttcagacaattcatctccacctaaagttccacccaaatcatttgcaccagctgttaaagatacctgtgcaaatctgaaacccatttttacccaggatacttggatatttggaatcaaatccttaagcattaatctagctactgcatataattttaaatcctcagtacctgtagctcccaagttttgctgaccttctaaaaaaattggagaatactcatgcataaatgtcatcggaataaattctgtaaaaccgtgagtttcctgctgaatttttctgataatatcaatgtgttctacacgttcttcaggagtttccacatgcccgtacataatagtagctgagcctggaattccaacttcatgagctgtttttacaatatcaatccattcctgtgttgttaccttttccggacagattatctctctggatctgtcagtcaatatttctgcagcagttccaggcaatgtatctaaacccgcacttttaagcctttcaaatgcatcttcaacacttatgcctgatacaacactggcatctttaatcatagttggtgaaaaaccatgaatcataatattgggaaattccccttttaacaattgaagcaaatgttcataatattcaacatctgcatcaggtaaaactccccccatgacacaaaactcatgagctcctttgtcaacagccccctgagctttttttaaaatagcttcatcatctaaaatatatgcttcagggtcatctgcatccttaccaaatgcacaaaaaccacatcttacagtacaaatatttgtgaagttaatattacaattattaataaatgtaacgttgtttccagcaatttcttgcctgagataatcagcagttgcaagtaagggatacaagtcagaccctttaatatttattaaatagtttgcatcttcagcagaaattggttcatcaagagatttagttaaaattttttctgttttagaagatataggtagtttatcaaacataaaataatataataatttaattaaataaatatctttccatataattgaatcactgcaaagttaacaaaatgaaaacatagtaaattcattcaatattttatccaaaataattatataattgaacaatacaacattatatattaaaaactatgaagaggacaaaaatggatagtactgaagctatttataatggattaaaagatgctgaaattgattttgttgttagtgtcccttgtgttaacttaagtaaactgttagaaatggttgacgaagacgaagaaattatgcatattccagttacaagagaagaagaaggaataggcatttgtgcaggagcatatatgggcggtcgcaagcctgcaatattaatgcaaaattcaggacttggaaactccatcaatgcacttaaatcattaatggaattatataagttcccattagtaataataataagtcataggggaactgaaggtgaaactatctgtggacaaattccaatgggagaatccacaccaagactgttaaacgctatggatttccatttctttgaaccgactaattctgaaaccgcatatgaagatgttaaaaatgcatggaaattatctgttgaagaaggtaaacccgtatctgtattattagaaattaaatattggtgatttgatgaaaagaagagatgcaattgcaaaaataatgagtgcaatcgatgatgaactggtattgtgcaatataggatttccttcaagagaattatacgacatagatgatagaaatgaaaacttttacatgatcggttctatgggacttgtttcctcaataggcctcggtcttgcactggctaaacctaataaaaaaattgtcattatagacggtgacggatcatttttaatgaacttaggatcagtaatcaccacttttgctcaaaacccatctaatttaacatggattgttatcaataacgaagcatacggttcaacaggaaatcaggaaacctatgcaaaaaacttaaacctaaaagaaatggctaaaagtgtaggtattaaaaactgttacaattacgaagaaatagacttaaatgaaataataaacaacaatgagtgtaactttatctgtttcaatacagaacctggaaactcaccagcaccaattatcgatttaacaccaatagaaattaaaaaaaggtttataaaaagtatataaattaaatgaatctattcagactcatttaattccttaattttcttatcaaaatcatttaacttatttgccaatcctgaataatacgggatgtaaacttttgaaaatgttatcctgtcaggattttgattaacttccctaatcctttctttgactttttctattttcctttcaacttcatcatacatcaaatctccagggaattcaccaataaatattccatcagcaccattttcaagagcatgtttaatgtggcgaggccttacacgatttacagaaagcaccctaatgatatggatggattcaggataagacaatctgttaactccaatattatctgctgcagtataaccaatattatcaaggaaaactaaaatcatacgttctccaggttcttttttagccaatactccatcaattgtagcttttatcttttcatcaatattaccgttaactgtaatagcaaactgcttacatccaactaaacattttccacaacctgtacagctcatcgggtcaatgtagatttcatcatcctgaatactcattgatttgaatttacaacgttcaacacattcaccgcaaacaatacatttttcttcatcaatttctgcaatgaatggttcaatttctattccgccataattatattcagatactttggaagcagctgcagtagcctgcataattgattctgtaatatctttcggatcctgtgctgttccacaaacaaaagttccctgaatatcagtggttacaggtttgatttttggatgtgcctctttaatgaattcatcttcagtagttccaacatttaagatttctgcaatttccttggtaccttcagaaggttccatagctgtagataatacaaccatatctgcttcaatttctgaaaattctcttttaagagtgtcttcaacacgaacaataaagttaccatttcttttaacaacttcaccaggtcttccacgtatgaatcttactccattagcctgtgtgtgtttataatacttttcatacatactaggagttctcatatcagtataacagataacaacatctgtttcagggtgtttgtgttttataatgtttgcattttttaaagcaacactgcagcatactttggaacagtacaaatgtccgtcgggtttttcatctcttgatccaacacactgtatcataactaccctttttggaatttctccgtttgattttaccagtttacctttagtcggaccgtttactcctgtaatacggcccagttcactttgagttataacatcatcatatctggaatatccgtattccggtcttaaatcaggatcaaagagtttatgtcctgtagctataataatagaacctacagaaatcggaatcttttctggttttactttaaaacggatagcattcatactacattgtcttttacagtccccacacctgtcacaatgttccatatccacaacatatgcttcaggataagactgaccaaaaggacgataaatagcttttctgttagatagtccgtcattccaatcatcgggaacttccacttcacagacttccgcacacttaccgcaggctatacatttttcagtatctacataccttggagatttttcaacaattagattataggttcctgcccttctttctgattcaatgacttttgcattagttataatctcaatattttcattccaaacaacttcattcaatattggattcagtaaacacattccacactcttcagctatttttacaggagagaaaacttttcctattttagccatatgtccgccgatagatggggaactttctataatagttactttagttccctgtttagctagtgacaatgcagcattcatacctgctattccaccaccaattactgccacttcatttggtgtttgacagtatatcggattaacagcatctgatttttttactttttctattgaagcattaataagagttatggcttttttggttgccccatctttatcattatgaacccatgaacactgttcacgaatatttgccatatccatcaaataaggatttaatggctgaacataatcctgaaaagttttttcatgacttattggagaacatgccgcaattacaacacggtccaaatgatgatcaaaaattgcatccctaatgatttttcttccatttaaagaacataaatttacaaattgctctacaacttccacattcagtgaatccttaactttttgaatatcaacagtatcagagatatttccaccgcattcacagatgaaaactcccacttttaaatcttcaggcattagtcaacctcccttaaatcattaatgactgaatctattggtacagtatgtgcttttgcaccgattacttcatcaaagtcaccacccattgcaatagctacaaattgagctacatttaaatgaatggtgttaaattcttcaccacattttttagatattaaattctgatatctgtcaaattgaacatgacagttaggacataaatgaactagaatttccaccccgtcctctttaatagagtataatttatcttcagttacctccatagacatatctttattagagtatctttgtctaaatccgcttccacaggtttggcgtttatggtcataccagccaaccgttttacatccgcaggcttctattatatcatcaatgatattggggtctctgactccccctattgtatcatcataatgaactttacagtaatgacatccgtgatgagtagctattttatagccgcttaagtcatatttaatgtttttagagatttcatcacgtttattgtataaaatatccactacatgaaaaatattttcagatgaatcaacatctccagattcatatttcaaataagacaattctgatttatcaaaaacttcatttactttatctcgaacatcatcctttttatttaaaatatttgctacctttttattaattgcataacatgttgcacacatcattaccaaatttggcctgttcaaattactggctactttaaagttacgtgctccaatagctgttgttgtaaactgatcaaaaacatcagagtaatgtccaagacctgtacagcaggtttgcttatctgaaatatcataatcaataccaattttatcaaaaacaaacttagtggatgattcaatacccggatattccacacttacaagacaacttttaaacaaaagaatattttcatcaggaacttgcttcatcattaccctcctttgactgtcttattttatccattctgtctttaaaaccagtattggttaaaattaaagagacttcatcaataacttcctgaggaggtgaaaccggacctaaacccaattcttccctgatttcactcaagtgctgtctaaattcccaccatccgtctacatcttcactaatttcctcataaaaattagatgggattgcaccgatagctgcattaaagtagctatctgcaaagcctaaataatcatatagctgctcatatgcaattccttttgatatggcgaactgtttaataatctgattaacttcacaaacactgtttccaacaggacatgtactatgacatgtatagcaataaaaacagttccataagtcttcatcttcaaggagtgtttcatctccttcaaagaccctctccattatttcacgaggattataattggaatgacgtgctgcaggacatgttgaagtacacattccgcactgaacacattttaagacaccatcatattttgaacttttaatatcttcttttatagcctcggcaaaatcaagaggtgtttcactgattttctgagtatgcatatcaataacctcaattataatttaaattcatgatttttaatcattttctttaattttaaagataatttattagctcttaaggcatcggactgcctgcatataattggaatattatgttttttaccgcctatttccaggtcaacattgcctgcatccattgtaaagctattgtttttacagtaatgcacacacattccgcaaccaaaacatttagataaatccagtcttttatttttaaatgcatttgttggacatacatcctcaactgtacaactatcacagccgcagttatctgaaacatattttggccttaattcatgattatcccacattgcaccataatcagtttgtgtcagtggcaaatgacggcctttaatatcagctacagttaatggaatgtcactatttttaattaataaattattatatatttcttcatttaaaacaggaattggaatagccaatgtatcgtagacttctccgccttcaccggttttaaatccgccaacataatttgcttccatatctttaagatttcctgaaaccattaaatttggtttttcaggtgaacttcttgttccttcccctaaaacaatagcttcagcaccgtttaataaaactttagttccgtttccaattattaaattattcggatcattttgaagagggtttaaatccccacatcctgaaaatgtcagaccttttaagtttccttccagaggaatagctgaaaatattgatgaaacctgttctgcagatggatttacaaatgctgtataatttttaaatgccatacgtgttccaatcatttgtgctcttgtaatttcgccaatgtttgttgttgattcaataatgtctccattgattgcttcaactttaacgtcaatatcttttccttcaagaatgtcttttaataggaatcctccaccatatgatgagtcttctactgatttagaggttccatgaagaattaaatctacagaacccaaccattcattaggacatgggccaatattagctggaacaccatttaaatatatattttttgccctcataaacactcctggctctgatactgtaaagttaaagatagctgcagtaccgctcataactccacaggttcctgcagttactacatccacttcttcaaagcttggagcattgtcttcttttataagctttttaaactcttctgctgtatatattttggcttcattattttcaatcttcttattaatttggccaattgttctctctttcaaattaaataccttcttttaaactttcttacggtttaaatttttcctacagtatctccccttaaacctcttcttaaggtttcaagggaagtgatatcgtcagttgatacattacctaaattaacatcatttccaagttttaaaatgaaaaatacttgctggtctttgtttggagcttcccaaaggattttatttccatcgaaattatctaaaatataatctatttcatcttcttttgcatttcctgccttgtcataaattccaatgttttttccaccttctcttgcttccacaatgattaatgatgaacctgcttccaattcattttgcatatactctattctttcatctaaagacaattctttatccagtcctggatcttttttacctacttcggacaatacttcgaatccgtcttttttagctgattctatgcattctaattttttgtcatgagatattgttgttgatccgtcagatacttcaatagcttcaaaacctaagtcatgagcttcctggaagaattcttctaatttatcattcatatatgccagttcaaagagagttccaccagtatacggagttatgttgtgtgatttatacatggcaactttatctttgattatatcctgttcatgtacaattgatgttccccatccaaattttaagtaatctacataatctccggaaatattcattaaactttcagcagtttccagtcctagacctttgtccagaaccattgttatacctttttgtcttggtttttcttccctttctttaagtaaaaaattaaaagatttcaattatatcacatctgttataatttctatttattagcttaattagtatattaacttatatactttttaatttatcgtcactttcaaaaacttgtgtgatttgaattttcactagtttttgagtcacgaatttttttcgttctattttttctttatttttaatttaaaagcagtaaaattaatatattaagtggagctaatatattaatatgtctagtatcaaaataaaagctccatatgaatttatggagtcaaaacaatttaaacttttcgattttgttcctgagttttctgaattccgtcaatttgatgatctttctcgatttggttgcgaaaatattgagaataatcttatcagattggaaaaaagaggtaaaatacattttgagaatagagttgcaatttgtccatcttgtaaatcacataatgctgttaaaaatggtacttatgaacgtaaacttatttttttaagaattggagaacaaatttgcactattcaaaaatataagtgcataaaatgcggtaaagtcttttatactgatttattatctcttgtttattcaaattcaaatattacattgcctgttattgaatgtattgagaatttatatcaaatttatggagcagggctccataaaatacgatttgatttaaaacaacaacataacattgaaatctcacatcaaagcattgaaaacatcttattgaactctaattatcaatttaactatgataattggacttattctggatattacttatttgatagtctttgggttaaaattaatggtgaatggaactatattttagccttattcgacgttaaattgaatactctcgtttccgttaaattggtcgaatcagaagattctaagaccatttatcaatttttaaacgaatctctaagaaatcagaaaaaaatatcaataggcacagacttaaaacacgaatatcgtgaagccatcgataaattaaaagtaaaacaccatttctgcaaatttcacgtgaaacaagcagtaaacaaaagatttaaagattactttgacaaaaatccattatctgaagacgaaaaagacatattaaattgtttaaaacaggacatttataaaatattggatgcaaaagacttaaatactgctaaagaacttagaaacgaattaataaacaaaaaatatacaaaaaacaagttcacaaacaaaattctttggaaattcatcattccttacttcaaaaaattaacgacacacctggaaaacacgaacatcccatcaacaaacaataaaatcgaaaatatcttccaaaaagtattcccaaaacacataaaaagaacaatgaaaatagaacaaggacttctagccagattcatgctaaaactaaattattggaatttaaacaatgaaaaagaaaaaaatcacacaagtttttgaaagagccaatttatccactaacaatagttataaaagaagataattaaataataataacattatggaattccaacatattgatttaaatcagacccatatcagactaacaacagacttgaaaaataacaatttggaaaaatacatattaaatctaagaaaagaactggaacattatataactaaaaataaagattttcaattatctctggagcctgttaatcatgatgaagaggatttgagtgaaataataaaaagaatgtatacagcttccagttactgtgatgtaggtccgatggcttgtgttgcaggatgcatatctgaaatgtctcttgattacctaatttccaaaaaatccgaatattccattattgaaaacggaggagacatagctattgtaaacaataaaaaagcagtatgcggaatttactcaaacaatcccatattaggaaataaaatcgggtttgaattaaaagcaagaaaaacaccgttgggaatctgtacatcttcaggtaaaataggccattcaataagcttcggttatgcagacagcgttacagtgctgagtaaaaaagcatcagtagctgacgggcttgctaccaaaatagccaatgaagctgttgggcaaaacagtgaatataaagtatcaaatgctcttgaagctagtgaaaactataaagacctgtttgagggagttttaatcatttcccaggataatgttggaagcattggaaaacttccaaaaattgttgaaactgaagaatttaatgttaagatgtgaaatatatgaacctcggaattattggatatggaaatattggagaacttctcagccaaaatataatcagtcatgatttttgtaatttaaataaactctacattgcaaatagaacactatctaaaataaatcacttaaaagacattgacccgcgcatatcaattacagatgataacatagaagttgcaaaaaactgtgaaaaaataataatatcagtaaaaactcccgatttggcaaatgttttagacccgctaaaaccacatataactaaaaatacacaaatcatacatacctgtgcaggaacagacttggaatttaaagactgtggtttaagctgcgttattccaacaatatcttctacatatgatgaagacaatcctaaaaaaggtgtttccattattatgcatgatgaaaatgtttctggcgaaaatagagaatttgtcgaaaagctattttcaaaattcagccagataaaagttgttgacagtcccatggatttggagatagctacaatagctgccagctgcatgcctgcatttatagctcttggtttagatctttttgctggcgaacttgaagagaaatgcaatctttcaaaagaagaaacctttaaaatacttgcagaaacattaaacagtacggcatacatattaaaagaagatatttactcacctgatgaactgattaataaagttgcaactaaaaacggaataactcaaaaaggattagatgttttagacaaagacctgccagatatttataaaaggttaatatctaaacttctgtaaccaatgcaatatttaaataagattaaaaataataatattaattaatattaataattaaaactaattatttatttcatttaaataatttacttaaactcttaattatagatactaggtcagatacacatgtacaaagatgaaatgatacaattacatcaatttttagtttatattttaaaatatttagcagaaaacgatcagataaaaaacgattgcagtgaatacatatcacttaaaataagcccacaccacatccacaaaacaaaagcagaacacaaacatgctatttttgttctttgtaaaataattgcacaggtaataaacgaaaaagatgaaaattcaatacctgacaatgtgtgcaattcattaaccgaccttgttgaaaggtctcaaaactatataaaaatggcttaaatattagcccattttcttcttttttataaattcaaatatttttaatactattacttatcataaatactaattgattaaattctaattgtgattaatatgaaaagtattagtaaaatgctctgtttagttgacggagaacattaccttccagtcacccaggaatcaatcgatgttttaaataatttagaacatatcgacatagtagctgctgttttcattggaggaactgaaaaactaagagatgactctgaagaatcatattccaaggttttaggcgttcctgtacagtttgcaaaaaatgaagacattccatatgacattattgtagaaatgattaacagatatgatgtagatactgtgatggatttaagtgatgaacctatcctggattatcctaaacgatttaaaatagcctgtaaaacacttgcacaaggcgtaagctatcagggtcctgattttaaatttgatccagttacacaatatgaaataatggaaaaaccttcaataaaaataattggaactggaaaaagaataggaaaaactgctgtttcaggatttgtatccagactaattgataaaaacggatatgaaccatgtgtaatagctatgggaagaggcggacctcaagaaccggaaatagttcatggagaacagcttgaaataacacctgaatttttattagaacagtctgaaaaaggagttcatgcagcaagtgaccattgggaagatgctctaatgagcagaatcttaacaataggctgcagacgttgcggaggtggaatggcaggtgaagtctttttaaccaatatgaaaaaaggagcaaaactagctaatcaggtagattccaaatttgccatatttgaaggtagcggagctgcaattcctccaattaaaacaaataaaaatattgtacttattggtgcaaatcaaccattgaataatattatagactatttcggaccttacaggattggtcttggtgatttaattattttgacaatgtgcgaagaaccaatgtgcaatgaagaaaaaagagaatacattgaaaaattcataaaagagataaatccaaaagcaaaaataatttcaacagtattcagaccaaaaccattagccgacatttccggtaaaaaagtgctgtttgctacaactgctccaaaaagtattgaacatgaattagttgactatctggaaaccaattataactgtgaaatcgttggaacaacacctcacctatccaataggcctcttttgaaaaaggacatagaaaaatatatggatgaagcagatataatgctcactgaacttaaagctgctgctgttgatgtagctactaaagactcaataaaagctggtttggatgtagtatactgtgacaatatacctgtcccaataaattataaatatcctgatttatccaaatccgttttagaaatagttgacgaagctattgaagatttcaataaagattaatttctttattttttactttttttacaacaaaatttataacctctttaatacaatatattaatactaaaataattgaggaaatgaaatgaaaaaagataagaagaaacttatcgtcatgctgttaataattgttgttatcctacttttaacactaataacattaatgactaattttggaaaggaatccagtgaaataaatattataagcaaggatactttaaaaaatggagacacaatttcaattacactaaaagattcaaatggaaatcccatagctgatcaaaaagtagatataataattgaaaatgaaaagaatcaacaagtaacaactgatgaaatgggcaatggtgtgctgcaacttaacagaatcagtgacggacaatacactgtaaaagtcatttacaacgggaacgacaaatattccaaaagtgaaactacacaatcattaacaatatctgaccaagccacatcattaagtaataatgaaagtagttccagcgataaaactgaaagcataatgagtgaagacggatattcgtataaaactggatatggacctgattatgattgtttaggagttagtcgtgaagaagcagctgctaaaggatggcactatattccaggtatggatgatgaaggaaatgatatgggagcatatgttccatatgattataatgcaggatgttaccatacataaaaatttaagatttaaaaaaaaaataaagctcaggaattagaataatcctgagtcttttaatgcttgttcaaatttattagctacattatcaaatttttctttaatgataattgttacaagcaatgatgcaataatcatagctatcattgcataaacaccagtgaaaaatgttggccaataaacaccaagtaatgcatttctaagtaaacctatagcataagtcattggtaaatatggatttaatgcttggaaaaagtcattcatcacatatacaggataaataccatttgttgtagatatttgaagtaccaacataataatagccaatgctttaccaccattaccgaacagagataataatgaataaatcaataccatgaatgcaatggttattaaataaacacagccgatgaacagtccgggatcagaaacctcaattcctaaccagaatgcaccaattagggttactgttgattgcaataatcctattactaagaacaatcccattctaccgaagtaaagttctaatggtttgtataatgattcacctaagtatcttgctttaatcaatgcaactgaaattacacatccaacccatattgaaagtacaatgtaaaatggagatacttctgaaccgtaattatctacaggatttattttttcttttgtaacttcagttggagagtagaaatagttatctacaccacttgaattcatgtaggataattgtgataagcttgattgaggtgttgtttgacccattactgataattggttaaatgctacaccgtttacagtttgaataacctcatcatttattttactttgtatctgatttactgcattgttactcattcttgaagcaacagggtttgttttctcattgattaaatatgttaattgtgcttgttttgggttttgatcattgattgataataaatttgaggagaaattctcaggtattattatagctgcataatacgttccattttccaccccgtcccgggcatcatcctcgtctacaaaatcccatgcaaaatcatcattgtcttccaatttatcaattaccttatctccaaagttatatgaagcattgttatatgttgcgttttggtcattgtttactactgcaaaatccaaattatctgtatttccataaggatcccaacatgcatcaatatttaaaagtgcatataaggaaggtaaaataataattgctattattgtaataacaacagccggatttttaaagattgcttttgaatcttttttcattatatgaaatattttatctattgacattagttccaccgttttagttagttataccgttaataaatatatctaaaaaatcatcaagatacttattagtatcatcattggaaacttttgattcgaatttccagaatattatcccttcaacaattacactaaagacagttaatgcagctgcggaaggattgattttacgtatttttcctttatcaatctgttcttgaaaaatattggttagatttttaagaacttcatctgaaaattttgaaaatattttttcctcttcaggattggacatcagctcgtctaaagctattttaataatatccagattgttatctaaaaaattaacaagtttcccccatatatgctttaataatgattccaaatctgtatcttcgtaattaatgaaaatatcacttattttctccaggaaataatctgaataataaatcttagctatttttaaaagattatctttagatttaaactttctaaaaacagtaacttcactaacttcagcttttttagctatttttttagttgttgtgccgttcattccttctttatctaaaaggaatattgttgcatcaacaattttctgttctgttttatctagttcaatttccataatgtaagtaagtacttacttacatataaatgtttagttttttcttattaaaaaatagctataaataacattacaataaataattaaaattaatgataactatagctgttggagttggagaaaataaaaacatcttagaggcttgtgatatttttaaaacacaaaaaccaaatgtcaatattgaattaatcgaaaatgacaaaaaacttgccaaaagcatttcagacaaaaatatagatgcaacaatacggggttcactagctgcatccaatgttttaaaacaactaaaagaaagttatcccaaaatatcaagagcaacatatatccatgggaaaggtcatgaatttataataagctccgtcggcattgacgaaggaaacaccctaaaagaaaagctcaatatagctgttcactgcatagattttatgaaaaaacttaaaaaaactccgaaaatagctacactttcatatgcaagacccggagattacggcagaagcgaagaaatcaaccagtcactggatgatgccaaaaagctcacccaattaattgaaaagcatacaaatcagaaaattgaaaacagctgcgtattaattgaccaggctataaaaaacaaatgcaacatattaatagctccaaacggaattgtaggaaatactatttttagaacacttgttttattaaactcatggccaagctttggagcaataaccttcggcattgatgacatatacatcgacaccagccgtgaccaaagtagagaaggttatttgcgcagtttagaattggcatataaattggccaaactttaaaagcatcaaataatatatatttattaatagagaatcatttacttcaggtagttattatgggtgaaaattttatttataaaatatatgaatggtatatttccagaaatttagaaacctcaaaaatgcccaaacatgtagcaattatcatggacggcaacagacgctattctaagattcagggaaatatggatgttgtaaaaggacatgaaattggagtagacactctggaaaaagttttagactggacaatagaacttggaattgaaatagtaacagcatatgcattctcaacagaaaactttaacagaccggaacacgaagtggaaggactgatgaatttattcttcaaaaactttaaaagactggttgatcatgaaaaaatccataaaaacgaagtaaaagtcaaagtagtgggaagaatcgatttattgcctgacaatgtaaaagaagctattaacgatgcagaagaagcaactaaaaactataacaaaagacaacttaatttagctatcggatatgacggccgtttagaaatcgtagattcagttaaaaaaatcatcagagatattgaaaaaggattaataacagttgacgatgttgatgaagatttaataagtaaaaacctttatactgcaggattggacgaccccaatttaattatcagaacaagcggagaagaaagattaagcggattcctactctggcaatcatcatactctgaattatacttctgtgaaagtttatggccagaacttagaaaagtagatttcttaagagccatcagatcataccaagaaagagaacgtagatttggagtataaaaaatatgatagatacacactgccacatagattttgaagactataacaacgatagaacagacgtaattaaaagagcaaaagaaaagctggatgcagtaattaactccggaacaaatcttgaaggaaatcagactgttttaaatttatcaaaagaaaatgaaggatttatttatccgactttcggattccaccctgtaacttcacaggaatgtaccgctgaagaactgcacgaagctcaaaaacatttaattgacaatatcaatgatattgtagctattggtgaagtgggaatggactttttttacgtaaaagacaaatccctaagggcaagacaaaaagaaatattcaccagctttattgaaatagccaatgattataaagttcctttgcttatgcatgttcgcgactgcgagaaaaaagcattgaatctcatcaatgaatacgaagacctgccatatgcagtatttcactgctttagcggaagcctaaaaacagctaaaagaataatggagcatgacaactattacatgagcttttccacaatgctttgctactcacaaagacatcaggaactaataaaagacattccattggatcatgttctgactgaaacagacagtccctatttagccatgacaaaagaagaaagaaatgaacctgcaaatgttgttaaggcctgtgaaaaaatagctgaaattaaagaaatggatttgaacactgttgatgaaataacaaccaacaatgcgaaaagagtatttaacatctaatcttttaacaagagatttagattcaatacactaaatcctttatctacttctgtataaataaccaatgtaaatttatccaaatcttttaaaagagcatccaatttttcaaaaggaatatcaacagcatttaaataaacattaaaatctttttgagcgaatcttaccggttttctgcaaaacaatttaaattcataaagatacaattcaattctgtctcccaaatcttcaggatttccgtttccgtttaacagaaagtcaataatgtcttcctgcagaatcttaccttcattatccatatctatctgaagactttccatttccttcagctcatttaaaagctcatctttttcattctgactatacataaagattaattatttttaataatatttaaacccatactacattagctgttgtaaagacataattattggaaaataccggattgtacagtttatttgtagaatctgctgtattaaaactcatagctactgattttctcaaattataattaatcctatctccgattgaatccagttcttttttattataatcaacacttgcttttgcatagactttaaactgtattttttgctttccataattttcatctattcctgatgaattataactaacattcacaatacttacactgcaggggtgttttaagccttccctgtcatcatattcattaaatgtttccttcggatatattgcacttgatgatgatgcaacaccttcatcagcacctgattttgcagctgccattgctatgttaagttcattttcattagctatcatgaatattgaaatcattaaaacaactattaaagacccaaccagcaacatatattctccgctgagctggcctttttcatcattcatattatcacaatctccccatctcgattttcgattaaataactccgtccaccgtacaactcataatttctattaatatctgccggcaaaatagacacttcaccttttttatttgagtattcaattgttaatttgcttttttcaactgtaatcttatatgcatactctttttgaggcagcaaaacttttttggaaaacccttcaccatttgagttaacctgatttatacagttagccagattatccaaaatcaacctgtggctgaaacttgattcgatatttttatctgattccaaatttgactgtacataaaagagtattgatgcaactatcaataatattataaaaatagaaaaaatggcttctagtgatataactccttttttatccatattttttaattatcctgataattaataaactttgtttaaattaaagtgaaatattgatgttaaattcttttttactttcataattattaaatagaagttaaatcaaaaaattgtattatgaaaggtaaagtaatctttattggagcaggtcccggtgacccggatttagtaactgtcaaaggaagaaatgttattgaaaaagcagatgttattgtttatgcaggatctttagttaataaagaagttttaaatccaagaaaagaagattgtgttgtttacaacagcgctgtattgaatttagaggaaacaactgaaatttgccgcgaagcaacttccaaaggacagttagtagctagagtccatactggagacccttccatttatggagctatcggtgagcaaatcagagagttgcaaaaatatgatattgaatatgatattattccgggagtaagttcattatttggtacagccagcgtacttgaaacagaattgacattacctgaaatttcacaaacagttattattacacgtcccgaaggcaggactcccaaaccacgtagtgaaagcatttccagcttatccaaacaccaggcaactatgtgtatctttttgggaattggtatgattgataaagttgttgatgaattgctggtcggatatagtgaggatactcctatagcagttgtaaaaaaagcaacttgggatgaccaggaaataattagaggaaccttaaagaatattgcacaaaaagtaaaagatgctaatataacaaagactgcaatgattgtagttggagatgtgttaaaccctggagatttcacaccatctaagctatatgatccaaactttaaacatgaatatagataatttttaactatattcatcttttatactgttcattaatttaagcttattgaaagctacatccttagtagctcttcttaacccacagtcagggtctaaaatcatattatcttttccaagaatttcaacacctttagctatcaggccttcaattttttcttttgaatcaacttcatttatggaagtgtcaagacagccaaagcctatttttttattcctgattaaagatgagttttcttctaaaattttaatgttaatgtcgtttcctgcaaattcacagtccaaaatatcaatattgaatttaatcaaatctttgaaaacattatccaaattaccgcaaacatgcatagctaatggaacactaagattttcaccaattatatcaatagctttactggctactttcaaatcaaccagaccagtagataaaaacggttcatcaacttgaatataaaccggattaatctttttttcaatagcttcaacttcatgtttaagacttctggccaaatccaaaattgcatcttccttatgtttatagaaagactcaattcttgatgaataaacaattgtggaaggaccagttatgattcccttaattcctttaccttcaggaatatttccattaaaataatcattcatgacttttttagcatattttaaatcatcaatggaaatttcttttgtaggctgtctgattttagaagtgataacagtattattgtcttccaactgcattcccggaataaaattagtaaaagtagaaaccatatctccacgaacctgaccatcagaaataatgtcaactccagcatcaagttgtgagattacagtttgttttatagactccttaaaaggatcataagctccaaatacatttaatattttatcttttgcagtagttggagattttatttcagcaggaaaactgccaacaacagtagaaatcataaactcatctatttgatatttaatgttcttattttttcaatctcggccatgtcaaccggcaactctacaactgcagtaccataacatggtttggtatatggaataagtacagttcctttttttgaatcaacaccaataggaatcggagttataccaataacacgagatcctaaaatttcttctccagcattgacataaacgatttctggagctttaaatctgataagtctggcacaatctttaaagcctgcctgtgatgccaaaatttcataattatcagactgctgaagataagtatctaaacaaaaagacattttattataactccttcaatactttatctaggttaactttaattggatttggattatgaaatgctcttacagaaataacttctgcatcagtattttcactgacaatttcagtatattcctttaacaactcagaatccttttcaaatacaagtgcaatagatttggtttgtagaagctgatagaaagttacaaaataggatgctgctgcatctttatgtacaaatcctaacaacaaatcatattccccttcctgaacattagctaagcagtcgtccaagtcaaccatttcctgaatataatatttttccggatcagaaactttaactaatttggaagctgcaggattggcagcaattgtcacatcataacctttttcagataatttataagacgcataaattgacataggtgtttgtgatggggtttccggacatcccaataatattaatgctttcatctcttttcaacctctttaaatattcttattagttcttgatttaagtgtaacaacattagccaatatcaatgctcccaaaaagataaatgaaagcaacgctaatccgttaatagatctgttaaatataaacataccgattaatgcctgtgcaataaatgcagttaatgcacctgtcaataacacttccctacctaagtatttcttattattattttctcttttttccctatacatggtcaatatttttaaaccaattatgatagttcctaaaacaaaaactattaaaccgacaagacctaaataaccaaagtcaaatccatatccgaaaatacctggaagcatataatcgattgtatctttctgatttacaagcactccgcagaacaatgggaatggcaaaccaaagaatatgattaattgcatcggcagggtaatatatccttcagcaaatgctgttccttcagtaccccagaaagaagcagcaccattatgtccgattagctggatgttatttaataccattttaatactggatgaagagtactgttcaattcttcctaaccttaacaatggagagaaaatagtcattccagttattctagctactatttcaagtccgaaaaaacctgcaagagctgctccgaaaaacattaaaatccttttaagtgtaaatactgatttttctctgaaagatttggaaattatgatgtatccaataaacaaacctaatatccataatattaagaaagatctgtgcattaatccaccgaaaatggtaatacctgcaaggaacaataaaacaacttttctaagaggtcgtacatccactcccgaactcttcatcaccttcagcgatgcaaatgcagaaacaatagccattaaagcaattggcccaaatggatgtgtaaattcattctgactagatgaaattattagtaaaagaatatctgctccaaaaagaagtgtgaacccaccagctaaaaagagagataaaaacgttacaacactaagtgacaatggaattaaattaagacaaaagactaatgtaacaaataacattgcccctacttctaagattagttgtaaatgattctgagctattaacatcataatttaatcacaattttaaattttatttttttgaaaatttataaatggactgaccgggatttgaacccggggcctccgccatgccaaggcgacgatctaccatctgagctaccagcccataataataaaaactaaatataatatataatatttagttgtttttaatataaaactatttaccttcattacccaaatcataaatattatctatgataatttggaataaatcatcagttttgaaatcaattttttcatgaggattaacaataaaagccaaagctttctgtataacttcatctatatcattggatctaaacattaaaccctgatcgatataatactgatctacagctaatgttttacctggataacatgaaataacaggagtctgcaatatggctgcttccctattcatagttccccctgctccaattaccaaatccgcttttttcattaagcttgaagtatcgacaggaggctctaaaatagtaacattatcaatgccttcaaagatttctgcctgtgctttgaatcttggcaatatcaatatattagcatattcttttaatacatcaacaattggagataaaactgatttatgacaatctgcatctaaataagatgctaaagatggttcaggtctcatcaaaatagtttttggatatttcaatttaaggtccagatcatcaaaaatattgtcgttatattcaaagctcttaaaatgcatcaattcagaagttccgttatatggaatgatactgttagggtctgctccaaattgcattaatttccagatatcaattttatttggtgtgataattctgttacataacgggagagttaatttatttgcagctaatgcatgttcattatccaaaacatacaaacttggaattcccaaaccaaatgctattcttggaagttcaatagaatgcttgctaagtgcaacatccaccttttcatcattaataacatctacaagttcataaacacgtgaagtactttctttaagcttatcatataaacttactccatgttttccaacagaaataaagtctatatcatacatattcatcagtttatgaatatctccaaagtctctggctgtaattattaaatcttctccttcagattccaaatatttaatgacatctttaaaaaaccttacatgaggtgcatttgaaatatcaatccatattttcaatgaaaccaccttaactatctttttgtttattaatagctgagatgatttctgataaaccttcaccctgttttaaactagctttaataacttgaacatctggatttaaacgttttgcatcattaaccatcttatcagcatctgcaccaacagcatcagctaaatccactttattaataacaactaaatcagaagtttggaaaatcaatgggtgtttttctacagtatcatcaccttcagtaacacttacaacaacaattctcatgtgagaacctaagtcaaaatcaacaggacagattaaattacctacattttcaataataaccatgtccaaatcgtctaacggtaaatctccaagtccatgacctaccaaatgagcatctaaatggcattctttacctgtgtttaaaccaactactggagcattatgtttttctattctgcctgcgtcaaatttactaattacatctcctgcaattacacctattttatcatcagtattttcaataatgttttcaattaatgtagttttaccggaaccaatagctccaacaaaatcaacacagaaaatgtttttttcttcaagattttctttatttctatttgctaatcttttattagcatccatgatatttttttgtacttctacatcagctacattatgcataatcaattcctcctatctaatcatcatcaggtttctcaataacaatatttttaacaacacaatcttttccgtttaaaatagatattcttttatttccacatttcggacattctacaattggagcatagtgatctttatcatccagttctgctactcctttaaatccgcattcaggacaattaatttcaacaggtatctcttcaattttaatatcggcatcttcaactatggtattttcaactaaaacgcttaacatgaaacgtaactgttcagggtttatcatagccaatctgccaatttcaataccaacttcagtaacttcagttgcattgttactttctgcagtatctattactgcatttattattccttgagccatagataattcatgcattttatttctcctacatattcagaaaaaaatcttaatattataattatagttaggatgattaataaatattgttaattaatgtgaaaatcagcaaaatttatgttttaaaaaaaataagttttataaaaaaaaataatggataaaaattaatttatcccatattataagcatcgtatgcagcatatacagcatatattaagtaaataatattaccaatggtacctaatgcgtaagctaaaataattgaaataacaattgctgcaacaaacattattatacctttctgggtttcaccttgtactacttgaccaataccagggaagaagaaagaaataatagctgctactattggactaaccattaatacccctcaataattcaattaaaaaatcaatacaaaatatcgtattatgttatatagactctttcaaaaactttgttgattttcaaaatcctttttgcgattgtcattccaaattagatctctgcgatatattcgttttaaaacgccccgtttggtcttgaatgttcgttttctggattttggcattgttttttgaaatgcattttcaattttgttacttgttttttcaattcgtttatcttttaagtgacgaatgaagcttttatatcgtggcctgattgattttttgattattttataaataactggatgaaattcttctttgcgatgaattaaagatgttacttcttttttgaattcatcgtaatcatttaaatcgaataaatctttgattattttcagttgtttgtgacattcttgatattcttcatcagaaatgcgatttttgtctttaaaagtttttaattgtttatttaaactttttttagtatgaaaaatacataattgatgtttaaaacctagttttgggataattgaagcatattttttatctaaatctgtggtaattgcaattttatttttatttaccgttgattctcttaaaaacttctcaacagtgttttcatcttcagtatcgtaaattgcatcggctacgatacaatttgaaatagaatcaagtaatatgtgtcgatatttccattctccgttgatttttatccattctacatcgaagacataataacccgagcaacgtcctaaatcaaattctaaaatgttttcattaacaaaaagccaattttcaattgtttgatgtaaaacagtgattccaaagaattttttaaaagatttacaaacatttttcaagcttcccaaataatctgaaatcaaatgttcagattcacttttcaattcatttgtaaaattactgtttttatcaacaagacttgttaaatcagtttgaaaggttttactgcatcgtttacaaatataacgctgaaccttcactttagttttaccaatttctttaaataccaatgttctttttgtaaaaccatatttaacaacatgacgagttccacaatgtggacatcaatctaaactcattttaaaataaggaacatccttcttaaaacttaaatcaaaagattttaaaactttttgacaggatttaaaaattttcacaaaacgaggatctgaaaggactaatccatcatttgaatcgcaaaatatatattgtttaacatctaaaatactatttggagtaaattttttttgatttggcatgataaaaacttttactccacctatttattaaatttaactatttttaagcaaaatcaaaaattcacaactaattttcatgaaaaaatttcaaatcaacaaagtttttgaaagagtcgttatatattaacattgaaaatatttaaagtttcctactgtatttccatttaatattcaaaaaaaatgtaataggttaaacgaagaaaaataaaataaattattttaattctaaccataattcattagcatcttcgttggcagagtcaatttttagagccctttttgtaaacattttggctccatttctgtcaccctgttcatataatattctaccaaataaagcccatgcatcagcatattcatcatcaatttcaaccagctcatttaatgattcttttgagttgaaataatctccttgtgaatataaatcataagcttcttcatataatgtttcaagagttatatcattagtagaaatctcttcaatttcattttcctcaactttttcaatagctgtttcttcaggattttgtgaaatcagattgcacatataatttaaaatatattcagttgcttttttgtgaagtggcttattatcatttccgcatttcggagaataaatacatgaagggcatccgtcatgacagctacaatttttaagcaaatctcttgtagattttaacaaatcaacaaatacatcaacagctttttgtgttattccaattccaccttcataagcatcataaatgaatattgtagcttcctgagtgtcttcatgataatttgtagataatcctccaatgtcaaatctgtcacacattacatgaagcggaaacaaacctattaatgcatgttccgcaccgtgaagtccaccttcaaagacttcctcttcacctttatataaatcttcaagattatttttaacttcacgtggaactgtaaaccataatccttttgttctgaattttaaaggtggcaaatctaaattaaactgtccgattacttttgaaaaatgcattttcttatatctgtaatagtcttcctctacagttaattcaccgaaatggatttttaaattgccgtattttgttttggataattttttctcaatattgatatgtaccttatttaaaaccatggtatgataatctacagtgtttttagaaacatttacaaaatgactggctaaattaacactgtctacctgatatgtttcacctttattaattaaaatagctccttcatgtgcttccctataaacctgtgagcgttccataacctctaaaagtttaccattattcattactctgaattcatcattggataactgatcaagagaatgtgacattgcaggattgtcatcatatgggtaaatataatctccacggggattttgatataaatcctttttagaaaccaatttgcccaagacttctttatccactccaaaataatccatagcttcatcttttttaagagttaattctttagcggcacacaataaatgggcttcctgcaatatatggtttgacaaatcaattattacattttcatgaggtttatcaaaaaagaaatcaggattattcataaaatactgatctagctgattttcaaaggcaaccaaaatagctaatgatttctgattgcttctgcctgcccttccgctttgctgccatgtggaaatcatagttccgggatatcctgaaataataactgcatcaagtgaacctatattgatacctaattccaaagcatttgtacatgtaactccaagatatttacgtgatttcaatccgtcctcaatttcacgtctttcatctgcctgataacctgccctatatgcagttattctgtgggtcaattttttcttaatattatccatgtcttttttagcccacatagctattaattcagttattttacgtgaaacagtaaaacataatgtttgaatgtcttttaacatcaggtaaacaaatatattttctgtttcaatgtgtacagaaggtgcctcttcactgttgtgtttttttcttctgtaatttctgaatggattgtacaatataaaatctttttctccgcttggagatgtatcattatccactaatctgaacttctcacctgttaatctgttagccagttccaatggattggccaatgttgcagaagataatataaactgaggatttgctccgtagaaattagctattctttttagtcttcgaataagataagccacatttgagccgaaaatacccttataataatgggattcatcaatgacaatgaatttcagattgctgtaaaaacgtttccactggtgatgccaggacagaataagatgcagctgatagggatttgttagaataatccttgatttttgacgaatatcatatcttttggattttggagtatccccgtcatatgtattaggattaattttaatgtccagggatttttcaagattttccaaaacatggagctgatcgtttgagagagcctttgcagggtaaatatataatgctgtggcatcttcatcttcaatcattgtttccataatcggcaaattgaaagccaatgttttacctgaagctgtaggtgttgtaatgattacattttcatcattttgaatggcctcataagtttctgattgatgtttatataatttagcattttttgactttaaataatcaacaattttaggatttaaattatcaacttttttatagctagcttttctggcaggaatagtttctacatgagctattctgtccctgtacctcacatcatttttaaacatatcaattgttgatttggtcataataatcttgaaaaaaagttatccattaataaataatatatgaataaattaaatatttaaattattcgtgtaaatgatacttatcaaatgctctgtagagtattttatatagttaacatatataaataataaataattaacaaaatgaggacaacaatgattagttacgaagaatttgaagatattgttgtaaacacactgaaaaggaacatttcttcaaatgaagatcaaaaaaaagccatttcatctcatgcaaatgaatctcttttcatagtagcaggaccaggatccggaaaaactactgtaattgtacttaaaatacttaaatatatttttgttgatgatattgctccagatgaaattttagcaactacttttactagaaaagcagcaaatgaactgcattcacgtattttaagctggggagatcaaattaaaaactatcttttagacaacattgttgaagatgatcctgttaaagaaatggaattaatggatttcattgaaaaaaagatagatttaaacaaaatcaatattggaactactgacagtgtagctgaagatttactgagaattcatagagagcctggaacgaatcagccattggtaattgaagatttcgttacaaagtctgctatgacaaatattcttcttaaagacaatatatacttaaatgaaaatttaaaggaatatcttaaaagctttacacctaaagaaaaactggaagaaccttcaaaaatggcagaaatcattctaaatatgaaaaacagaatgtactatgaccaggtgaattttgatgaaatctatgataaatttgaagaaggcagcggagccaaattaactctcaactgtataaaagattacgaagatgaattgaaaaaaagaaatattatagatttcccaatgcttgaatttaaatttctaaataaacttaaaaatcataaattggacatttttttagacaacataaaaatcattttaattgatgaatatcaggacaccaatctgattcaggaagatatctattttacaatagccgaatacggtctaaaaaataacggcagcataactgttgtaggtgacgatgaccagtccctttatcgttttagaggagctactgtagacttatttacaaatttcaaaaaacgtgcacatgacaggttgggaattaatgttgaagaaattaatttaaaaaccaactacagatccagtgaaaatattatcaatcactgcaaccattttgtagaactggataaagaatatcaaaaagccagagtagatgaaaaacctaaaatcattgctcccgattttgacaaagataaaatgcccgttttaggaatgttcagaaataaccctcaaatgttagccagagatttaaccctgttaattaataatctcataaacaatggagaagcctctctaaaaatcagaagaatattgaataaagattattatgacacattaaatggcaattccaacttacaatccattaataaacaaaaacagaataatgctaaaaaaagcaaaaatttagaaaaaattacattaaaattagatgaagaatacggctctgcatcagacatagctattttatcatattctcctaaagaaatgaaaggaagcaatcccacatttaatttttacttaaggaaaaatcttaaaaaactgaaaaaacctattgaagtttttaatccaaaaggaagagacctgcaggatgtaaaacaagttgaaatattttgcggattaattctagaatgcattgatcctcaaggaataatccaaaaatccgataagcaaatccagaatttagctgacagaaatatgaaccgttggagataccgggcaatagaccacattaaatcaaaacctgaaccaaacgaacctgtttcattatctgaatttgtgatttcatggcaaaaccgccaccctaaaaaccgtgacaaatggccagaaagtgcaagtttaatggaattagcatataaattgattacatggattgaagaacttcaggatgatgttgaaggaattgtatacttagaagctattacaaggtcaattaaacaaacgggatttttcaataaatattctggaaatattgtatttaccaattcaaaaaccgaaagggaatctgttcttgaagctatatggaatattttcattccaatagctaccggaggggttggaattgatgaagatcttcttgaaacactgcctgatgacagaataaacataatgtctattcatcaatctaaaggattggagtttcctttagtaattgttgatgtaggcagcagatttaaaaagaacacagtaaatactcaaaatttaagatttccgaaactggaacctaaaaacagaagcatagaagatagtgtgcgttgtttcagttctcttggagaatcagaaagaagtgaaaaggacagatcatttgatgatttaacaagactttatttcgttgcattttccagagctgaaaatgttttacttcttattggattattgccgtcacttgacggatatgcagttaacaataaccttaaacaaattcctaatgttgcccttggctggaacagagatgaacaattagtcggatttgatgaaatatatttaatatgaaaaaggagacttaaaaaatgaaattatcttcaagatctaaagcatatatgattccggaatatagtttaactggagatttgctctcctttttaacctgtaatttacagtacagatatcaaaataaaggtactcttcctccgtcaatgcctatccaattatggtttggagaatttatacacggagtaatggaagaagcttacctgcagtgggaactgaataaaacaccgtttccatgggactggaaaaaagatatcagacctattgaaaatatgattgatgcaaggctgcaggtaagagggctttatcctccgaaagaacatttcttttcaacaaatcatccaagtaatgaaaatgttgatgtcaatgaaagagaccataaaaaattagccagcgcaagagccgaaagagctattaattactggggtcctcatttattcccgctgattgattctgcagaattgctgataaaaggaatcagaaatatgccccattacgataaaaacactagccgttccaattattatggaattaatggtgttattgatgttttaagctcattgaaaattaatgaaacaattgaaaataccagacaaaccacattggattcctacagaaataaaatcattgaatatttaaaaaatgacaaagagttccaggaacatataaacagcattgatggtgatgaatacgaagtaatcattgattataagggaatgagaagaccttcaaatcaaaaggaagatgatgaaacatggattcgccacaaatggcaaattttaacatatgcctggcttagacgtcagcaggcagatgccaaaccaattgttgcaggaattattttctatttaaatgaacttgttccgtcaaaagaagatctgattgttgttcagcaggatattcacaataacctgacggacattccaaaagagggtgaatttaaaaaagatgttgcattaattgaaaactgggatgaagacgccaaggttccggaattaagttcagaatttaaaacagcaagatcaatcagaataattaatattaacaatgaggaaattgaaaaagctttaaatgaattcgacaatgttgtgaataatattgaatcatctttaattaaagaaatcaaaggctgtaaaattcaagacgcatggaaagcacagggagatgaaagaacctgtgatgcatgtgatttcaaaacattctgtaaaaataaaaaaacaaaaccaaaagaatttactattccttaaaataatatataaataagtgatattatgagtagtttagaaaccaatcaagagtatagtaagatacttgaagacaatgttaaattaacctgtaaagctgtagctgttaaattattagccagtgaagaagagcttcctgaaggctatgatttaatagatgaaaaagtcagacattgtgaaatgattagaaaagcatcatatggagaaaaattttacagtaccattgaacagcaatcctgtttaggcggagctggagctatcggtcttagagatatgcctcctaaattagctagtggagaaaaatattttgaattaggaagatttaaagatttaaaaacagcaaaagcagctactgaaaaactttcaataatcaaagaaagatactggggaattgtttattcacctttagatgaagctacttttaaacctgatgtagttttaataattacagaacctgttggtggaatgaaattagctcaaactattgtttattcttccggagataaagtaagacctaattttgcaggtatccaatccctttgtggtgacgctttagctaatccatttataactggaggagttaattttactttaggctgtgacggttccagaaatgctgccgatattaaagataatgaaatgaccattggaattagtggtgaaaaattagaagaagttatttcaaacctacaagctatctaataactttaaataatcatcataatgatttatatttaataattccagctcatttttttcttttattccataaaaagtgtaaccatcaccaaatatttttcttaaaatcggatttaaattatcgttttcattttctaaatattttatcatattatccttaaatactacaaaaggcattcccaatccttcagcagtgtctagcaaacctgtttttctacgtcttaaaacagctattgttttttcaggattatctgaatttttacaaacattaatcatttcattaaatgtttcacttgatactgtcggctggtctccagttatgcaaagtgcaaaatcagaactgatattttttaaaccatttaaaagagatactgataaacctacatcaacaggattattttctataaactttacagaatctttataattatcaaaaacaacctcttttatttcatcactgtaatgacctaatacaacaatacattcatctacatttgaggataatgcattatcaatagttgtctctaaaacacttttattttgaaacggaagaacaagtttgttttttactgaaatatttcgggaaatctgatcctttctcatacgggaatttttacctgcagcggtaataatagctgaaactgtcataataaacactaaaaaaaaagtaaagtaaaagataaataattatcttcaacttggaatgaatctttctatcttaccataaattgccatgcctgtacctgaaccttcagtccacattactattttgactggataatcatgattatttgtaactttaatatcttcagaaggattaaatccaaataatactgcatcattatctccacacatacctaccggcaatccaaatccttcagcaagaacagctgctcttaatactctagctggtggacatacaccatgagaagcactgcctccaggagcattactatcagaagcagaaccaaaatcaatatatgcttttccatttccacttgaatttggtggaattactgtattattccatgcatctacaaaagatcttgcattaaattctcttactccgtctccatattcagggtgagaacctaaagaagtagaataaacttcaccatcttcttctgtaacattacccatatacaatacaataggagtgccgtcaggatatgctgccacataatcggacacattatcaccaaatatgatggacacattacccgcacttatattgtttcttccgtcagaaaagttaacaattccgcgttccagtgtgaagttagatttgtcggaatcataattataccaattttgaatagttgtagtattgtaatacttgcctccaaaatcagtatttttaatttctgaagtaggaattgattcaacaacagtaccattttccacaacatcaacaccatcagatgttttggttaaaatcttataaggtgcactgtaaccccatacataagtatgcggagctttaacagctaattgattaccttcataagtcaaataaccaggaccttcaaatccctgtgccttaccataagaatctataccttcagtggatattgtagtaaagtcaaatggaacagttccagttgttaaagttattagtataccctgcaaatcaagacttttaatctgatgagccataaaaggcaaattacctaacaaaggtaattgaattgattgattttcacctaaaatggaatccccttcaaacatagactgaccaataggcaaattataatcctttgcaaaagattcaccagtgtatgcagtatgatttacaaaagaaaatgcgaataaaagtaaagaaataaagaataatgccaatattatcttaatagatgtacttctccattcataactcatattatttaacaccttcaataataatataacaatagtatatttagttactattatatttatatatttttattctaatgaatacaaactaaaggttttcagacaagagccttattctttcttgaatctcaataatagcttcctgaccgttgcctccaatgaaaagtgcatcttcatgagaaaattcagcgataagagcaattatttcatctaatgagttagctacctcaattctaccctcataaccaagtctgtttaaacgataaagtcccatatcaacagtatcatctaatcccggaaacagaacaataacttcaggattatatttaaccgcttcatccaaaatacttaatctatgttcttcattagcccttggagtacctataaataaagcatagaaatcattctcatttaaaactgaagttaatgcatctgaattatcagttttacctacaaaaattgaagcattattaattttataaacattcattcttccttcaactgctttaaaatcagctaaagatcccatgataatgtccttaggtattttaagctcagtagctatagctgcaaccaaaccagcatttaatgcattgaatctgccccaaacttgcaatttttcatcatattcaaagaaaggaatagctttactggccacttctttaaaatcagcattgaaatcctgattaaaagctgtaaaagccgttttgccttcaaagaatcttaccaaagtatttttataattggctattgtcttatgaacatccatatgatcattgccaatattggtaaggcccaccatatcgaaatcaaagcaataattgcaaaaatcaagtgtcatatcacaaacttcaacaagtaaaatatcataatcatcatttgacgcttctaaaattaaatcatagtaacctgaaaagcctccaccaccatttccgccaactaaaacttttttgcccgcattttccaaaatactttttaacatatggacacttgtagttttaccgttagttcctgtaatgccaatagtaaaaatgtctttatgtttagttacaacattgcttaacagtttgcctttttcaagcaatttatctgcaaaagctcctccgtacatactgggactaatagctattgcatcacattcttcaattgcacttgaatttgaaaaacctaaatcaacagttaaattatcagaaacaatggaaacagtttcaccaccactgaccaaattcattgaaatcataggcaattccaaatctgataaatcaacattactatttaaatcagtggcataaacctcccaaccatgacttaaaagagaattgactgccttttttccttccacacctaaacctataactgctgctttcataaaaaaaatacctttatattttataacagtataaactattgttattcaagtataaatattataacattcataactcatttaaaaggtgaaataatgtttgaagaggaaaatgacaataaaatatatcgtcttatcatcactaacggctatgacaaaaacagagaatatgcaaaatttaccgagcaaatatattctaaaactgattttttatggaaagaatccatttccgggtcttattcaacagccaataaagaattttttgaaaaaatagatgttataatcctcttagcaggtttgtataacaataataaggaaaattttaatgatttaattgaagctagtaaaaactttgatattccaatagttcttgtaagacctcacggacttgaagaagttcctgaaagtttagaaaaagaagcatcaacaattgtaggatggaatgcaaactgtattgtagatgcaataaaaaatgctgaggaaatgggcagaatctaaatcccaacattaatcacttaaaaaaaaataaaaagtatctaattagatacttttgaaataccattatttttttctactttaaccaaattatctgcagcattttcaagctggctttcatgagttacaataatcatttgcggtaaaacagtcatatcttttaacaaattaattagctcatgtcttctaaagctgtctaaatgtattgtaggctcgtctaaaagaatagtttccaaatcaccttttgccttagccttagtaatacctaatcttaaagcaagagcaatagctattttttcaccaccacttaccatactcattgaagcttcaccttcaggaccgaatacagttacttcatagtcctcatccaatgttaaatcagaataattaaagttaaattcatcaaagaagtctttagtgtatttctgaattaccggccttgaacggttcctcaattctttttgtataccatttttagaatacaatgttctgatatgatttaataaatcaatataatcagtagtgtttttgtattcctgctggaatttatagttagttaatattttttctgccaaaacattaacattagctattaattctttagcctgacctttaatttctgaaagctcacctgcaaattcatcatatcttctttcatagacttcatagaagtagattactttttcgtatttttctttatcataaacagaagcttctattttatttttcaggatttcaatctgatttaatgaaacaccaatatcatcttttttagagattaattgagattcaagagcctttttattttgaacaaaacctttaagctgattaaattcttcttctttattttttaaatcagtaatacgtgcctgcaaatcagcagtactcatatccccacttaaatgagggtcctgatcaatagctaatttaatgtttttaacatggacatcaacttcattattaacctgatttaacttatattgaagttcagttttactgcttaaaacatcaagagctccttttgattttatgtatgcatcataatcctctttattttcttcacgtccaactttctctttagagatatccaatataagttcgcctaatttagtattggtgtactctttagattccagtccgtcatcaatttcattaagcctaaccagatctttttctaaattatcaaatttgtttttatatcctatgatatctttagataattcctggagtctgttgtatttttcttcaaaactatctttatttttatttaaaagacggatattttccttattttcctcaatagatttttcattaatcttaatttcattattataagaatcaatcaattcatttttcttttgaggattgatatccgactgacagacaggacatttattttcaacatctcccaattcatctaaaggtttttgtgctgtttcaatagcctgtttaaatttgacaatttcctcatttttagaaataatctcaagacttaaatccttaactttattggaaacttcttcactaaagttgtcagtaacctcttccaactgagtgaaattatcaacatctgtcagaatatcctgagacaaaccgttatcatacagattatccttagttacagaaaagaacctttcaatttcatttctatttccttcaattgatttgagaagttgctttttatctttttcaagctgggtaagagtagccaattctttttccagattgattttttgattgtttaatttttcaatctgctcatcagctgctaaaaatttattatatccctcttttttagttgctaaaagttcttcctgtgttgcaattgaatccaaatctttttcaattttttgtttatcaagctctaactgttgaatgcttgtaacagacttttcaaagtcaagatacaggggcaatttcttaacaaatttttccaatcttgcaatttgctcttcagctttttttatttcatccaaattatcttgaagtgttcttttatcattttcaagagactccaatctttttttctcagcatccaaattgttattgaagttatcaaagatttccttttccctttccatattggttttttcattttgcttttcagctttcatctctttgacttcttcaatttgtttttctaaatcaagtcctttttctttaagactgcctaacaatgcttttttatgatcatattcctcttttaattcttcagatgaaaataacttacctttaagttctgactgggttttttcatagttgctgataattggctgcaagtttttccatgctttttcaagggaatccaaacctaataattttccgattaactgctttttctcagatgaggttttatcaactagttctgcaatttccccctgtcttatgtatattgcatttaaaaacaaatcagaatcaatatccaaaatagattggatttcattagctacctctttatctccagcacatgatgggataaattggcctttagaagtagtttttttaagaagtgttgatttcaaacctgatttggttttttcacgatgaattttatattctttaccattggaaacaaattccaaatcaacatacatattttcatcactgccatttcttaccagatcatcaatttttttagcagtatgctgtttaaataatgcgaaactaatagcttctaaaatagtagattttccagcaccattttcccctacaataactgtaatcccatcaccaaacttaataacttcatgaccataggatttgaaattgtttaatgttaattttgtaaaaatcattgaatagccccactaaatcttacctgaccgtcttcagctttgttttcagttatttcctcaccggaatcatcacgtataatattgtatttttcattgaaaaactgcctaatcaagtcctcagattcctctgttttattttttgaaagcaaatcatataattcaacagctaaattattaacgtcttcactgtcatattcctttaattcatcgattaaaagctctttaggacgtaaagcattttcatcattaattatggcatcaacatccacttccctatcaagtacattgaatgtaggtctaatcattaatgccaaatcaccaagttccctattaatgaattcatagatttcacctaggtttgaatctatattgttaattttaagatttaaaataggccgtttatcaaaatcttttattgtatttttaatggaatctatttcagcgcctaaatttctataatcaattgtttttacaataaattcacggggaatatccatagcaactcttttaacattcattttcggtccgtctaaatcaactacaataaaacctttaccattctttttaaggtctattaactcactaacattccaggtttcagttgaacctggataaacgagttttccattaccaaaatcatcacagatataattatgaatgtggcctaatgcataataatcaaaattatcgggaatatcaccaatttccaattcatactgtagattaaaatatttgtcaattccctgatgtaaaacaagaatagatttttcgtgattttctgcttttttagataattcatctaatttgcttttaagatttttgttttgggaagcaggataaaaaggcagtcctgcaataaaaacatcatcatgcatataatttgtattaatagggcttattaactttaaaccaaattttttaaataaaacttgaggaggtatagctccgttacggtttacaatatcatgatttcctgcaattgcatacattggtattcctgcacctttcagtttaagcaaacctttttgaaaagctaaaagagcacttggtgacggtcttgctgaatcaaataaatctccactatgtattacaaaatcgaccttttcttcgattattttatctataattttatcaaatacttcataaaagtctttttcccgttcaagcaatccgaactgtctataacctaaatgagtatctgccaaatgtgcaaatttcattatattaccttttaaaatttttatataaccaataaacactctaaaattaaagcatttaacaattaattatatagttaataatatatttaatactatggtagcattagaaaagtaatatggaaaaaggaatcaatagtcataacctaaattaaaactgtcttcttcctgttttttgatttcttcagcttcatcttctttaaaattagctaatatagacacaacatccaagtctccaccatgtctgcggcctttaaattcatcaattttaaccagtgttggaacatttgtcataagtcctgttaaaatagcttcaccgacatttagagaaggtaactgctttaccaaatctccagacaggctttcactagctgactgtacatgtctttggtcttcaggttccaccaatcttaaaataatcatgttattcatctgggacaatgcgtcatggtccactgtctttggagattgacttaccaaacataaccctaaaccaaatttacgtccttccctggctactctttgaatccagaatttagagtttgaatcccttttgttaggagctaaaatatgtgcttcttcaagaatataaaataccggaaaatcaagtgttttattgcttgtcttatgaactgcgtttttcctatactgaagggaatttctcataatgtgacttacaagaacttcagcaattgattcatcagcctgacttaaatccaaaacattagctttgcctatctgaatagttcctaaaatattacccttatttatattgaaaagattatcatatttttcccttaaatcttcaaccttattcataacatccataattttatttttctcgttggagctgcgtgtttcatcattgtaccatccttctaaaattacaaatataatttctaaaaagtctctggagctagatccgccactgcttataacctcacgggcttccttaaatgcttttctgaagtatctttcctgaatgtgggctgaacctttaatattagctaaatttttaatttctgaaaaggacatatatattggatttattacaggttcaataacgtttacttcaccatttgtaaatgtggcatccacatattccccatgcatatcaaaaacaaaaacaggagcattatattttaataatccgtcaattaaaacagatactgtatttgatttacctgctccagtcatagctaaaatagctaaatgcctgttcataatagagtttacatcaacattaacttcaacatcactctggttaactaatgttcctaatttaaggggattttttaaattaaagactttttttagaatttcatcatcggcttttgttataggtgttccaggaggtgctgggattcttggcagctttaaattatcctctacatcaccaagtaaacgaacttttcctttaacatacaaatcatttccgctgacctgagttattgtttcaatgtcatccacatcatatatttcactatttaatgctacattacctctaaccaagttttcaatcattcccaatacattttttccatcatatctaatagaaacatattctccaacctgaggcattgaatttgaaataaaatctacttccaataatgaaatttcccctatacatcttcctataatcataaatatcacatctttaatttataacatttccctgccggatttttcacgaactttagctatattaataagctcttttatgtttttatctgaaataaccacatcattatgtgcttttttaagcagatatggatatccatttgttgaaaactttttaagtttggtggcaatttcctcaatttctgccatagaagcctcataaggcagttccactttcaatacatttttataatcagctaatcttaaataaaaaattgtaaatttcaaatctttaaaaaattcatcaaaaaccggaaaagtggtgttgatgtcttttgatacttttttacgaattacctttgaaataccttccttttgagtgtatttatcaaaaatagctatatccggcatattactatgaaaaatatcattatttgaagaacttttagaaatagctatcatttttctggaattttttaaaatttctttcaagaccaccaatctttcgatagttgttaaatacaaagtgtagggatatttatgctcctgataaattttaaaatatttattgaataactttggagaataaacacttttatcagacggatttttaaccatttcttcaaaatcatttaatgtagcagatattaaatcttttttggctttggcagatgtttcaacaccttttggaaacggattttgcaaatcaccataaatagatccgtcaatcaaataataatctacattatattcttcaagagagcttaaacagcatttaagctcaaaaatagacatgtaattacttaaaaattcatccaaatatggcaaatacggaaatctgtcaatgtcgctttgctcaattgttttaagctgtccgtcaaaaattaatgattctgcagctactgcataaaagttgaatcctaaaaatttctttttattgaaactgccatcacctgcacctattgaaaactcatcatcactgcttgtaatgtttttttcgctccagttatctgaaacaatggaatttccttcaagttcaggtatgatttccttaatggatccccttttactggctgctttaatatacaatgaatttaacataatctctaataaaaaataagttagttaaataataaaaaaattagctaagagtatttgaaaactattctattgaagcttttctaatagctgctgtaatttcttcaattttacccctaacatcattggtttcttctacaactgttccggtaacaattatatccccgccagcttttgctgctgtatatgcagcttcaccatcacggatacctccaccaacaataattaccatatcttcagtagcttttttagtatatcctaccatttctggtggaatcggtttatctgctccggaacctgcttcaatgtagaaaaatctcattcctaaaagttcagcagacatcgcataagctgcaggtatttttggtttgtttctaggtactaatttggcatctcccacccatccaacagttcctccaggctgaacaaccatatagcccattggtaaaacttcaattccagcttgccttacaattggtgcagctaatgcctgagcaccataaatccaataaggattggtagaatttaaatagctcataaagaaaattgcatctgcatatttacttacactattaatatttccagggaataaaataattggaacttctatattctcagataatattttacaagtttcatcaacttcatcattattaacagttgaccctccaatcataattccgtcagttccaccaagaatagcttcttcagctatttctaaagcttcctgtggtgtttgttcatcaggatcaattaaagtaaaatgaattttcctattttttaatatacctttaatatgttcttcgaccatttccataaaaatccctatataaatatcttaatacagttatttgtgtaaacaatattatattaaattaatgtttatagaactcttaaatttaatgtaaaaacaatgaaaacagattaaaaatcaaattaaaataataaaatagcttattaaaaagtactgaaataaattttataaaaaaagaaattgaagtaaagagaataagattatcctcttggttcttttgctttgaaccttaaacctgtgtaaccacattttctacaagtggttgcagcagcagggttacgagcattacattttaaacagattttaacattaaacattctgttttctgcttcttcaaatcttgccattgataactcctccttataatcatgaaaaacgtaattttaattaaagaaaatatgttatgaaacaaaataagaattttaattatcataactattaataaattattttgttttaatagtatttaaatgtttagttaaaaccctttttatttccggaatttataactcccatataaaatcaaacctacaacagcaataacaaaaatcaaatcatgaatatggaaataatcagtaagaataaagcgattttacacctaaataaataataaaaagaaagaatccaaaaattattctttagattctaaaaattcattttgaaccctgacaacatccttactagtatcagcttcactgtaagcttctaaaagatcatgatttaattccaaaaatgtatgaccccatttaaaaccatccaaaatatcttttgcctcatctttaaaacgggtgatatataaagtagctgaaacagcttcaactgtagataaaatacatggctttccgtaattaacaggattggtggctattaaaaagggaagggatctgtgatatttggataaagagaagaattttttagaacttgacacttcgttccaggaacagtcaagccctacaactccccttctgtgaacatatctgtaatcctcatatgaaacagctttttgggcaaacgggtttaacacaacagctccactaggtattttattaatattatataccaatttacatttacctaatttttccattttgatagaagtgcacttctttctatcacattcatttgcatgaaaaactgtaactttcatttaaacactgccttccaatacagaagtatttcctgcttcatattgacgtatcaaatcaatttgatggttaaattcatcctgagacaaaccgaactgttcagctacagatggaacatccttactttcttttaaactaatagttttgagcaacggttctacataattaatatatgaatcaccataagtgtttttagtaaagttaacatctgaattatttccaaagattatattgattacataaccctggttttctttttgaacttcacagatgataattcccattgtacttttagagttagtagaattattattatctccattattgggaacagcttcaccaaagtaaatattccattcctgaccgttgaaagttcttttttcaggaccttcaataccctggaattcataaatttccattaatgcagatgcattgtccattgtagtaatattatattctatatcatgagccttatctttataagaatgaacatactccagagaatcattttccaaagaaacattacctacaaaactacctgccataaaaggagtagaaaatgaggttgattctttggatgaatcatcaaagctaccagaaataaaaataaaacctgcaacaactacaacagctaaaataacaactgcagctattattatcatattctttttttccattatgaaaactccattaatcaagtttactatactttaattattaatcaacctgttttatataattttacaaaaacttttattatactaaaaataaaataaataactgaacaaataattttaagttgttaattatgaataaaaaagcaaagtacgaattaattctaatcattctaataggtgttgtgctgataaacactgcaattgttatcagtcaccctgaaaagaagagtgatagtgaaaactgctataatatgacaactgttggaagtaatgaaaacgggactgtttataaaattatagccgggaacaattcttccaatgatactgtcggggtaatccttggagttcatcctagagaacatgaaatccacgaagaagtaaataaaacgattgccaatattacaggagaaaacggaaccaataacttaactaaaaaattcgtaatttactatgttgttacaaatgataatttaacttcacgtgacgacacaagacctgcaggtgaaaatctggcacatgactttattgtccctaatataaaagcagacaatccatttgttgtaattgatgttcatgaaattgatccgaagtatgaatattccaattttatttactcaatatcaaacaatagtgcaaaaacaaatggatatgcccaaataatagcggataatttaagtattgagaattttaactttacagaaggtacaagcccccataaagttacagagccaatagctgctcagggaataaacaccttattaatggaaacatgtattacaaattccatacaagaaaagcatgatactgcagaaaaattaatttacacactagacaatttgaaaaagtgattaatatggaaaaagttcgtggaatattaattggtagaatgcagccagtccataatggccatattgaagtcattaaaaaaacgctagaagaagtggatgaaattgtaataggaatcggcagtgctcaaaaaagtcatgagttaaaagatccatttactgcaggagaacgtgtagtgatgttaacccaggccctaattgaaaataacatagaccctggtagctattacatcatacctatggaagatattaatttcaatgcaatatgggttgctcatgttaaaatgatgacacctccgttttctgttgtttattccggaaattcattagtaaaacagttgttttatgaagaaggatttgaagtcagaaatccgcccctttatgacagaatgaacctgtcaggaacagaaattagaagaagaatgcttgaagatgaaaactggcaggaacttgttccgcaagctacaatagatgttatagaagaaataaatggtgttgaaagattaaaaaatttagctataaaagaaataagtgaaattggagattaaaaaatggttgttagagttattgaagcaaaagaagacaaagtaacaatggctgatttaatagcagacttgaaaaagtccaacaaggtggattattccggagctatctttacttttgaaggtattgtccgtggaaaggaagaaaatatgaaccttgaaaagctcatattaactactccagataaagaaaaaaccttaaaagacattgaaaatattattgaagatgcaaaaatcaaatttaatgtttttgaaatatctgtaatacattatatcggagaattttacactggagacagtctgtttttagttgcagtattaggtggacacaggggagagtcacttgatgcactaagagaagtaattgaaaaagtaaaatatgatgttgagtttaaaaaagaagaaatttcagataatggaactaaaaccatattggcaggaggttgattttcatacctctaattttttttattaaactaataatcctgtttttagttatttacttaatagtaaagaactttaagtttatttttgttgttctggcactgattttcctatttttcgcacttcaaacagtctttggatatgatgcaacagctattttaactcaagtattttcatacaattaaattcatttttttaaagtttttaaatttttatttatatcaatacttcaaatagcgatatgtaaaaaaatatgtaatcgatgcaaaaacctttaatattccctaaaacgaaagatttatatgcaattcgatactgatatattattaaaaatattctaaggagattttaaaatggaaattagtgctagaaataaaatgaatggaaaaataactgacattaaaactggtggagttatggctagtgttaaaatccaagttgaagaacctggtgaaattacagctttaattaccaaagaatccgttgaaaagctcggtttaaaagaaggagatgatgcaacagctatcatcaaatcaactgaaattattgtaggtaaagaataattacctactaacttattttttttaatcaaaatccaccacctaccaccaacgttatagaagaacctactattcccaatatattttatatcaaatattcgattgttttaaataaattaaaatttaaattaaaaaatatgaaaatcgaactagaatctatcggaactatacataccgagtttaaagatattgaaggtatgccaatacaaccaacaggtgcaaaaggcgttgaaggaaaaatagtacttgatgaaaaatatgctgcaggtttaaaggatttagaagatttctcccacattcatttgctttacttacttcataaagttgaaggatacctgttagaagtaaaaccttttatggacaacaacacacacggagttttcgcaacaagatctccaaaaagaccaaaccgcataggttcttctgtagtaaaattagataaaatcgaggaaaataccatatacatctcaaatattgatgttctagacggcacaccattactggacattaagccttatgttccccaattatatgaagatacaattgacgagttaaaaataggttggtttgagagtaaccataaaaaggctaaatctcaaaaatctgatgacagatttaaataattattcttttccaaattcatctgcaggaattaagtgttcttcaagctgtaatctgatatcatcaggtattgaaactgatttctgttccatgaaatcaaaatgaacaagaacacatgttcctttaacttttaactgaccgtcctgccatgcttcctgacctaacgtaaaggaactatttcctatttttaaaatatgagttcttatttcaacatcctgacctaaaaaaatttgttttaagtaatcataatcattatgaactaaaattaatttccagtgttcataatcaacttttaaatcaggggtaaaaattctgaacaattcatttcttcctgtttcaaaccaatcccctaatgtattattgttaatatgccttaaaccatcaagatctccaaattttggtgtgacaatagttctaaacattttttcataatctccaaaaaaaattaaaaaaaagctataatgaatttatagcttctgtaattaattgaatagttgattcaacatctttcatactgcaaacacttacagtagtgtgtatatatctggttggaactgataaaactccagttggaattccttcccttgttaagtgaatagctgtaccgtcagttgttccgccgtcacttacttcaagctggtaatcaatttcattttcatcacctgctttaataagcaagtctttaattgactgctgagtaagaattccgcgtccacttgcatcagctaaaattatagccggacctttacccattactactggtgcctcttcaggtttaattcccggatggtcaccagataaggtaacatctaatgcaatagccatgtctggatttaatttaaatgcagaagtttttgctcctttaagacctacttcttcctgtacagtacctacaccgtaaacagtagctcttgtatttactctttttaaaacttccatcattacataacagccaacacgattatctaatgctttacccataatcaaatcgtttggatattcttcaaaccaagctctgaaacttattttgtctccaatacgaatcattttttctgcatcttcctggtcttttgcaccgatatcaataaacatgtcatctgcttttacaactttgtttctttcttcaggttttgtaacatgaggtggttttgagccaataacccccggaacatcttctccaatgctgctgtgaataattacagactgattcattaacatttggtcattaattccaccaattgttgagaatttgacatatcctttttcatcaatatatctgaccatcaatccgatttcatccatatgggaagctaacattacagtaggtgcttttttctcaccttttttagtagctattacattacccatactgtcttcttcaatagaatcagcgacatcttttaattctcttttaataatgtttgctattttttcttcagatccagaaacacctggagttaaagatagctctttcattaattccatcatatcaccattaaataaatgtattttttatattataaatagtttaaaaaataagtaaaaacaagaagatttacttcttatttgttaatgctttaaatccaattgttgtagtactgtatttagttccagcagctttaataacatcctggattttagatgtaagataagattcaggtctccaaggcgcatccttatcttcaccgacaacagaaacttcatcaacaatattgttttcaagcagatatactaaaatagctgatactacaccaccatcttgtcccataatggaatctgcttttacagagtaaatttcaaggtattcgcctaatggctgttcatcaattccttcaggatatattgcatcactgataaatgttctaggacatgcaaagtaacatgcatgacagtcttcttcacattcttttactgatacaggttttctgttgtttatctgaacagcatcaatcggacagacatattcgcaggcaccgcataaaacacatgaccctacactgattacatcattttgcaggttgtcaaactgacatttgccgcattcatcatagaattcttcttcggatatttgtctttttgataaaacaggtcttccaatagcttcccttttcttatagattcttgtatttttgctgattttttgattagctattttttccagcaaatcctgaccttttctggaaatcgcttcagcttcaatatatccttcagctatacatgcatcaattatctgcttacctttttggcttcttacaataactgttgagtgatatttcggagaaccgacagatccaacagaaatgtctgaaacatcagaagtataatcagtacaaatatggcaatttttacgagtaaaaggttcggtttcagctatcggtattttaaatacattaccatctatcagatatgcaacaaattgtcctttttctattctaaattccttaacttcaaacaattcaatatcgcgacttttcaaatatcttttaagatattggtatgagaagttttccatacaaaacaaacctattttaacatcaataggagaaccgccggttttttcttcgtatctgttaatttttgtagctgctaatatttggcaaggtgttcccaccatagctgttttcttgttactcatatttttcacctcttatgctaacataatcatattaatataatatatgtgatgtaatatcatttaaagttttttatcaaactaaacaaatccctttaaaaacaaaataaaacaaaaatttgtttagataatctaatttattccaaataaaactatacaaaaatacaattgcaataaaaaatattaaaaaatatttaaacaacacatttaaatatacataataattaactaataaaacaaaggtgagagtatgaaaacatttacaaaaattgctaaaatctattttagcccatcaagtacaacaaggaaaatagtagatgaaatagccaataaatttgaaggcacacaggaagaatacgacttattaaatgtagctggtggaaattctccaaaagagtttgatgatgacacattagtaattgtaggaatgcctatttttgcaggaagacttccgaaaacagccagtacaaaattaatgaactttaaaggagaaaatatccctgcaatagctgtcgtaaactacggaaacataaatatcggagatgcactcattgagttaaacgacatattaaaagaaaacggatttaccatcgtaggaaccggtgcaacagtcagccagcactcaatagtaacagatgttgcagcagacagaccggatgaaaaagatttggaaaagcttaatgaatttgtagaaaaatgcagggaaaaattagattctgaagaatttgaagacattgaagttccgggcaataaaccgtactgcgaatataaaaaagttcaattaactccaatctgtgacgaatcattatgtacatactgctatgagtgtgtttcatcttgccctgaagaagctattcctgatatggaccctggacagacagatgctgatctttgcagtgcatgtactgcctgcatatatacatgccctgaagatgcaagatactttaccggagacttatttgaaagaatgaaagaaagattcctaactaacttcaaccaaagaaaagaaagtgaattttatttatagaaaatagccatgctattttcttttttaaattctgttttttgcaacgcttcttacatattcgttttcatcacttgcagcaacttcttttaaaactttcttatttgaaatatttttaacagccgcttcacgaattctccaggaaggttcatttttaatcaattcaattaaaggcttttgtgtttttactttagaaacagctcttacagacagctcttctgaaatattggcttcataaactttaagtaaaatatcctcatcatctattttattcaaagcttttagagaaaattcagcatcttcattttctttaattatttcaattaatactttgatatcatcaatatgagataaagtctcttttctaacttcttccagtttggcattgtgtaaaatctgaataaatgaagattcattctcaatatgttcaatagcttcatcagcagtctctttaaaaggagtgtttatagctatttcaacaaagcactcttcatcagccaaactgggattgttgattgcatgttctcttacaaactggtcttcatcttcaagagctacagcaaccagtgtttcctgagaagtaagttttttaacggcactctggcgggctaagcggtctgcttcagttttagctattttagttaaaatctcttcattatcaagttttttaatagcttctgttctaacaacagtatcattatcctccaaagctattttttcaagcaaatcctcattatccaacctttttaccaagtccagacgaatatctgcagtttgagaagtaagtgcaatttcctccagcaattcaggatttacaattttacttaaaagaacatttctcacttttgtattttcctcatttttagctatttcaaccagtttggattcatcattgattttatttacagcagctattcgcacaccgtcatccctatcttcaacagctaccttctgaagtacatcctcattataaaagttgcctttattgactgccatttttctaatttcattatccttagcctcaaatgcaatgctttccagtatttcctgagtgtcaattttttccaatgccaattttctgaatttcctgtcaacggcactgacagctatatcctttaaggtttcttcatcctctattttttcaaagatttcagttacatgctggtttttcttttgattaataacaatttcagctattgacttattgttttcacctaatctttcataagcgaagcttctgacatcataaaactcggcattttcagctgcatcccataaaaggtcttcatcctgaattttatttgcagctattaatcttatagctctgtcagttacatgtttagctatatccaatgctacatactgatttgtaattgaatctgtagcctgtgctctttcatgtctgtttttactgttaacagctatttctcttaaaactaactgggattcttcaatgtccggctgtttatcaattgcttttctttttctttcaaccctttttacctttttattggcgtttttgttctttttaaatctatcaaaaaatcccattgtaattcctcatttgataattattatattttataataaaaatagtttattttacaaacatatcctgtaaaaatcatcagctttcatttactatatcatacattttcatcaaaaagctggccagggaaacaatatcctgtctgttgtgttctataattggaactatcggccctatattcctttcagtcaagtatgtttgataatatcccggaatgtactggcctggaacgtcatcttttctttcaattccaaagatttctttttcaattgtttgaagttgacagttaggcagagtatttttccacagatttcttgcaaaatacaataaatcaagatgaggcaaatccagctgaggattcattctgtaatagctgcacctatttttaataaagggaacatcaaacattgatccgttgaaggttacatgaatagaatcatcatccaaatgagacagataagcttccaaaactgcaggttcctcataaatgtctcttaagaaatattgtgaagaggttattttgttgtttttgatttcagctacaccaatcagaataaccggaacatttgataaacccaatgtttcgatatccataaatttaaagttttccgcatcaggaatacttgcatactttattagattgtccctgcactttttgccgtacttgtttttgttcagcagtcttaaaacatccctaaatgacatctcatcaatactggccatgaatctgtcagcatatgatccgtatctgtcatgagcagtaagtgattcaatggtgtcgtatcctgcatttttaaggttctgttctgttttaatgcctattttcggaagcagtttaaggttgtggttcatttgttgtttaaaattattttcagctaatttgaagtttattttttcactttcagttatacataatgtttcacctgcatcagtatcaattattttacttccgctaatatctgacagctttttattttcatatttaaccagaagattttcttccaatgccttaaaataagatggtgaatttttcctagctttttctttagctttttcagaaggattatctgaagatattgaatctgacaatatcgcttccaacaaatacctttcgtgttcttctctttgtgtcatttacattaatttagtcatttattgtatatattattaattaaagtataattgaattttaataaaatataaataagtttatatagtagattgatacaatattaaattgactactaataaactcagcaattattagtagtcagagatagataaaaaaacagccaattttaaaattcatttctctaaaaaacttgtaaaaacaaacacattataaggcaaggataaaactctcaaatgcttgccttataatcccaaaatactatttttaaaaaaaaaaaattctttagaaaactataataatattttaaaactaatattaaaattagtcaatatataaaatattaaggttgcaataatgaagctaaaattaggtataatctatggaattttaatatggttttttgtatatctaattacagtaatatttagcccattgataaccgacaacattccatacatcaatattgttgctccaatagctattatcacagtaactggtttttttggaatcctctacatcagagacatcaatgaaaatgaagttattgaaggatttaaaattggaacaatatttattttgatggatgttatttgtgattttgtattttttgtaattcgcaagaaaacaaatatcctgattgatgattatccaattcatgtaatttctatgattatattaactcttattacaactaccttacttggctatctagcacaaatggaaatagatttaaaataaagaggtttgaatatgatacctaaatcacatccacgttatgaatcattagttttaagagacaaaatagttaaagcccaaaaagaaggatatttagcagaatctgcaatgattgcacacggcagaggagaagcatttgactaccttcttggtgaaaaaacaacatttcctgctaaaagagcaatgtatgcagcagtagctaccatattattatccgaaaatccggttatatcagtaaatggaaatacaacagctttagctattgatgaagtaattcaatttgcaaaaaccgtaaatgccaaaatagaaatcaatttattttacagaactgatgaaagagtagaaaaaataaccgaactctacaagaaacatggatacagccagatacttggaacaaaagacgatgacatcaaatacctgaaaagcattaaaaatgaaagagcatcagccagcaaaacaggtatctattcagcagacaccgttcttgtacctttagaagatggagacagagcagaaattctaagtaaaacaggcaaaaaaacaatcacaattgatttaaatcctttatccagaacttcacaaacttcagacatttcaattgtagataatgttgtacgtgcatttccatttatgacagaaattgctaaagacctgaaaactcaggacaaacaacttttaataaatatgataaacgactttgacaacagaaaaaaccttaaagaagcactgaaactatttaaaaataaataaaacgaggaatataaaatggaagtaatgggaatatcaggactacctggatctggaaaaagtttagtttctgaaattgcagctaagaaaggagcagcagttgtaagtatgggagacataatacgtgaagaagctaaaaaaagaggagaaagctcaaaagaaactgcaactaaccttagaaaagaacacggaaaatatattgtagccaagctaactattgaaaaaatcaaaaagatgattgaagacaaattagctacaacaatcatcgtagaaggaatcagaagtccttttgaagtaaatatgtttaaagaaaactttgatgattttataattctttccatttttgcaaatcctgcaatacgctttaaaagattgcagcaaagaaacagagaagatgactctgaaaattacgaagacttcctgaaaagagaccagatggaattggattttggtattggaactgtaatctcattatccgataaaatcattatcaatgaaaaggatttggaaagctatgaaaaagaaataaatgaatttttaaaagaaaacaccaccctctaaattcatttatcttccaattctgcttcttcaataatatacaaaccactatccaaatgccatgtttttttatcttttaaaatattgattctttttttgaaaattggaccgtcaacagctagtgtttctgcttctccaccttcaaaagctaaattaataccaacttttttgttgatttcaaccagttcatcaatagctttatcatcgatttttctgcccagccatgattcatctaaaccataagcaaaaacaccacttattataacttcaaaacctaatgaaacaatctctttcatatattcaagttcatccacatgccagtaaggagatatgatttccagtccaacttcatcacctaatttttcaatccttgatttttgataaactgaataaagtgcaccggtatatatggcttcaacacctaaatctttaagttttataaaagccatttttaaatcttcaagttcctcttctttaatgccctgagtctgtgcagtaatgattggaatatttaatgcttctgcaagcaaatcagttatatgaatattcggaacatgaaacatgtaagattcatcattaacagatttcatagaaagaagatatttaacatcttctcctgtttctaaagcattatataatgccatagtactgtcttttcctccagaaaataaaacagctaccttcatcaaatactaccttttaacctttttattaaggaactttttgaattttctataactaacaacaactgcatcgaagtaaattccaacaacagaaaccattacaccaacaacacctgaaaccagtatgaattcgttgtcagatatcatagactgattggtttgattaacaaccttttgagttggtccttcaatatgagttgcaacaattcctctttccaatagagcatcttcaaattcacctaaagaggcagatgatacaaccaatttagcatgtatctgagcataagcaatagaatcaccataaactaatttataccaatcagaaaatgactgcaatgcagaactggatgtgtaacccggttctaaagtaatattaattctgcctgaaggttcaactgtataatctgcataatgagaatcaatattgcctattacactattaaaataagccaattccttatcattaaaactccataggaaaaacgttactccagtttcattaaatgatttaaaaccatcgattttagataaattctgttccaattcacctacatctgtggcggaagacaaatccaaatataatgtttcttcatttccgggaacattcttttcaagttcaccgacaaatgccgggacctcctcatacaaaggctccaggaaaaaggcaccaccaatagaccctataagaaaagctacaacaagaacaagtgctatttcttttttaggcataaatggctttaacatacctatagaaaaaacaaataccatcaatataatgaataaaataacatatacaatagcaattaaaatatccataaattcacgcgccaattaaataatattactatttaagataacaagtaatttaaataagttttggatagattaatggattatttcccattgaaaaaagaagaatagatgaaaattaatcaatcataaaatttctgattaacacacttccaaatcattgtatgttcatcttcctgacttacaaattcaaattccgtttcaggagcaagaagaatatcgcaactcatttcaggatccatcataccacctaaataaacagttctggtgtcttttggaagtattaaaacattcaaataaggaatattgtcatcaaaatgcatatttacactggctttaagtggatctggagatgaataaacaccatcaacagcttgttttttcataaaaggttccaattcacgataataaaccctaatttcctgatttaaaggcatggctttttcaaaaatccagtcattaggattatttcttacttcaaacaagtcaaaaaaggaatcaagatctatgcaaacagtatccttacttgagggatttatcataatttcatcaatttctgatgaatcttcaagcatatccttcaagtctttcataaaaatagctattacagaaactggaggattgtctttttttaattcttcattgtctgtaaataatggaatgcatttacatccattttcttcaattgtaacaggtttaaaactaagaggttcatttatttcatcactttgagttttagaatatatttcaaccggaagtaaaagctgtgcatttttaaattcagatacgaaactttcatattcttctttgctcatagattcaggttcgattttcattaattctttaagtttagcattgtctagactactcataaattaacctcacacattacattataatttactttttagagataaatatattttcactatcctcaggccattcaataacaagtgtatttctgcctttatttaaattcagaacaccactgacatcatctgcatcatgatttactctaatcagcttagatgacccgtcattgaattttacactgactgagagatgttttttgtagatattgacattaatgctttgatccatctccagattaacagtctgccttgcgccatgaccttcaccatatacctgattgattccgccggctattttatacatctgggatttgacatttacagcatcggaaacatctgttgttttatcaattgccagactggctaaaggcagagtgaatatagtcagaataattaaggctattgcaaatataaacaaatattcaactgcaatttgaccattattttctttaagcatcctacatcaccagaaagaacttttttataaacagcagcatcaaatcaccataaataacagatatcaagaatcctgcaaatattgcaggtgcaaacggaaatcctatttttactgaaatgctgttggatatgattttttgagcattcataatctttaagagatacatatcctgagcagttattcctccggcactctgagatttaaagtaataattaaaatcaggattattctttgttttgtaaacttttagattgccattgatgtcactgattaaaacagctattttttcattattgaaataataatcattgactatcattccttcttttaaatctttaatcagtatcagtttatttagatttaactttaaaaatagtgatatggaatttatatttaaaaatgaaaataatatgtccttatttgagttaaacattgtgttttttaatatcagatagccggtaaatattagcagaaacggaaatgctattaaaatgctgtttataattactgtaaatgaaaacgggtaaactgacagctgaggataaatatttaaaaagtcaagatttatgccaaatggtataactgtggcaatagctgtaagtaattttacatctcctccaccccaaatttttaatttccaaaataggaaagttacgatatatgttacaaacattgaaattattgagcataaaatgtatttaatgttagcagaaagaactgacaaaaacaggttagatatcaacccaaaaataagcagagataaatttaacctgttggatattattcctgttttaacatcaaaaattgcagccaaacaacaaaataaagatgtaactataatttgaactaaaaatataatactaaaatccataattctagtataaactaagaaatatattaattagctagaaaataagagtgtaaaattgtttttaaaataaaaaaaatgaagagaatcagtttttagaatactcataaatagcttctaaaaatgatttgaataatggatgtggcctattcggtcttgatttaaattccggatggaattggcagccgacagcccatggatgatttggcaattcaacaatttccactaagaagtcatcaggactaactcctgaaataactaaacctttatcttccaggtctttcctgtaatcattgttaaattcaaatctgtgtctgtgacgttctgcaatatcttccacattataagcctcatatgttttagttcctttaacaagcttacagtcataagaacctaaacgcatagttccgcccatgtttttaacttttttctgttcttccatcatgtcaataacagggtgaggattttcgctgtcaaattctgaactgttagcttcaggatatccgttacgtcttgcaaactgagttacaatagaatgcattcccaaacagataccgaacaacggaacattgtgttcaatagcataatctacagcatcaagctttccttcaaatccacgttctccaaatcctccgggaataagaataccatggagattgcccataacctcttcatccaaattatcaacatcagaactgatgtagatgatgttggcttttaccccaacattagctgctgcatgctgcagggattccctgatactgatatatgcatcttcaagctctacatatttaccgacaattccaatatttacaacaggactttcaatcttaagagattctacaattttacgccagtcatcaagttttgaggaatccggtttaatatccagtcctatcctattaactatcaattcaccaatgttattttcttctaaaaccagtggcacttcatagatagtacctgcatcaggagtgtttacaacagctttttgatccacatcacagaaatgagctatttttccttctaaagcatcgtcaattggttcctgagatctgcatacaataacatcagggttaatacccatacttcttaattcttttgtagaatgttgtgtcggtttggttttgaattcaccggcggcatttaagtatggaataaatgtaacatgaacaaacatgacattatcatggccttcttcatttctaagttgccttaaagcttcaaggaaaggctggctttcaatatctccaacagtaccacccaactcaattagaacaacatcataatcctcattatcagagattaacctaatcatttctttaatttcattggtaatatgtggaataacctgtacacaagctcccaagaatttgccttccctttctttagaaataacagatttataaactttacctgtagtgatattggacaatccaggcaattcaacatctaaaaatctttcataatgacctaaatccaagtcagtttccattccatcattagttacaaaaacttcaccatgctgataagggtttaatgttccggaatcccagttcaaataaggatctattttaatagccgctacttttaaaccataagatcttaaaatacgacccatagatgcagaagtaattccttttccaatagaactaactaccccaccagttataataatatactttgtcagaaaaatcctctccattttataaaaaataaaatttatatactttataatttagttgttcatcttatatataattatgaaaaaatcagattaaattaattggtagctatacttgggtggtgtaattgtatagctaccctatttttacttaaaagaattttagtaattagtcactgggttgggtggtggaatgactaattaccaaaacaaatttttttaaacaaaaatcagaagagcaaaaactctcccgatagtaaaatttatagcatgtgttataaatactttactctcataacatagattccagatcaacttccagcaagtccctgacctttttaagctcatcaatgatttttatatgctgagtgcagttctcctcacattcaccacattccaaacatgaagatgcaggtgcatttttcttggctaaattatcatagtagaaataatgtaaaaactggagttcaatggattgtttaacatcattataaagagcaaagaactttgaaattggaatatcttcagggcatgcatccaaacagtaatcacatcccgtacatggaattgctattgaatgtttaatgatttcaactacatctccaataaccttcaattcatcttcagtcaatggattgaaatctttcatataacttaaattgtcttccagctgctccaatgaacttacaccagacaatactgttaaaacaccttccaaactggctgcaaacctaattccccaagatgcaagtgacaaatcaggattgtagctagttaatattttaccggcatcttccggaatatttacaagtgttcctccttttaaaggttccattacaataatgtccttattgtattttctggctacttcataacatttccctgactgaattccctcattgtcccagtcaagataatttatctgtaactgaacaaattctatagaaggatgctcacttaatattttatcaagagtttctgcatcatcatgaaatgaaattccgagatgtctgataaagccttcttcctttaatttttctgcaaattcaaagcactttaactgcggaatgattccattgtagaagttgtttgtaatattgtgcagcatgtaataatcaaaatactcaacaccgcatctttctttttgctcactgaatatttcttcaaggttatgtgaaggtttaagcatgtatacaggtaatttatcagctattattacatcttctctcggatatctttcagtaactgcttttctaagtgccacttcacttaatccgtcatggtatccatatgcagtatcaaagtaattgaatccgctttcaatatatttatcaaccatttcaaatatctgtggcaggtcaatatctttcggatcatcactattacagggtaacctcatagatccaaaaccaaattttttcatattatctcctcttttttataatgggagccattctataaactctttaatataatcattgcaaaactcccaggtatgttctcctgaagagcatctgaactccacatcaacatttcttgattttaagtaattataataatctatgttctcatcatacaagaagtcattatctccaactgccatgaaaatctttggaatttcaatatcattagctatcaaatcatcaattaaaaatttggggtccatgtcacttccgattactttattcaagtctccgaaacaggactgggcaaaagattttgaagacaataaatcatctccttcaccccagttatgcaaatcatctgtcagcaacgctgcagagattgctccaatatatccgaaagtgtcatggtattttaatccgtttctaatagctccatatcctcccattgaaaatcctgcaagatatgtgtcttcttttttatgagatagtgggaaaatgtttcttgtcatttcaacaagttcacgacctataaactccccataatatttgtgggattctttttggtccacataaaagctattttctccacttggcaggacaactgcaatattatggtcttctgcaaatttttgaattgtagtgtttgctaaaaatatatcatcactgccgaaaagcccatgcagcagatacaatgttttatatggcttttctactatttcttcagtgccctgcaagtaatgtatattgtctgcaggtaaaattacacttaatgatgttcttctctgaagtgacttgcacttaatatctcctctaaacaataccataatatcacaaactgttgcacattacaacataatttttaatttttttaatatataactgttgtgtttaacaaccattttatttctgttatttgcaaattaaaattaaatattccattccgcttttcatgccttttatggctacaaatgaaaaaaataatggaaccaatcaagcatattcttaaaatttattataataattaaaaaaaatacaattattataatccttccaggccagttaatatttattttcttaaagaaaaggacacagtaataataaatagtcaaaattactataatactaagcaaaatcacatttacaacatctttaatcatagaacacatacacccaaaataatattatctcaaaattatatacatggaataataatagcaattaaaataaaagatatataaaatagcctagatggccaattatctttttctacaagaggattaggattccaaattgtataatagttataacaatgccatgataaaacaaatattacaaaaaaaataaaaacaaaaacacatttaacattaatatccataatcataccaccaaacatctaattattagagtactgtgactcccaaatatctctccaaatataatctcccccaacaccacaaacagaacctaaagataaaaaaaataaaaaaaacaataataaacatacaccaaaatcaacatccctcatcaaaaccactaataaaacaatctatcaaaataaaaatataaacattactatttgaatttttatgtaaaaaaagaaaaattaggattctgcaaccctatataatgtccatttattgctgaagtatctgtagatgtataatccgcctcttacaaaccagtcaatgaacatagctacccatgttccaaatactcccatattaaagtttatggctaaaatgtaagataagcctatcctgcaggtaaacattactgttaagcttaccaccattgcccattttgcatcaccagcacctctaaacaggttaggcagtgtaaatgctattggccaaattaaaattccaagtgtaccgtgccagataatcatcttgccagacagtgctgcagtagcaggagacaaattataaaggctcaaaataaccggcaacagggcaaatattgctgcattgacaataatgtgacatacaacaacaattaaaataatctttttattgtaatatcttgcctgttcataatcatttgctccaacacatcttgaaattactgcagtcattcccagattaattgcaaaaccaggcaatactgaaaatattccaattgcataacctacagaattagctgcaatagctactgttccaaaagttgaaaccaaacttaaaaccagcacacgtccaaactggaacagtccgttttcaataccgtatggaatacctacattcagcacgtttttaagaactttccaatcaaatttatgttttaaagttcttttaatatggagtttgaagttttcatttaatgtaaaatgcattatagcagctgctgcaatcagtcttgaaattacagtggggacagctactccttcaacacctaaacccaaataataaataccgaatgcattacctacaacatttaaaatatcgcagataaccattatcttcattggcagaattgaatttccgctggttctgtaaattgcagcacctgcattgtaaatagctataaatggtattgaaaaagccataaacagcagatatgtatttgcataattccatacgtctgcttcaatctggccaaataatgtattaattaaaaaggatttggctattaaaacaaccaccattaaaagagctgataaaattcctgaaaaccacacaagctgattgcatgctcctctagctttttccggcttattgtttcctaagtactggccagctattaccgctcctccagtagccagtgcagaaaatccaaaaatcagcagctgcatcagaaaatcaactaatgaaacaccggaaattgctgcttcacctaaagatgcaaccattacagaatcagcaaaccctacaaaaaattccagtccctgctcaataagcaaaggtaaaaacagaacgaataatgctttattggaaaataaataatgttttggggttttaattaaagattccatatttagtacaccataaaaaaaaataaaattattgttgcaaattacaacataaattataaatttccagatatataactgttgcgattaacaacattaaaagaaaatgattaatgagatgatttatctaaaaatcatcattaattagccttgacattaatttatatccttcttttttatccaaactgcctttaagaacactctgttcatcaaaggattcacattcatcgcctgttttatcagaagaatatattatcaaaggcacatcatctcttgtatgggttccaactgaaaccggagttggatgatcaggcaaaatagctgccttaaagtcctgaccttttaaactgtctaaaaccggacctacaatatgcttgtcaatttgttcaatagctctaactttttcagctgtgtctgatgcatgtcctgcttcatcaggagcttcaatgtgtacaaacactacatcatggttttttaaagcttcaattgcatattttcccttagcttcataatctgtgtcaaagtatcctgtagctcctggaacatcaataatgtcaaagcctgcaaaagcacctattccttttaacaaatcaacaccagtaattactgctgcatccaatccgtaaacatctttaaagttaggtaaagttggtgttaccccctgaccccacagccataccatatttgccggttttttaccattttccactctttttttattgacttcatgattttcaagaacttcccctgattcccacatgattttcttaatgaatttgggtaatttttcatcccatctgtcgccggaggtgttttcatccagattctcacctgcaatatcatgaggaggcatagtcttcaaatcagccaatagcttagcatcttcagcactgtcacaggaatatacaaacagatgtctgtaactgactcctgaatagaatctgcctttaaaatcatcatattttccattgaaataatcatttaagctgtccataagtatttcagcttcttcagaagtaatatggcctgcattaaaatcatccatatgattgtccttctgggtaatggtattgcatctgaaaattacgtccttatctgtggtttcaatacccatgcttcctgcttccagaggtcctctgcctgtataataatctgcagggttaaatccgaaaatactcatattggctacatcagaacctggagtatatgcatcaggaacattattggttaaacctccaaaaccctcttttgccattttatcaatatttggagtatcagctgccataagtggagtcatgccgtccaattcgtcgattggatagtcacttgaaccgtcaggaataaaaattacatatttcatactatcatcaaaaaaagtaaaagtaaattagtatttaacttttaaaatactaatcaaatcagtcaacatcgcagaagcagtttcaagagatcctgctccaagtccaataacactaacatcacctgcaaggtcagtgcggacagtagccatatttaaagttccgcttaaatcatatgcactgccttttttaactaaacgtggtgatacctgcagtttgtctttagaaacttcagctattaatttaattaaataaccttcttttctggctaaatccatagcctgtgaagtaatatttgaaataccttcaacatcaacatcactataagtggcatcaattcctaaaagtgaattagctaaaattacagttttacaagctgcatcaataccttcaacatcctgagttgggtctgtttcagctattcccaactcttgagattcttttaaggttatatcataggaggaaccttcggatgccattcttgataaaatgtaattggtggtaccgttcaatattcctacaattgatttgattccacaggatgaaagtgtttcttttgtgaaattaataataggcattgctccaccaacactggcttcatatttaaattcaacattgtttttctcagcttcggatacaacttctctgaattttaaagctaaatgtcccttatttgatgttacaacatcttttccagctttaaatgcttttaaagttaaagacagtgcaggttctgcatcagttatattagttggagttgcttccatcaaacagtcatattccacagcatccaacacatccaaacctgaaatggtactgccgtattcaggataattggataattttccaaattcatttttagtgtttacaagcagttcttcatccaatccgtcagcacagattgcagaagatgaagaatctgcagcagctactatttttaattctacattaaatctttctttaatcatgtctttttttaatgagattgccctagccacaccctgaccaactgcaccaaatcccattactatgactttacattctttcatactatccctaaacttcattaatcataagtaaatctttttctgcagctattttaccaatcttatcaaatataaattctttcatgccaaagtctgtttcaatattaattaaggcagaggatttggattccccgtctaatttaatatcaaatccaactacataaacaccgtctaaagaattaattttatccatagtgtctctaatgtcattatcaacaatatggccaattaaaatagtgctcacaacttcctttttaacgactccatccattgcaataattgaaactcccaactctttgaacctttcaataaccctatcaaggctatcacgttcaccttcaagagtaagctgaaccggaatcattcctttttcatttttagaatctcttttatggattacagtaaccaggtttgcaccaaggccactaatcggatccaaaacagaaacaagctgtccaggaacatccataagttctaaaaccaaatccattttcataaaaaattcccctaattaacccaatctgctcttttaacaacaagtttgccttctttatcaatatgagcattccttaaaattttttcaggatgtttctcatgagatttatcttcacgagtaagatttaaattgtcagtaatataccaagtttcttcaagatctggaatattctctaaagtttttgaaaacttgtttaaaatattttctgcatctttttcaattttcataaataaatctcctatgattatttgataataataaaaataattttgttttttaatattaataaatgtttattaaaacttgggctttttgccaacttaaaattacatcgccagttaatcctgacaacaaacatttgttggagaagtccttttttaaatttttgagttttattaatcaattcttctatagcaaatatcttattatctatgttagaaagcatgttgcttatttgtttttgttcatcgaatgatggaaattcaaatttcatgttttcaaagctttttttatttaatattggagtagcagttattccagcatagtttttcattttttcagaattgtaatctattaaataataaataaaatctaaatcaaaactttgtgatggagttatagaattaatttgttgattaaaatatccatcttctagaataatacaattttttccaatactggctatgcatgtgactaatacactatttttttaacaaagcgtccttttttagcaccttcgtcagataatcttttcgctgtgtcaaaaatgtattttgaggatatatctgatggagttacccataaatattttttaggagaataatattcattaactttagttgaaggagtgtttccagtatttatttcgccaacatcttttagttttatagttttccactcctctatgtaatctgtaaatcttaatttctgtgtgaaaatctgctgcattaaatacttcttgaaattctggcacatttgtagtttattatctaaaatttctatttttgcatctagattcttaagcaatattcctatttttttctgttcatcatatttaggtattttgactttttcaattgaataatctttaaaatatatgtgggggattgttgaccctgttttatatttatttaaattaattgtttgaagtaaatagaaaataaaatgaatatttagattttccttaggcaaaatatattgtgatgtattaacaacagatgtgtttttttcatgaaaactgatatttccaacaccagatccatctttaacaatagaaatataatcactatccatttcataaaaatctatgcattttaaaaatccactagcgccatataaaggataattgccaacattatcatccaattgattaatagatatgctagatgatttattatgcaataaatcttttagtttgtatgttttccattcatcatcaaatccgctaaatcgcaatttaagccaggtttactatgccaatgaatttgaagcactgggaaataatctgatagctgcagttggaacctacttcagcagcagctgtggaaaatacgaaatcagcatttatgtaaatgatatattaaaacacacacaaaacggaacaagtgcatttggcggtttttcaactgtcaaattaaataattacattccagttaacaaaggagacattttcagagctgtaattaaaggtgtaaatgtcccattatccataaataccagagttcataatgacgatttagctactttaaatataaatctgatacctggaaaatatatcataacagctattgaaccggtaaccggattagatatggggtatggagtaactgtccttaaatagagttttaaactctattttaaatactcctcaatatcagtatcctttaaaactttttttcttaaaattttgtcaatacccgtgccgtactgggctgcctttttaggtctgtaagcaatctgcttatccagtcccaaattgaaagccgtttttcttaaaatatttttgcgcagcttatcatcagaacctgaaatcttatatctgaccggaatattgagggcaaattcaacaagattcttatctaaaaaaggaagacgcagctcaacgccatttgccattgagcatgcatcatcacgttccagattaacatgatacatattagccatatcatatcttaattcatcatctaaagtattttccatatagctattcagatatctgttatagcccccaaacagctcatcagcaccctgaccggaaatagctaccttaatattatcttcaactatcattttagaagcaagataaacagtcattcccactccaatcttcatcagattgttttcaccaattgcctgaacaacatctttaagactgtcctttacaatactttccgtaatgtcatgaacctttagaggaagacccaaatactcggctacacacttagctgcaaccacatccttggaatcctttttaccgacagcatacaaagtaactttaagatttttatttaaagatatttcccgaagcagcaaagctatcaaagagctgtcaacacctcctgaaaatattactccaacttcattcaaatcctcaaccctttttaaaacagccagtttaagaagcttttcaagttttctgttgtcggtttcaaacctcttctggaaaatatccgttttaggaggtatctcttcccagttgtaaagtatatgtcccggctttaatgttttgatatctcctttcaagcactgttttgaagaagcaaaagcattatgtgtgtaaaataaaggtttgacacctaaaggatctcttgaaacagccaagttaatgccatctgtaacagcataagcataatccccatccaaaagattattgacctgagttactgctcttaaaaggtcatccttataataaaaatcaatcagattaattaataactcagaatcagaatttatattgtcattttttgtcagtttagccagcaaattctttagggaagaataattataaatctcaccattgaaaaccagagtcagagtgtttttagctatcggctgagtatgggaagttctgttttccaaattatggacagccagcagattatggcctaaacctaaataataagcgtttttatcattgaaatcatttaaatcaatacctttttgtattttaccatctaaaaatattcctgaagcatcttttcccctattttttgatgtttttaacatagctattaaatcatcagctttgaaattaccttgaagaccaactattgaacacatgatttaatattaaattttggagtttaaaaaaataatgatagtacaaagtaaacatttgattatttcaattcatagtgcattattttaactgattacatccaagtttttaaaagatattaagatttaaatcctattatagtcttatttttaacagttgacctaagtttatataattgtgcaaatccagcatttcaatcctattatagtcttatttttaacagatgatgttttattggagaatggatatgcagtacaatttcaatcctattatagtcttatttttaaccaggttatcattttccatgattactttatcatgtgtaatttcaatcctattatagtcttatttttaacattatatgatgctgtagacttaagatgactttcttgatttcaatcctattatagtcttatttttaacactcacaaaagaaacagtgatccttatattgctcaatttcaatcctattatagtcttatttttaacttgaattagaaatcacagttaaagaaatacctacatttcaatcctattatagtcttatttttaactcctattttggacaattttgttttaataccatcatttcaatcctattatagtcttatttttaacatcaccatcataccattttcatttatatgaatattatttcaatcctattatagtcttatttttaacctacaaaaaaccattcaagcaataaacctgactaatttcaatcctattatagtcttatttttaactatctaaatcattccttttataaatcacttcactgatatttcaatcctattatagtcttatttttaacctgtgtcgtttaataataaatcatttacgtaactaaatttcaatcctattatagtcttatttttaacctaatacatctgacatcataaaaacacctttcataatttcaatcctattatagtcttatttttaacgacagttaaaacatttgccattacaaattatatattatttcaatcctattatagtcttatttttaacccatacattatcataccagtaaaccaatttggatttcaatcctattatagtcttatttttaacttccacactatcaaatttgttgattttttccattctatttcaatcctattatagtcttatttttaacaaaagtatacaaataatctgaaaaccatgggttctatatttcaatcctattatagtcttatttttaacatcttcctttttgataacaagatttgtttcctcgtatttcaatcctattatagtcttatttttaacactggtttaaatggtgctggaatatctaataatccaatttcaatcctattatagtcttatttttaacaatatatttatatagtagacggtataaagtaatataatttcaatcctattatagtcttatttttaactttgatgtagttcttcttcagttatgttgaatgtgtatttcaatcctattatagtcttatttttaacacattcaccaacctcaatttccatttcaatagttttatttcaatcctattatagtcttatttttaactgctcctgcaatcaaaattaaaatcttgtaaacttcatttcaatcctattatagtcttatttttaaccatcacgtcttaacattctaatgtcatcttcactccaatttcaatcctattatagtcttatttttaacttactaatatggccaatggtgttaaaagtttacaagatttcaatcctattatagtcttatttttaacttgtacatgcattgtcctgcatgtacttttaatgttatttcaatcctattatagtcttatttttaactttagtttatgatactatgaccagtgaatccgacagaatttcaatcctattatagtcttatttttaactagttgcaaaagctgtggacactgcaaggttaattctatttcaatcctattatagtcttatttttaacacctcctttgtaacctacagggtcacgactgccagatttcaatcctattatagtcttatttttaactactgaaaggcatatcagaattagtatccagtacatatttcaatcctattatagtcttatttttaaccaatacagttgccttctacaatcccgtttttagttgatttcaatcctattatagtcttatttttaactaggaaaagcaatgggagcattgtctgatgttaatatttcaatcctattatagtcttatttttaactgtatatgtgaataatgcttgtccattattattcgatttcaatcctattatagtcttatttttaacattctaattgcattgcgttaggataatcgctaacctgtatttcaatcctattatagtcttatttttaactattaataaatcttgtactattactcattgtcataaatttcaatcctattatagtcttatttttaactctaaaatcagtgtatcctggttcttcatagtaatttcaatcctattatagtcttatttttaaccaaaggtatctgtgatggatttactaatcatttccatttcaatcctattatagtcttatttttaacagttgcagtagtataagtagaagttcctttatacgaatttcaatcctattatagtcttatttttaacttggttacaaacaaggtaaagtttttctacctttatttcaatcctattatagtcttatttttaactttagtagtagaaataagaaaaactgaaaaagtaaaatttcaatcctattatagtcttatttttaacatttagatattatgatgttaatgcggaagtatggtaatttcaatcctattatagtcttatttttaacattcctgcatatagtacaattactggagttaaatttcaatcctattatagtcttatttttaacatcgcagtgcttgtagcaattattggtttcgtatatttcaatcctattatagtcttatttttaacaagtagtgttgaatttacatggtacaagtaatacatttcaatcctattatagtcttatttttaacaggccacattttttctcaaaacgggcaaaaccaatttataatttatttattcatgcacttaaatttgttgattataaaaaatgttttttatttatatgtatcaacaaagaagacaaaataattgaaaataaaaaataaaacttagaaatttataaaataaaatatcaacctatttaaaagagaagtatcccatttaaataaataaaacttaaaaaaataatcaaaaaataaaattttttaaatagctaaaaaataatcaaaaaataaaacatgtgataaacaaagcttttaaaatttattttatcaaatttaacagtttaaataaaattaaaaatatcaaatttataaaatttcatcgataggtgctttttcaatacctaaaacctcacgattcatcacatcagccattcttaatttataaattataactgaatcaacctctgtatcaattattttcattaaaccatcatgaattatcttaaactcgctttcactagcttctccttcaaaaacagaattttgaatccaaaagaggtactgccttaaaaatgactttactttattgacccgctcaaccttaatatcataaactataattacatacataaagtcaccaccagcttacgaatggatcatatttttcaatgcctaaaatatgttttttaagtttatatgcttctaatcggattaatctttggtaagaaacatttttctttaattttttatgtttaatcgttttttcaagtcgtttattgtattcttttatgaatttatttcgtcctttatcatttaaaagacaacagtttaaatcttcattaaaatcttttttagacaacattcttttgttaaccatataaaaaatcaacctatcaacaaaaatcggcttaaaaatttcactaagatccaaagatagtgaaaatcttctttcagaaggttcatgaagataagatattgtaggatttaattgtgtattatacaattctgtcaaaactgtagaatacatcattgaatttccaaagctaattaaagaatttatcatatttttaggaggttgtctggatctgccttccattttaaaatcatcgggaagaatttcatcaaatttagaataatattccgagcgaatcctaccttcaatattcattatttcagttattttatttgttgaatttaactctgataatgtttctttaatattgttttcaattttataatatgctaaaacctttaaaatattatttgctgctccttcaacaaataatttagctaactccaaccttttttgaatatttaaataataatctgcctgttttactaacaaatcaccagacaataatgtttcacgaggataataagatccgctataaaaaccataataattgaaaaaatgaataggaactccatttttagataaaagactcattacctgtgaagaaaatgttatctgaccatatgcataaattgaatatactttattgattgggattggttttttacctttttcattgacaaaataaatagtattttctttccttttaagaatcccttcagacaggatataataattcttttttgacattttaaaaaacacctctatgaaaaacaaaactcaaaataagcacatttactgcaaattcttttctttttaggttttggcatcgaactatcaacaatatttttgatattgtcaattatttcaaataaatctcgctctttttcttttgttaaagtaattttcttctttttgcgactatctggataatttaaaaaacctacaacattttttatatctttttcatgttttaaataaaacatataatataaaagttgatattcattagctaaattcattttttgtgacttttttacttcatgaatttcaacagaatcagttattttaataaaatctacattaattaagttatcaataagaaaatctttttctcttttaaaactagtttcatgtaaaaatttacctaacttgacattctcatgctcatcttctaattggatattatgagaaaataaccatagtttagttttacatatgaaatagtaattaatttgagttccattaattttagaaatcataaaattcatttataaaattgtggattcttcatccgaaagttttaatcccaattccgaatcatattttacatcgataaagtaagtattgctattacaatcaaattcaacattattatccttttgaagtttaaaaaattgacctttactaattgacaaacaataactcatagatttataatatcgtttattatttatttcatccaaatattcttccctaaatttttgaggaacaacctcataagaatcaaaaagattataaaaatcattatctttattaaaatttataaaagggacaatattttttaataacctgttaaaagagagttttacttcatcaaaagtttcttgattttttgaatcataaccctcactgtatacatgatcaataatctcttgaattttactttctggtaaaatatcaaaattatttaaaacatctaatgttttattaaccaaattttgattataaatatatttatcattatcagaccctattttaaaaatattaacctgtttaataatatcatctttccatcctctgcgattaaccctaccaaatctttgaattaatgcatccaatggagctggctcagaatataaaacatcataatcaatatctaaagaaacttcaatagcttgagtacctattaacagatttaaattatctaaatttttttctattctttccctatcttttaatataaatctactatgtaataatgcagaattatccacatccttttccttaaaccattcataaataaattgggctttatccacagtattgcagacaatcaatacttttttaccagaatttatatcatttaatattttatcgcaacaattctcaatacaattattaattatattaactttatggcgagtaaatgaatctaattcttttgaatctaaagatatgaaattagaaatatccaattccttagaaaaaagattttttaaaaaagacggaagtgtagcagacatgataaaaatatctacatcaaatttactttttaaaattttaagagattctaataacaaacaagtgactctagcatcatatgcatgaatttcatctaaaattaataaactgtttgttaattcagataatcccatttcaaaacctttaactccaaaaaagaatttaataagttgaaaaggtgttaaaattttataaggcctatatattttctttgttaaattttgaattcttttagtttcaaagttagactcatcataatctccagactcaacagatttataaataaaataagatgctttaccatgagaaatgcctactaattcatcagagcccaaatctttgactaatctattatacatagcatttatgcttgcagtaaacggcaaaacataaaaaatccttttagaaaaattatcagtctgattattatccgcccataaaaaagaagcttctgttttaccactaccagttggggctattaagaaactacttccttttgttttagaagctatcagttgtgtttttcttaatgaatcaaaagtatataaatctccattttttactgctgaaagtatttcatatttagatcctgaagctaaataatcacaagcattcataaaaccttttaaaaaataaccataaataccatgtaattcattataattacctatcttaaaatctttaaaataattaagcactgtttgattataaacacttcttaaatcttcaaaagaaatattattaggcgtttttaatttatatcccaaatatttttcgctcaattttggaactaaatttaaataagatattaactcatcaaaattaggttttaactcaaataatttttcgtcaaaaacacgtttagcttctttattttttatttgataatctttccttaactttttaacatctttatggtgagttataattgttaaaccaattgcatttattgtaacttctggaaaaatatcatttaaagaaataataaaacatgcagatagtatttcatgcctatatccccaataattatttgaatttaaagaattttgaaaacctactgctgctttaccaaaatcgtggaaaaataaaatataaaaaagatgttcccaaaaatcaggaacaccacatattttaggaacatcaggataacattctttaatacatttaaaaacttttaaagtattttccgtatgctccattaatgtttcattaggtttagctaaaataaccataatataacctacttatgaatccaaactccccaatttaactcagaatcaaaataacaatcaccagaataatcaaaaaattgattcatcaatagatatggtttggttccaattgcttttctaggaattgaatctgaaaaatgtgtaggtaatgcttgaataattccaaatgcaccttcaataccaaatggtaaaattgttttacctaacttaacattattctttttttccatcttaatttctttaatttcactaataatagctaaatctgaagatcttccaagtaaaattggatatgttggatttttaaaatattttttaaatttcaaatcatcagtatataaatataaactaggattaaatagaaactctcttttagctacattagatttgtttccttttaatccttttaattcataaattgtctctaaatctactgcttttgcatcataatcaaaaacaaaaccaacatttgtttcatcaggagtaactaactcccctttagcagcagacaataatccataaattgtacttaaaggaggaactggcaatgttggctgaaatccacttataaatgcaggatatctaaatgaagcagtccacccctcaattaaaatccttaaatatttcatttaaatcaacttaggaatttcatcagaaaatttatcagttatctctttaatagttccaatatgaacattttctttatttttagcatattcaattattttatcttgagtatcttttaaaaatcctgttctaacaccaatgaaaatatctgatttaataatatcagaataatctgaaattacttcatctaaagcattcaaatcaaatataagttctcctttttcttcacggacaatattcatgaaaatatgattcccaccatcaatagcagcaagaactattatttttggagttacatctgttaaatgggatgcggatttagctcctccagacaaataaggtaatgcattaataatatcttgtgtacgtttaattctaatgtctttatccattatccatttatcttcttcgtgttccaatcctttttcttcagctaatttcaataaatcagcagacatatttttatatcctgttttttcactttcggaaaatattccaacagcccctaaatcaattgaaaaaataccttttaaaatatttgaataaaattcatgttcataaggaacaggatctccttcatgacgagacattactccaaaatcttcagttggattctgaccaattactgcaattagaggtgaattttttaaaggagaaattcttgtaacagttcctccttcttttttagacatagccctcatatatccaaaaacatcatcatcaggatattcaataggattagcacttgtgaacgcaatctttttttcacgactaataggagacatttcccaatcaaatttatcttccaaagtttctctccaccaataccttaaagcttgaccagaaacataaggatacctagtcattccttttctaatagttttaactctaacaatattatctgttctatctccagcatcagatcctgcattattaagcgcagaatgaggtgcatcaattaacattaaacctacaacattatttgtcatttttattcctccaataattcttcttctgaaacttcttcaacaaaatcattttcaaccatccaatcatgcaagttttcatatattctaaaaagcaacaaatcttgagtttctctccaagttaaattaccttcaggaaataaattaactacataatcatcaaaagtaaataataattcattatcatctttaattttacttttaagaatttttcttaaaacattcctaaaattattatatgaagatgcattctccaaactagataatgtttttttactatcattaatttcaatatattttgataatttatctccaacagtttttattgcatcaattcttttttcatccatttttctaacctctcttatatatgcattaactaatttccatgaacaataagtttttttatatttaaaattgtaaaagtactttaaaatagatttattcaataataaattgttataaacaacatttggtttgtttttgtaataataattttttttatccttgttaaaagtttcttttttatcccatttaacaaattgatatccttttttaagaataaaattccaattatgtttatcttctaatggaatatctactaaaaaattaaacacctccataggcaatgtataaatttcaagttctggtccttgattataattagtaaaataataaaaattcaaagatggattttcatcttcccacaaatcagataaagaaatcacttttataataatttcaaaaattgcattgactggtcttgtaattccatcattacagcaacccgtgtaatctttcaatgctatttgattatccacattttgaatcgtttctttagcccataaactcattactaattctgaatcagaatgcaataaaataaattttcctccacatgtatacattaataatggagaaaattgagttaaaatagcacataatgaacaataatctgctccatcattagcaaatgaaaaataattttttaaagatccagatccagttaatggaattgtactttttccaaacacattaactgaatttcttctaccacaacctatacaagaaccttcatcttgaatatcttgaatattttcaatttcacattttaaatcatcaaaatatttttctgaacgatttcctttaatggcattattaactaaagaagaatttggaaaaatactatacatatttttattccaagcatcattaagataaagtttagaaatgaattttgcttcattctcaatatcttcaatcgtgatattgttgattgatttatctagcatacctttaagtgcaaaaatacctgcatcaataaaaggattcccagttatttttaaatctaaatttttagacatgctttttctccttattaaatttatttatcctaaaatagactgattttaagaatatgttcattttttcaatcacaaaatgtacttattatacaatttaatattttgtaactccaactatttaaaagtaacctaatgaacatatacttagtaaaattattaatgaaagataataacttgttaataaataatattataatcaaatatttataaatatatctattttaatcttaaaaaataaaaaacaatctctaaaatattataaataatgttcaaaattgattttaaattcaaaaacaaaagatactttaattatccaaaataaataaaaatattaatgagactcgaaattatcttaaaaggaaaaaacaactttaaagttccatttaattacaatcatattttatcagccattatttataataaaatagctgatttgaattttgccaatgaattgcactcatcaaaatcatttaaattttttactttttctcaaatttatattcctaaaagaagaatagttaaagatggaataatagctaaagacggagttattagtttttatatatcttcacctaatgattttttaattaaaagtcttgttgacggatttcttgaagatttagaaataagctttcaaaaccaaaaattaacaattcaaaaaattgaagcattaaaaacccctgaattttcatctaaaagtgaatttaaaaccttggcaccaataattgtcagaactaaaaaagaaattaatggtgaacttaaaatttgggatcttgcaccttcagataagtttttcaaatcattggaaaataatttaataaaaaaatatattaaatttaataatttaacaaaaactgataaaaaaatcaatatatattcagatatgaattttgtaaaaagaaaacgaatttcaataaacaaaggcaatgctacaactcatcacagagcttatatgatggatcttattttagagggtgacctggacctgattgaatttgcttatgatgtcggaataggtgagaaaaattcaatgggctttggaatgattaaattattggaataaattaataaaaataaaaaaaagagttaagagaagatttctcctaactgattgtaattttatttccaatttgataactgttccatattgaagtgatgatatattctcccctgagaagtcggatatttaaacttgcaacaccattatctgctgttgttttattgtaaaatactccgtttacattgaatatcactgtctgattagctaagggttttccctgaccgtcaagaacagttgcattaaacttactgccgtccttaaacttcatggacaaatcatcagtaagcagaacacttttaacaaccacattgtttcccacatcatatccttcatatattgcagttacaatatattttccgggattcaaattgatgtttagtgttactgtaccattttcatcaactgtccttttatagaataccccgtttatgttaaatgttacatttttaccaatagctaagcttccgtctttatcatagacttttgctgtgtattgtgtgctgtttttataatatttaactatatcatggttttcacagataagagctttgacagttatgttgaaaccttttttctcattgtttacagggttgtatgccgttaaaatgtaggttccgggtcttaagttaatgtttaattttgcataacctgaatcatcagtgtttcttgtgtaaaacacaccattgatattgaatgtaactgcccttttagctaaagggtttcctgaactatcaatgaattttgcataaaactgggtttcatttctgaacatctttacaatatcatttcctgagatagtttcatatacttttacattggcttttttggaatcactgccgaaacgtccattataacttactttggcaagatattcaccagaatccagattaatggccagtgaagcagtgcccttatcatcactaacttttttataatcaacaccattgatattaataataacattttcaccaacaataggattgccattaacatcctttaagcatatgctaaacctttcaggacctctataatatttgtttacgtcatctgcacaaagtacagcaccataatcatttgcaaataatttatcgcttccgacaaaattgttgtccagtgaatggtataaatcaaactgtcctgatttaagtgccttaagagaaattgtgatgtaattattcatatcacagtcatttaaattccaaactacaatacggccagaatccaatctgtaatttcccctagatacacttgcattattaaaatcaaatccttcaggaagagcaaactgaactacagggcttgaatgagcaatatagttaacctgatatttcaactcaatattatctccaacaggacatgagctgacgggagtcagtaatctgaaaacttcaatactgttttcaaaaacatgagttcccaaaaatagtttatctctagctaatggaagggaatttcttgaatggaaattactgaagtaataaacattatctgccatattggatgttgagcggccaacacctctaccgtcatcatttgatgcataggaatctactccataggacagtccattagaagaagcagtcagcttccagtgataagtcattatatttctcctattgacaccatagctgtcagtataaacttttttaatggctgcatcaaccggattcagactgctgtcataactgcctttttgagacatggaataaatattaggacataaaacatactgtccaggctgcagtttagaaacatgatacaaattactgaaaacaacaccataggttccgtcagctgccttaattacaaaatgacctaaagaatatctggacattatcttataaattcttgaaagataatcatttgtaatctgattggtgacaaccatttcagaagctatgctttcaatctggcgaaatacagaaccgtctgttacaccaccattaccaataagccagccattggatgtgacaattgcatgtgaaaaataacccccgctggttttatattgcttcagataaccaatatctccccagctaccgctttcaatataaatatcagcggcatttgcagcatcacgcctgatacaaataactccttcattatcacttacctgaagaacagctgaactgcattcacttaaattaatcaaatcatcagcagtctgacctgtgtcctgccttactccaccatctgcatagtgttctgcatcagtgttagtatccaacaccacattatcattaaatgacaattcatttaaatcctgactagctacagcatcatcctgcgcactgactgaagttatagctatcagaaaaacaaaaaaaactaaaataaaatactttttattgaacatgaattcacctgtaacctattaattaacagatatttaatgattgtatgttaaaatataaacatttttatgaaattcagatgtgtttttagaatataaatcagtatacggattcaactaaaaaacagaaaatatccgaaaactaaaaaattcaactgtggtttttttataatttcatgcataaaaatagcttttttaatgatcattaaataagatttaaaaataataattgcgatttagcggatttgatgatgaatggatagaagattattttattaatttttattatttttctaactataattgtatcaattttgatttcaattatcgttattattaaatatagaaataaggatattggtattcaaatttccgctttgattctaatttcagtagctagtcaatttgtatcaggaaatgctccgtcttcaataatgttttatccagaatatcccggcagatactggataattttcaatggaattttaatgattataataggattactgatttatgatttattggaaaactgggaattttcaataaataaacttcaaaagtaatgcatatctaaaacaattatattttttagttttaaaagattaatatgactagccatattaccacaacaatacccaaattatttttaatatttattgtgctctttatatacaagttactgttaatttccaagaaaataataagagcaatccattaatagcaatgaaaaaatagctaatcttaaaaaataaaaaaagctgatttgagtagttaaacccaaaccacaaataaattataattttctttttctagatccgacaaatattacacttaaaatacataagagcaacattacaagtggatttcctgtattcggtaagtttacagatttgccacattcattatctgaagatgaaccatctggatgaacctgtttatccggaccgatcggagctgcttttttaaggactttaacagttacattgtcgtagttgttttccatgattacttcgaaggtttcgcttgttacattgacatgtactgttgaattgccttcgtttaatgctttagctacaaatgttaatacgactttttcaccatttgttaagtttcctatagaccagttgcccgaagttatgtcaaatgttccttttgttgcattatatgagagaatgcttaatgcatttggtattaatatattagcaatagtatttattgcatcgcttggtccattatttatgacagtaacagtgtagacaacattgtctccaacatatatttcggatttgtcagcaactatgtgtatttccagatcaacaatatctccggattctatagtgcagttggaagttttgtttccaacatttacagtatttgtaatatttcctgatttgtttacacatacatcagcagtcaaatcaacagttgaattagctgtgatgtttaaaatccatgtaataattccagtaacagggtcatatactccgccgtttgaagcattgatgaattttaatccttcaggaagaatatctctaattacaacatttgttgcattgatttttccagggttggaaactgtaatagtgtaggttatttcatctccaatatgaatatcagaggaattaacttcttttacagtgattatttcaggaactgttatgtttctgacagctgttttattaccaacagcaacagtgttaggtaaaacaccataacctaaaacagtaacatttacattgaatgttttggtttcgcctttagctaaatcaacaatccaggtaattatgcctgttttttcatcatatgtgaagtttccagttgcatttaagaatttcaatcctttatctaaaacatctgtaataactacattgttagcatcaccgataccatcattagtaacagtaacagtgtaggttacattatcaccgaaattaggaatttcgttgtcaactgttttgtccggattgatttcaggaacagtcacattaacaccagcagtcttattaccaacaactaaagagttagtaacatttccataacctacaacagtagcaatcacactaaatactttactttcacctttagccaaatcaacaatccaagtaacagtacgtgtagcttcatcaaaggagtaattaccagttgctgaaacaaatttaagaccttcacctaaaacatcacgaacaacaacatccttagcatcaccgataccatcattagtaacagtaacagtataatttacattgtccccaaagttaggattggaaatattagcagtcttatcaggaataatctcaggaacagtcacattaacaccggttgttttattaccaacaactaaagagttagtaacatttccataacctacaacagtagcaatcacactaaatactttactttcacctttagccaaatcaacaatccaagtaacagtacgtgtagcttcatcaaaggagtaattaccagtagcatcaacgaaagttaaaccttcacctaaaacatcacgaacaacaacatccttagcatcaccaattccatcattagtaacagtaacagtataatctaccttatcaccgaaattaggattagtaatattagctgttttatcaggattaatctcaggaacagtcacattaacaccggttgttttattaccaacaactaaagagttagtaacatttccataacctgaaacaatagcattaacatagaaagttctgctttcacctttagccaaatcaacaatccaagtaacagtacgtgtagcttcatcaaatgtgtaattaccagtagcatcaacaaaagttaaaccttcacctaaaatatctttaacaacaacattattagcatcaccaattccatcattagtaacttttacagtgtaggttacattatcaccgaaattaggattttcaatacctacagtcttatctggaatgatttcaggaacagtcacattaacagaaatggttttattaccaacaactaaagagttagtaacatttccataacctgaaacagtagcaatcacactaaatactttactttcacctttagccaaatcaacaatccaggtaacagtacgttttacaggatcccaaacaccattatcagaagcacttacaaaggtcaaaccttcaccaagcatatcaacaataacaacattattagcatcccccataccatcattagtaacagtaacagtataatctaccttatcaccgaaattaggattagtaatattagctgttttatcaggaataatttcaggaacaacaacatcagcagaagcagtgttatccccaacagttacatcattgattaaaacaccataagcttcagcaacagcagtcacatagaaagtttgagactcacctttagccaaatcaataatccatgtaacagtatgactatcttcatcaaaagtatactcgccagtagctttaacaaatttcaatcctttatcaagaatatccttaacaacaacctgtttagcatcaacaacaccattatttgtaacaacaacagtataagttacagtatcgccgaaattaggattttcaacatcaacagacttacccggaataatttcaggtactgtaatgttttttgtagctgatttgtttcctacaactactgtgttatttatgtttccatatgcttctacagcagcatttacactaaataccgcactttcaccagcacccaaatcaataatccaggtaatggttcttgtagattcatcatatttgccgttatggcttgcattaatgaattttaaacctttgccaagagtatcaactatgacaacttgttttgcatctttattagcattattgttaacagttatagtgtattccactttatctccaaagttaggagttgtattgttaacatccttagcaggaatgatttcaggtatatctacagttacagcagctgttttattacctacagttacttcattggttacatctgtgtatccgacgattttagcaacaacagtaaatgttttagtttctccagaagccaggtcaactttccaggtaattgtattggttttattatcatagttaccagtagaactgacatattctaaacctttgccaagagcatcaacaataattacatcattagcgtttccattaccttcgtttttaacagtaactgtataagttaaatcatctccgaagttagggttttcattgtctactgttttgtctggagtgatttcaggtacggttacatttttattgaatgttttgttaccgacaactaaagagttggttacattaccatagttgataacagtagctacaacagtaaatgtttctgttttacctgcatctacatcaacagtccatgtaatagtattggtagcttcatcaaaggtataagtaccggtagctgaaacaaatttaagatctttacctaaaacatcacgaacaacaactgctttagcatctgcatttccgtcattagtgactgttacagtataagttacattgtcaccaaagttaggattttcaatgtctgcagttttgttaggaataatttcaggaacatttacatctacagaagcgcttttatctccaacagatacaatgttggttaaaacaccatactcatcagcaacagcagttacagtcaaatcaagagaactgcctgcagcaatatcaactacccatgtaacagtatgagaagcttcatcataaacaccattatgagaagaactgacatatttcaatccattatccaaacggtctacaacaactacatgtttagcatctgctttgccgatgttattaacagtaattgtgtaatctatgctatcaccaaagttaggatacttattgtccgcatctttacttgggataatttccggaacatcaacatctacagcagaggttttattacctacaactaaagagttggttacattcccgtatccaattactttagcaactactttaaatgattttgtttcccctgaatttagattaacagtccatgtaatagtgcgggtaatcggattatatactcctccgtctgctgaaataagttctaaaccttcacctaaaacatcacgaacagctacattgacagcattggatttgccgacatttgtaatgttaacagtgtatgttacttcatcaccaaagttaggattttcaatgtctgcagttttgttgggaataatttcaggtactgtaatgtttacagaacttgttttatttccgacagttacattgttggttaaaacaccgtaatcttcaacaataaccttaatagttaaatcaacatgacctttagcattaacatctacaatccaggttacagtacgggtaagttcatcataaacaccaccataattagcttcaatgaacttgaaaccaggagcaagaatatcttttacaacaacattcttagcatcagcagcaccatcgttagaaacaacaatagtataagttacattgtcgccaaaattagggtttttgttatctacagttttatttggagtaatttcaggaacattaacgtttattttagaagttttattgcctacagctaaagagttggttacattaccataccctaccacagtagctacaacatttaatgttttggttttgcctgcagccaaatcaacaatccaagtaacagtgttggttttttcatcccaaacaccaccatctgaagaactgacatatttaaggccgttacctaattggtcaacaatgacaacctgactagcatccacatcaccgtcattagtaacagtaacagtgtaggttacattgtcaccaaagttagcatcagttacattagctgttttatcagggataatttccggaactgcaatatctacagaacttgttttatctccaacagtcaccctgttaactaaaacaccgtaatcttccacagtaacatttacttttaattctacagttttacctgaatcaatatccaaagtccatgttacagtatgtgtattttcatcataaacaccattgtaattagctccaaggaatttaagacctttcgcaagagtatctgttattacaacttgttttgcatcactaatgccgtcattagaaacaacaatagtataagctacattttcaccgaagttaggagttgtattgttaacatcttttttaggagtaatttcaggtacatccacatttttaaagattgttttatttccaacaacaactttgttagatatatttccatagcctgaaacagtagcttcaacagtaaatgtttttacttcgtttttagctaaatcaacaatccatgtaatagtatgggtaatcggatcatattgaccgttatcactaatatcagtaacggttaatccgttcccaacaacatccttaacaataacattattagcttcaaattcgccattggtaacagtgacagtatatgatactttatcaccgaagttaggtgaatcattatcaatagttttatcaggagtaatttcaggaacagttacatttcttataacagtattgtctccaacagtaactgtattgtttaaaacaccataagcatctacagtagcatatacatagaatgttaagttttgacctacagctaaaccatcaatattccatgtaacagtacgtgtggtagaatcatattcataattaccactagcaccagtaaatatcaaacctttatcaagaatatctgttaaagttacatcagcagtaatcttaccgacattacttaccactatagtatatttaactttatcaccatagttagggtttgtaacatttacatcttttgtaggaactaccttaggcagttcttgtatgtatatggttttagtagctacattgttacttatgttagtatcttcagtactgtttactgcattaacagtcagagtaacagtacctaaactggtagtttttgttttaactttaagagtaacaacttcatttttggctaattttcctactttccatatacctgtagctgcatcaaaagtaccttttgaaggagtaaaaccaacaatatcctcaagtttaattccatttacataacaattattgtcagtatgcggaccatggttagttaaactgatagtccattcaacttcctcgtccaatccataataatttttatcagttgtaatatcaacatccaaatcaacaaaaccaactacttcaaaattagtttcatttttgatagctttatagaagagatcttcagggtgttctgctttaatggtataattacccggagcaagaccgcttaatgaaaacctgacatcaccataaattgaagagattaaagtttcattgtaaataatgtttccgtcttcattataaataacaatcggattgattgactgagtattttcacgttcatccctatagattaaagtaccgtttttactgttttccacaccatcaaccggatgaatttcatctgctcctgttgttctgttcatgattgttccgtttacattaaataagtaagttacattatcaaatgaaatatcattaagctgacctacatgatgtattgcatttgcaatattgtttccaccaataatcactacagtaacattaacagttactccataaggagttttcggattttgaacaataataggcaatacataagtgtaagcctggtttctgtaaaatacaatatttttaagagaagctacaccgtctacaaataaagcagaaccgttaacagctgtattatatctgaatattgcattatcataagttacattattacccatagtatatatagctccacctaaaccagtatttaaatcattgttaaatggattagcatggttggagtagaactgtgaattggttacttttatatgacttcctattacacatatagctcctgcatcaccttctacagtgttatttgcaaagtaagaactgtctatattaacattatttccactgattcctaaagctcctgcttgagattttgaaacaccatcagaaatagctttatttcctataaaagtagcgttcaaaacattaacagaacttccttccaccctcacagcacctgcgaagtgtgcagaattatttacaaatgttgcattttgaattttaacattatttccttttacataaatagctccggcatggtttttagcagagttatttccaaaattagaatttaaaaccgtgattccatcatcaacaacataaacagctccaccatcatcagcagctttatttgatatgaatgtggagttatctacagttatatcgttaccgtgagtagtaatagcaccaccgataggtgcagcgtttccttcaaaataagaatttgaaatttttaccttttgacctgtagtaccgtcatatccggtagagattgcaccaccaaaaccggttgcagtgttgttaataaatatacaatctttcaattcaccgcttgcatggaaagtggtagccgctcccctatatgcaatattgcctataaaagtacagttataaacagtacttccaggtctgaaacaaagtgcaccggcatgagagttattaacatccgaatttgcctgattatattcgaatgtacaattagaaactgtacccaatacatgtaatgcagcaccaaaggcatttccatttgttgatgtggcataattgttcataaatttagtgttacttactttattgctgctggaaccaacaattgtaattccaatagccattgcccctatagaagaaacataattatcacgaacaatacagtcagtcattgacccgtcaaaacttgcagttctgacaacataactatttgttacagtattgtaagtactggtagctttattgttaaccaaagtacaacgagataatgttactgtattttctgaatataatgcagaatgaacatctcctcttgagctagatgatgcttcacagttactgataacacagttttccaaaacaagattagaacctgaactgtaaacaccagcaccatttgcatcacgtcctgaatatttaccattagttattataatgttcttcaaagttatgctgctggctccaatgttaaacacacgggaacttgattttgcatctaatgtagacatttcattaccggttccacctttgtttggattaatagaaccgtcaatagtaatctcatctttattagaaaaccatccgccagctacagaaatctcactgccggatcctgtgaacgtgtgattgtttaaataaattgtatcaccagactgagcctgatttattccattctgaacatcgctaaatgttccatcattatttatatcaatgtctgctgcagaactagctccaattattaataagaataataaagccgatccaacaacagcaaatatctttttaaccattttatcaacgcaccaattatagaattcaaaaaattttctcatgtaaattattatgtgaacatgaaaattctacaggattatatttggaacatatgatgtatatatgtttctattcagctatacaaaatattataattaaaaaaattaattatatgaaacattataaataacctcaattaattaaacaatatataatttccccccccccccaaatatgacaaaaataccatacataatcagttttaactatatattattcaaagtaacaataatatttaaattatgttataactaaaaaatatgaaaaataattatgaaatgtttaacaaaaaaaaataatgtatataaaattcgttcagaatattaagtttacctaataatccataaattataccataattaattaaataattgattaacaaaaataaagttgaggaataatatgaataaacaaagaaaatacaaacaacgaactctggaagttcatgcaggtgaaaaagtggaccctgttaccggagccagagctacacctatatatcataccagctcatatgcttttgaaagtgctgaaaaagctaaaaaattatatgctcttgaagaagaaggttatctatacaccagaatatccaatccaacattggatgttttggaaaaaagagtggctgcaattgaaggaggtgttggagctctttcacagtcaaccggtatgagtgcaattttactgtctattttaaatatagccaattcaggagatgaaattgtagcatcaaataacctttacggaggtacatttacattatttaaaaataccatgcctaactggggaatcaaagtaaatttcgtacctacccatgatctggaagcttatgaaaatgcaattaatgaaaataccaaagcaatttactgcgaatctataggaaatccgaaattaaacattcctgattttgaaaaaatagctaaaatagcacacaaacatgatttgcctttgattgttgacaatacttcagctattacaatggtgaggcctctggaacacggtgcagacattgttgttcattccgccaccaaatttttatcaggaaccggaaccagtatgggtggagttattgttgacggcggtactttcaactgggcaaacggcaagtttccacagtttactacacctgatccggcatatcacggtttaatttatagtgaagcatttggaaacaaagcatatatcaccaaagcccgtgtgcatttaatgaaggatttgggaactgttttaagtcctattaatgcatttttaatcctgcaaagtattgaatcactatcactaagagttaaccagcactgcaagaatgctttagaaatagctaaattcctgaaaaatcatgaagctgtttcctgggttaattatccgggtcttgaagataatgaaaaccatgaaatggctgaaaaatacttaaacggcaattacggtggaattgttggttttggaattaaaggtggtttggaagaaggtaagaagtttattgaaagtgttgagcttttaagtcatgtggctaatatcggtgatgcaaaatctctagttatccatcctgccagcactacccattccaacatgactgaagaagaacagcttgaagggggaatcactcctgactttatcagaatgtctgttggtattgaggatgctgaagatttaatagctgatattgaccaggcattaaaaaaagcagttagctagaaaggatttttacctttctacctatattctgatactaaatgacttatttgatcagtagagattattccttttaatttaaagtcatcatctacaacaggaagacatgaaatatccaattttctcattctgcgtgctgttgattcaatagaatcgtctgcatgacagaatttaactgtttttgtcattatttcttttaaatcattggaatttgtagctattgctttagacaaatcccagctagttacgattccaatcagctttttgccatttgtaacaacaggaatatgtgtaacattaagattaaacattaatttagcggcttcctctatctgtgcctgttcggtaattgtaactacatcagtaatcatcaagtcttcaactatgttgtctgacaagaattttgataaaatatagttaagctgacctttttcaagtaaaaatgcatcatgaccataattagatttaagttctgaaaagcttacctcaacatcatttgcattaagtgctgtcaggatttctgttccctgttcaacaggatatagccagtctgaatccactgaaataatttccacttttgcctttacatctttaagtccgtcaatcagagagttgttttgggcaaggtcaaataaatccactgcttttgtaatatagagataactgtttgcatcaaaacgttttacaaaacttgctccctgatggtgcaggtagctttcaacctggaaatccattgacaaatcatatgtaatttcatctttatcctgcagatccctaccaaatttaagatacattgattcatcacttaaataagtaatatgagctatcatacgggctacagacaacccttcttttggaattttgtcagttccataatagtttccaccgttccagttcggatcgcctactattgattggcggcccacttcattaaatgctatttgctgcggtgaagatcttgctgttgtagctattgcaactgcttttttcatcatttcaggatatgaaacaatccactgcagggtttgcattcctcccattgaacctccaacaactgctgccagtttatcaattccaaatgcatcaaccagtttcttttgaacatttaccatgtcctttattgtaataaccggaaaatctataccatattccttaccagtttttggattgattgatgatgggcctgttgttcctttacatcctcccaatacattagaacagattataaagtacttttcactatccagagcttttccgggacctattactatttcccaccatccaggttttttatctccttcatgccatcctgcagcatgtgcatctccggataatgcatgacatattaaaattgcattgtccttttccctgttaagctcaccataagtttcataagctactgtgatgttatcaagagtctttccactttctagttcaattggctcttcaatattataatactttgtttgaacaactccaactgattcttttttcatttaaaacacctaatatttctgtattttcagttttttcatagcctgttttgaagcagcctgttcagcttcttttttgtttttacctttaccaacacccatttcctttccgtcaatcaatatagagattataaatgttttattatgaggcacaccgcattcatcaattattttatattcaatatccacttcctgggcatccccgtattcttttattactgatttataatcaaagaaaaacactttttttgcatcgatgtatgggaatattatttttgaaatgtaatcctttgcaaattctataccctgatccaagaatattgctcctaaaaatgattcaaaaacatctgcggtaattgacaaaacctcattttcagttattttgctgtcatcaccatatattttgatatgcttatccaaacccagttcatgtgaataataaattaatgctgtttgacaaacataatttgctcgcagtttagttaatttaccttcttcataatccggatactgtttatataaatattctgaaacaatcatgttcaaaacagagtcacctaaaaactccaatctttcatatgtataatctaaaccatgttttgttccataagacccgtgagtaaatgcaacatcatatagatgcctgtcctttgggagtatgttaaatttttctaataaattcataataaagaccaaatttctttaaatatgttaatacactttgtttttaggcttatataaatttatagttgtaaaaagaagtatatataactatcgttataaaaattattatttttcaaatgctcttgctttctttttataagccaaaaataaccaatattagaaataacaggatttggtaatcatgaaattaaactggttcgaagaaataaaaagaatagaccctgacataaaattcagagcacagggcggatggttaaaaactgttgaaaaactagataaaaccgttaaaaacggatattcacttgttggagactttgtaaaagcaggagactttgaagaggaatatgatgaaggcttataccttgactgcaataaagaaggaagtaccaaaaaatcccagcaggactacagactattccgttttaaagatggaaaagtaagacttctggatatggtaattgacggttcacaaggatgggctactgaattgtgggatgccgtagaagatgaagttccaagtgtaatcgaataattttctcaatcaagagaagatatatgtggatttaaatactgtccgtgattttgagttttgttatcatattgaattgcaaacttagggcacaaatgaagacacctcaaacacataacacactcatttttaacccataccggttttttcatttgtaaatcaatagccttaaccggacagctttttctacacaatcctcatccaacacatttatcatcaacatttaaatgactggtttttctataagatgtggtaatttttctaaagatatcacagacaaacttaggcaattttcttttaacgaaatctcccggttcttttctttcaattttagaaattacatccccaatctgtttatcagattttaaagttttcttattaatcttatcttcattcgacagattaaaaaccggcgtccaggtatcaaccatcagaatactgaatttggcagatacattaaagcctttagattcaattaaatcagcaagataaccgcagcagtacccaggacttgatccgaaagtagcaattaaaaaaatgtaaggatttttatcttcagattttatatctgttctgacaaaaactccgtgacaaatgcaggaagaccccaaaaatgaacaggaactacaatacctaaagactcgcctttttttaaataaatggaataatcatgtccaatcatagacactgcaatatctcgtgttttatcggctattttctttgcaacgtatttgcagtttccggttgcagaataatagattatcatattatttggatttttgatttactttaggtacaaacctggaagaccttttaggaatagtatattcatcttttttagggcatttgtactcttccaaaagtattatcttatggtcaatatttttgctgaaattcttttgacccccttcaataatacctctgaaatttactccaacacttcctgttcctccaatattaaattttattttttcggaaggaggaaaattttcaaagaacctttcaagttcaattatttcataaattggagcctgataactaactgccattactttattttgcccttctctgattttaacatatttctgttcaatttgcagtctttcaccagaacgaactttagtcaatgttatataaggacttatatcagtatcatccatcttttacacctgtttattttatataatgaaacacacagctatcgcagacaggttcttcataagtatctttagggatagtgacagcaggatctaccataacagttattgaaaatgtttcttcaggattatgtgttacatttttagaaatcggcagcattcccctgtagtttacaggaatatatcctgtctgactgatattgtaatagattctttcaccggaagttaaggaatcaaaaaactcgttaacctcttttagctgtttaggatttatagtaaatgttatacccatcaaatgatcttgcctttgtttaatctttacatatttaacattagctgccaatactttctgattatctgttacaaaggttacatattcatccaagtttatgttttctttttcaacaatctcctttaattgagtcataactgaaacctccatgaaatttaatgaaataacatgctcattggatgactttattaaataacttatttataaatgtaacgatttattaggtatgccaaaatattggcaaatatcaaaaattacgcaatatcttcaattgaatcaaaaaacaggaaaaatccaataaaacagctgaataagtttttataaaaatagaaaaaatagaattgatgaagattaaataaataatcttccgcttttaccaacttaaactaatctttttctagtggttggttttttgttttgccagctgtatcttctaatccttttagatttaccgaatccacaggaagcacaaacttttttatgaatgtggtaagtgtttcttccacatcttctgcatcttatatgggtctttttattctttttacccattgatggagtaccttttgacactgatacacctcctaattaatcagttcgtttattacaaatattagaattaaaatagtacttatggtgagatatagacaatattgtctcctctaatgagcacaacaccaagtcttctagtaacttctccgtcttggagttcttctgcatcattaagaactaagttcatatgtaaatcaaaacttttaagtattcctctaaattcacgatctcctttaagttttattaaaacaggggagtttacagatttgcctaaagcatcaagtggcctttgaacattttgtccgctcattttatcaccttatattactataattttttattgtattttataatttaaaagcaattaatgataatcacttttttaaatattagacataatataatcaagtttagataagacaaaacctaattaaaactaatattaaattatatgcttctactactatataaatgtttagtttgttttaagaccaaaactaatataaatcactgaattaacagtaatttacactatataagacatctaactttattttaaacaaagttattaaaaaatttaactgatttcattttaaaaaactgcatttcatcattttctaaaaaggcaaattccaatcatccagccagcccccaaaaaaatattttacagacataatatgcaccatataaattattaaagaaaattcagcatctgaaaaacaaatcagtgcagtcaaatcactttttaaaattaaatttgaattttgtaaccaaagaatataataaataaaaatcagataataaatcatatcaaaattaaggtatggaaaaaatatgactataaaagttaaaaaaagaaactttctgaaaaaaaagaaaattaaagaaatcaaaaaagaattgggagaatatggtgaactgctccaaaataagaaaaatgtggaaatacttgaagccgaacctgattcatttattttagttgatggtgaaccttacatcatattaattgatgaaaagccatttccaaccttaaaagctgcactggctaatgaaatccatggaaaaaaagtaacagtggacatgggtgcaattcgctttgtaagtaatggtgccgatattatgagtcctggaattgtagctgctgatgagaatataaatcctgaagatattgttctaatcattgatgaaacacatggaaaaccattagctattggaataagcttaattactggagaagaaatggttgaaaatgattctggtaaagctattgaaacaaaacattatgttggagacgacatttggaactttgaattataatttggtgatttaaatggcagaattaagatacagagcaggaaaaattaaaaatccaagagttcacaaaatcggagtgatagctcttgggtcacatctggaaaatcacggtcctgcattacctatagatactgatgccaaaatcggtgcacacattgcatttcaggcatcacttgaaagcggagctaaatttttaggaatagtatttcctgcttatgaattagatgaaatagatcatggagtgcatgtttctttagatgaattaaaggcaaatgtaatcagcacccttaattctgcgaaaaaatatctggatattgaaaaagtggttattgtaaattcacacgggggaaatattcctctgatgactgaactctatgacattgaagacaaaacagatctgactattatctttaataacaagattatttcaacagaaggtcctcacggaggcagcggtgagctttcaatggcaaaggttttgggaataattaacgaagctgaaattgaaaaccagacagatttaagtaaatatgaagaagttggtctatatggttttaaacaagctcgtgaaaatgatcctaacattgaagaaggtgcaagagatgttgaagaaaacggagtttatgttgatgaagtctatggaaaacaactctttgatttagctattaactctgttgtatttgatattgaaaagcttttagatttttaaaaaaaaataaaatttaaggagttcttcctgcaccaccctcctcagttccagaagtacctccacttgaatcatcgtgagtacctccgtcaggattatgttcaggagtgcttggagaatcatgattatatccggaatcctgactttgagatgaagttgattcagaaccacttgatgaagaatagctgtaatcatttccggaatcgtcagctgatgaatcacttacagaaacatcatcagtactgttatctgatgaattcagcaaatctgtttcatttggtaaaatgtttatttctccagtcatagctgcaaaaacactagctatacaaaatgctccaacagctattacaaaaaccaccaataatgtagctgatttacttgacaaaataccaccttaatattgttaatttaattaacttaaattatgtctgcaagaatatataaaagtatttgatattatgaaaactattgaaaaagctgttcaaagtgaaataaatattaaaaaatcccagtttatctgctctttatttccaaccaaaagcaaaaaggaaagcaaagagattattcagaagttaaatcagcagtatcatgatgccacccataactgtacagcatatattacaaatgacggtgagggatatgacgacaacggcgaacctggcggaactgcaggcaaacctatgattaatgcattaaggaaaaatgatttgcataatgttacagcagttgttacaagatattttggaggaatcaaacttggagctggaggtttggttcgtgcatacagcaaatcagttcttgaagctattgaagctagtgaaataattgaagttgaatattatgatgtttacaatattacatttgattattctgatttaaaggatattgaaagagaaatcagaaacagcaaattaacaatcattcaaaaagattttggtgaaaaaattagctatgatttagtttccaaaaacaataagaatataaaagaaatatttgaaaaattccacaataagattaaggttaattttaaaaataagcaggttttaaaaaagataaaatgaagaataaataattattgttcttcaaattggtcttttcctacaccacaaagaggacatacccagtcatcaggtaagtcttcaaaatcgtcgccttcgtaaacatatccacatactttacatacataagccataataactcctccttaaataatttagaatcaatttcttttgtccaaacctacaactgtttaaacaaagctttgccggcaccacatcttgggcatttaaagtcatcaggtaaatcttcaaattctgtacctgcttcaatgcctttttctggtatgcctttttcactgtcgtaaatatatccacatacactacatttccatttagacataatatctcctttctaaaatttattcctatttaaattatttaatttaaacaattatttatcttattaaaactagtatataatcctttcgaaatttgttcgaaaatatgcaaactataatttgtttggaactttcaaatggtcaggaagaggcttgattcttgcaggagttccaatagccaaataaaacggaggaacactgtgaataacaatggctcctgcagctacaatagatccctcaccgatttcaacattggataaaaatgtagtgttgccaccaatagaagctccccttcttattttaggcccctgcaattcataattaattcttacaggatacttatcattagtaaaacaggcacaaggtccgataaaaacattatcttcaattactgaattggtaggaatataaacattagactgaatgctgacgtcatttccgattataacctcaccttcaattacagtgtttgttccgattaaaacatcatccccaatatttgtattctcacgaataacaacattatgacctgttctgaaattatccccaattacaacatcattatagataattgaattggaacgaattgtatgatttcttccaataaccggaggtctggagtccggagaatattctacaccgaatcttatattgtcctcaggtagaaaggtaggtgtttctacattttttactcgattatcacccaatcctcctaaaaacttaaccattttatcgcaccttcatttaatttaaaaatatgatatctgttaaactatatttaataatatcttagtatatattatttactagacaatcaagaaaaatattgcaaatttggtgaaaaacttgtatactaaagaaaaactgacagaagaaataaatcaggtaagaaaacagataggtcatgaagagcttgaaatccatattgaagacatttactacaacgaaaaggaaaacgaattatggataataacccaggacagacctgacaaatctgcaattatcggaaaaggcggatgggtagttggaaagctaagagaaaaattaaaaataaacagcatccatgtggaaagctacggagattacctgaccaaggaatacaaacttaaactttccaaaaaaacattggatgaatttaactctgatttaacaggaatccagaacctgaaaaaaattctaagctccaaattagaaaacatctacagctttgactataacagctattttgaaagcaatgtatttaaagaatctgaaaaaacagaagcagtagttgccctgtccggtggagttgacagcagtttttcattaattttagcaaaatacctgggattcaatcccacagcggttacaattgatccgggaactattattttaccaaatcagtataaaagaaacatcaaaaaattaactgaccagctgaatgcaggtcatgaatatataaaagcagattacagtgaaataatcagggaatccctaaacggaagattccatccctgcggaagatgctccaaacatactgaagaactaataaatcaatatgcaataaacaataatatcccaatagtcatatttggagatatgctctcaacaggaacacaatgcataaccccgcaggaaaaaggcctgtaccgccttaacttacctgcaagtttagctgttggaaaacaggaaaacaaatccctaacacagcaatttgatttgcagtcatttagcggattcggatgccctctgttatacgaagtccatagaaaatacccatatttaaaaaaatactccattcaaagaatattacgggaaacaaggtcttcagctctggaagtaggggaagctcttgatttgatatggagtttctacaatacaaaagattaaatagagcataggtaaaattaatgaatatgttatttaaaatctgcccacgttgtggatcaaaaaaagtaaaatggattattcctcaaaactggtcaacctgggaatgctatgactgtgattacacaggtccgattatagaaggtaatgaggagttatctgaggaaatacgtgaagcctatcttgaatcacaaaaacatcctcaagaaaacacagatgaagatgaagaattggaaaaggattaaattccttttttctcaaattcttcatttaaaaattctttaatattgtctctagctatttcaaccatagcaggagaaggaccacccggaacagttctcattttaacattttctaaaggatttaaagctttctgaaccaaatcatcttcaagacctaatttttcaaaaccaagttctgaagctatatcatcaatatattctgatgtaatgtctgcttcttttaatccgctggcagtagcttcattgactattctgcctacaattttatgagctgtcctaaatggaatctgtttttcacgaaccataatatctgccaaatcagtagctgtagcaaaattagttccggctaactccaaacatctgtcttccttaaatttaacagaaagcaacatttttgtaactattgataaagtgtcttgagttactttaactgcattccataagtgaggagtgatttcctgcaagtctctattataggtgtaaggaattgcttttaaaatagttaaaatagttacaagttcaccgttgacaattgttgattttgctcttgcaagttcagcaacatcaggatttttcttttgaggcataatagatgatgtagatgaatattcatcagccatttctataataccgaattcataagtactccataaaataagttcttcacagattttggataatgttgtacataatgcagataaatcaaaaactgtttctgaaatgaaatcccttgaagaaacaccatccattgagttttcaagataagcatcaaaaccaagcaaatcagtggttaactgtctgttgatcgggaaactggttgtagtcatagctgctgaacctaaaggatttaaattgacacgtttataagtatcttccaaacgttcataatctcttttaagtgcctgtacatgagccatcaaatgatgagctattgtaattggctgtgcatgctgaagatgagtataacctataaaaacagtttccaaatgctcacctgctttttcaaccagcccttccataaattccaaaataccgatttgggtttcggtaattttatcacgaagaaccagtctgacatcagtagctacctggtcgttacgtgatttggctgtatgcataaaacctgcagttggacctattttatcagtaacataattttcaatagccatgtgaatatcttcaacagaagggtcgaaaacaagctcattatagccatcttcttttaactggtcaagagcacctaaaatattatctgctatttcatcatcaataatattttcttcttttaacatcaaagtatgtgcaaaattggttttaatatcagcttcaaaaataattttatcaaattcaagtgatgaagtatattcagcggcttcatcagtcatttctgttttaagtctaccacttcttaaattcacaagactcccttcttaaaaataaattttataaaaaaaatagttaaaaaaaagattgtttaatcttttttcatttcagtgtatccacatttaccgcatgcgtatctattaccatgatcagccataaatacaccgtcagaacaacgaggacaaactgggttttttctttcgattttatctccgtctactttgtaaagatcagatttttttaccattagaatcaccttattcttcgtcttcttcagcttcttcagaagcttcagtatttttagctattacacttttagtttcaatgtattctaaatcttctacagtttcgtaaactttagcataacctaatgctttaggttcaccgtagtgaggttgtacattatctacaacagtagattcttttttagaatttaataaagctactaatttacttttgatatcggtaatttttggagtagcttctccttcatattcaacatagaattttatttctcttctgttaaaaactttattttccttatcttcaaaaatatcaatttccataattaaccctcttttattctttaataaaggtatcaataagattttgagcataatctttagcatcacaaacttttaaaagtaccaaaccttcatttggttgaccgtacaagatagtagtctcatcactagccattaagatgcaaggaagaactgcaagatcttcttccccgtctacttcaattacatgacaatttccatcaccagataacttcatagcttggcctatggtttcccatagatcatctgtaatggtccctgcagggtttttagcttttaaaatattttctgccttgataacttcatgattatgattttttctttgaattaaattatcaattataccaatgtcaggatataattcatatttggtaagattattaaaagttgcatcaccaacagaaattaaaaactcagaagatttaatttcttcaatagcatcttcaaagtgaggatataatttacctaacggttttttaagctttgaaatagtatccttatttaattctgcatctaaacgtaacacaataaaaccttctaccttactcttaaacaatattcgccagctaaatctatatttaattcattagctaactcagattcttcaggttttgtaattattaaaagaccgctccagttatctgaagttgggttaccgcagactggacaacgttctttattagtaatatatttacaaactgtacatgcattcatgatttagccttcttatttttatttttagcttcttcaatccattcaaatctacctaaattattttgtctcatggtaagacctattttagtatttttggtagagttatctttaagactgatagctacaattcttgttctaactaaatctccttcatctaaagttttattagattcttttgcaaggagtgctcctcttttagaatcgtaattaatataatcatcagtgacttgggaaacatgaaccaaaccgtccataggtccaattctgacaaaagcaccaaattcagctatttctattacttcaccatcaataacttcttgctgttcaggtttgaagaatattgcattaaacacaacattatggtaagaagctccatctcccatgatgagtctaccttcaccaatttcttcaatttcattaacacaaataagtaaacctaattttttatctaaacggccgttatatgtatcatttaaagtttgaatagctacctcttcaagaggatcatcaaatctataaggtggtattcttacagtatcctcaattttagtcatgtaatacaaaacaatccctctattcgtatttttctttatacatttctaaagatcttaaaagttcttttttagctgactctttaccttcccagcctttagtttcaacaacttttccttcaagatttttataaactgagaaaaagtgttcaatttcttttaataaatgagatggaacatcactgatgtcttgaacatcactgaaacgtggatcgtcttcaggtacagctaagattttgtaatctttgtctccaccgtcaatcatacccataattccaataggtcttgcttcaataagacatcctgggaatgtaggttgttccataagaacaagaatatccatagggtcgccgtcatcatatgtagatttaggtataaaaccgtaatctgccggataaacaacaggagagtacaatactctatctaacatgaaagcttctctttccttatcatattcgtatttatttcttgaacctttaggcacttcaataactgctgttacaacatcaggaatatcagaacctgattcaatttcactccataaattcacttaaatcacctataattaattttatgataaattaataagtctaatttttatatttttccatcaatagctatatactttttctgtcttagatatgctactgttatacctttctttctagcacgtttttttaattcaatatcgtttgtagctaaaacttctgaaactctaagtaacgcatcatccacagtttcattattttctaatgaaatatcctttatttcaatgttggaagaattagctaactttagagctaaatctgcatttagcctaattttacctttattatttctttttaaacctttcaattcattaataacaaagatcggagtagttaacttatatgaaggcagtgctttttcaagttcatcgattatatcgacgttaaattgaaaaggaaccataaaaaaattggtatcaatcacaacttctttagactccattatttccctctatataataattccataaccaattaatctccaacgagctcccactctacggcttaaagctaccctagttccgggactggcacaaacaggcaatttaagagcaacttcaatattctttttcttagtagaagtaacaacaccaatagttgttgtagtaccacaattaatcattaaaggttctttaagtttaattggagctacatcacgttcttcttttgtacctactactctgtcaagtaaatgtgcttccattgtaaaactatctaaaacatcaggtaatgtatctactgctccagcaacagaacctgataatgaatcagctttagttaatgaagggtctaattttgtagctacaccaataagtcctccgggacctatttcttcaacgtcttttccattagcttcaagaccaataatttcggatttcaaggttattcttttattgttatttgtaattcccggccttatttcaatagtgtctccaagcttaaaagtaccctgaactaaagttccgccaataactccacctttgattttagcagcgccggaaccaggtttgttaatatcaaaagatcttgcaacatgcattaaaggagttttatccaaacttctttctggcggttggattcttttaagcatagcttcaattaaaatatccatatttgctccttgctgagcagatacaggtataattggagcatcttctgcacaagtaccttttacaaattctttaatttcatgataactttcaatagctctttcttttgaaacaatatcaattttattttgaactacaataacatctttaacaccaataacatcaagagccattaagtgttctttagtttgtggttgtgggcaatattcatttgcagcaattactaaaactgcaccatccattattgcagcaccagataacatagtcgccattaaggtttcgtgacctggagcatcaacaaatgatacttttctaactaattctgtctcgcttccacagttttcacaagttttagaagtagtataacacataggttcatcacaatctggacattttctgaattcaatgtctgcataacctaaacgaattgaaatacctctttttgtttcttcactgtgagtatcagtccatattcctgataatgctttggtaagagtagtcttaccgtgatccacatgaccaactaaacctatgtttacatctgactgtatgttcacagataaccacctttttattataattttaaatttaacttaaaagttaaaataagaaaaatagtaaaactattcttcttcctcttcatcgccaacaccaagaatatcagctatagctttacttccagctgaaacaacaacagtgttaacttgtacgatatcatcagcaatggtatttcctcttacggtttttctcctttttacaccgtcagatttaggatgataaccaataccaccacttaataaacttttgattcttctagtacctggtacatcttttttcatggtaaatccatttttatcagcaccaccagttacttttaaagtgtaaccgtctaaaccaacgattccaccatcaaattcatctccaataactaaaccgttaagagctttgccatcttcaacttcaatttgatgagttacctctttttgagatacaactactttgaatgccatggtattcctcctttaaattgttttataaaaaatattaattattattcaaaaagaccaaaacttccccaatcagaatcctgcttacgtttaatttccaaaaactcatataaggtttcaaattcatcttcagtcaatttatccttaaattccctttcaatgtatttgtaatgtttttcaggaatatcaacatataactcgtctccctcttcaaagtcttttccaactatagcatctttaatagccatagctaccctttgacctctggaaatatcaggtaatgtttcacccttatcttccatactagctattgaaccaacaacatgcccatctttattaatcaattgttgaccttgtttaagagttccgcttaaagattcaataccgataatagcaggtttactttgacggaacactaattttggaagtgaaacaaattttgcaggtttaattatagcatcataaaatgactttttcttatcttcttgcttttgcttgacccattcctcatactcttcaagaatctgataaattacatctcctgaaaagagcttgacttcagaattattaagatcttcttcagaatttggatgaacatccacattaaaagcaataattgctccgtgaagttcattttcatcataagcaattgaagaattaataatatccctacgatttacatcaccgatatcagctgcacgaattggaatatccatttcccttaatagcttaacaacagcttccagtgaaccaatagtatctgctttaactaaaataccttcatcttctgtatcaatagtaatgttgtcaatttcatttaaaatctcctgttcaacatcagtatcttcacttaaaactctaagaggagaacctgaaacaacatcatctaaatgaggtgcagctactttaatacctgccgctgcaacaacttcatctaattttctaaatttctttttagaatccctcatttcctcaagaggaagaggtcttaaaatagatctaattttagttaccaatacatcttctgaagataacattaaagctatttcatcattggttcttaaaacaccatcataaataatagcatcaagagtaactcccaaaccagtttcttccttaatttctaaaactgtacctttagctggagcattttcatcgatttcaagttgttcagttaaatattcttgagcaagccctaaaagcatagctaaaacttctataactccttcaccagttttagcactaatcggaataatactaatctgggaagcaaaattgcttactctgtcaaatctttcagactggaatccttccttgtgaagttcaccgacaatttcataaatcttattgtccaaatcctgctgaacacttttagcctgattggaaaatgtttccctaaaagaggcaccttcatgaacttcccaaccaaaaagcctatcgattttattagctacaacaataaatggagttttatacattttaagaatgtttaatgcttcataagtctgtggcttaaatccgtcattaacatctaaaatcaatacagccaaatcagctaatgcaccaccacgttttcttaaactagtaaatgcggcatgtccaggagtatcaatgaaaaacaaaccaggaattaaatctttaatagctaatttggatatgaaatctccacagatattttcaatggtatcattaggaatctcagtagcaccaatatgctgagtaatacctccagcttccttagctgcaatagtacttcctctaatataatccaataaagtggtcttaccgtggtctacatgtcctaaaactgatacaattggggatctgattttcatgttatcttaaataataattattcgtaaattaatttgttatcaacgatttcgtaatcgcaaatttcatcttcattaaagaataaattgatttctctttctgcagaatctggagagtcagaagcatgaataatgtttctaccagtgtccatagcaaaatctcctctaatagttccgaggtctgcttctaaaggattggttgctccaactaattttctgatagtactgatagcttcttctccttcaattaccatagcaagagatggggaagatgtaatgtattcaattaaactaccgaaaaatggtttatctgcatgttctccataatgagtttttgctaaatcttcatcaatttgcattaactttacagcaacgatttgaagacctttttcttcaaaacgggataatattttacccataagacgtctttgaactgcgtccggtttcatcattacaaaacttttttgaatcattctttaacccatttaacttttcttggaactctaccaagtttaatcatgtttttttcacatttactgctacaaaagaaataaatagaaccgtcttttttaacatacatttttccggtaccttcttctatttctttattacagaatgaacaagtcctcatgttcttacaccttcttaaggagttttaatttccttagcttctctaatagtatcaagtaacattaaaatgtccccttctcttacaggacccataatgtttcttgttaaaattcttcctttgtctctaccatcgaggattctgcatttaatttgcataacctctccagtcataccagttctttttaaaacattaatgacttcagcaggagtagcttcttccatataaatcaccttttaatcctcaaaaagaagatttattcttttaattctgcgattttttcaacaatttcagctacgtcgccttcagcatctccagcgtcaacaatacaagcggatgcggtaccgacagttaaacctgcagctccaccaacttgttctttagtaggtaagtaaatgtaaggaatttctttttcatcagcgagaacagggatgtgtgcaacaatttcagcaggatcaacatcttctgcgataacaacaagtgctgcgtctcctctttcgataaatttagttacttcgttagttccttttgctactttaccactgtcttgtgcggtttttaatgcttcttcagcttgattagctaattcttcaggtgtatcaaattttacataaattgcttttgccataatatatacctcctttttcatctggctatgccatccatcggcagatattataattccttgaattataatattcgtaattatatatagttatattattttaactatagaaattactcaaattattcaatgagcgaataattttatagtttttaataatactaattcttgaatacattcatatatcactaaatataatcccattaaataaaaaaaagagggattaaactttcaatacaaatacttctgaatttcatataatttttagcaaaactaaaaataaaaatttagtaattaatgaaataattctagagaactagacagtattaagtatgtttttattacatataaatgttttccatactttttcctaaaaataagtttactaagttaataatagtaagttatactttttaatacttttgaaaaaagctaatcataaagctgtcaaatactgcaatttcagattttaaaaatttttaatttaattttcacagacataagataacatttatatagagttatgaatatatattcataatacctaaagacatttggggatagaattatggtaagacctaaaagaatgagaagagtagttacatgtcacagacatgaattaaataaaaatctgaaaccgatagaactgtctgtagatgaatttgaagctatcagattcaaagattaccataacatcaaacagacagaatctgcagagttcatgggaatttcacaatcaacattccacagaattctaaattctgcaagacataaactgtctacttctttaattgaaggccgaccaatagttattgtcaaaggtgatacaatgattgatccaaataaatatttatgcgaagactgtggttttcaatggtcaaacccagaaaaagaatatggagaatgtccagactgcaaatcaaaaaatatccgtaaattaaatgcaaataataaaaataatgtatcagatgacacctgcagctgccctaattgcggttacagtgaagcaaaaattatgggagtgccctgcagaactaaaatatgtcccaaatgtggttcatcactacaaagaagattatgcaatatgcaataaggagataatttaaatggctgacaatttagaatatgtttgtaaagaatgtggcttcaattggataacattaaatggtgagcaccatatctgtccaaaatgccacagcgaaacaattgaatatattggtgaagtaaatgatttggatattgattccatattaaaccacaacaaaagaatgggtggatgctgcggttctgctcgtggaagaggacctttgacctgtggaaagccacatcctgaccaccacgatccaaataccccacacaaccctaaaaaatgctgtggccacagagtatgctaacataccagtttttatttattggagattaaaaaatggctgatattataatagacaataatgaatgtgataattgcggtgactgtgcagatgtttgtcctatggaagttttaattcttgaagatgaaaaattaactgtcaatgaacctgacgaatgcagttactgtgaaagctgtgtggacatatgtccaaatgaatgcatcacaatcgaataaactttaaaacttttctttttttatctatttttcacaaaatctcaccagattaacatgacttttttttacttcattatgtcttacaaaattatataaccgattaaatattaaattatacctacagatgtgattgtatgattttcgatgaagaattgacattgttaaaagaaaaaattgcaaatgccgaagatgtagatgaattaaattatataagaactactaaccaaaaaaaaatactggtggaccagcatatttattgcaggtttattttatggtttgaacggaaaagtgggaaaaatgattataacatggtttgttagtgttataaccttaggaatctatgcactatacatcatttatagaagctataaagatgaaaccgaattcaataatcaaatggaatattatatattacaaagaagcaaagaattaaaagggaaaatcaattcatctgaattaaaacttcctgaatccgacataaactgaatttgtcaaaaatacaaaaacacaatttataagtgtaaaacacccattgattcacagacacaggaaaaaaatatttttttcactttcctgtgtttttttatgaaacagatttttttattttaactgtctttagtattttcccaaataatctcagctagtgaaattaaatgaatttttcagtaacaaaaatatccctaaactttccaaatctaaaaaaagttaaggtatcaaattttcatgaaaaacatattttatttcttcctcaaattcttcaacaggaattatagtcatgtcaaaagttttactcaaaatatatgtagtgtttgggttaattacatcagttaaaaccaaaaatgaatgatttttatccaaatttaacatatttgccacatgagagtacttgttgatataatgctgataatttcctgtttttccttcaacccaatatatttcaccatttattaaaaaaacaacatccaattcaaaatcatttccatttggaagaataatctgaggattaattaaatatgtatattcaatagttgcaggtaatgactttaaggaatcctgtattgtttttcgaataaagatctccagccagtgcccggtaaggaagttaattgcaatcggaattttgtttggtgttgcatgaataaaatatctgggtgacttatcgtatttgtattctgataaaaatgctatatcataaagagtggtacacagctggcaggaagctgaaatttcgctttgtgttgcattctttaaatccaaatgaaatccattgggtttatttaaatgacgtttgatagtttcataaacttttctgatgtcattgtaccggtttcccataaaatatgcaacattgtcaagtgaagtgttttctgttatagaatcaacataggttttaacagtaatgtttttctcctgcagtttatcaatcagtatattgacatcaatttccttgacactgcaaccataatccatattttcattttcatttgtatcatcactagattcaacagccacatcaactttatcatcaacttcattatgtgcatttttttctaatgaatcagcaattctttctaatgataatgcaatgctttttaataacaaaaactcttcttcattcatacaatcaatatataattttagtaattaatattaatattattaactaatttccatgctgaatatttttttgcagacataacttcaaattaacaacaattaaattcttattttcaaggatagtacatctacaccaccataaatttgacagaataacaaattaatccaacgaaaatcataaaaaaaataattaatattgtatacaatttgtgtttttagatgaaaaaaataggtattcccttttaaaatcagttgaaattagaaaaaaagtacaaaaaataagacaatataataaaaaagaagatagcaattaaaaaattactatctaaaacagatacttaattaacaaatctatttgatagctaatttaatatcttctgctttaacggtttttctacctgcgtgacgtgcaaatccaacagctttttgagcgatttcgtttccacattcttcgatagcttcggttaaagcgatttttgcgtcatcactgactctttgagcgccagcgttttttaatatcctgcctacaggagcgattggtaattccataattaaacacctcatttttttatatagatagtttaaactttcccatatataaatatattggtatattttccttaaatttacaaaatttcaatacaataaagtgaattatcctatcattaaggtgctacttactgaaaagtgaaatgtttttcaaagagtaaccaaaataaaaaatcagatgaaaatatgaaaatataaagtatttataataaaattaaaaataaaaaaagagaaaaaagattaaaaatagctataaaactatttattcattaaaatttttcttaaagtgtcaatatctgcatccacttgttttggtttagtacatgcatcaattgcagtattcggatctttaagtaaatgaccggtaacaacacaggttacagtttctccattatctacaactccttcgtcacataattttttaagacctgcaattgaagctgcagaagccggttcaacacctattccctcttttctagctaataatttttgagcatccaatatctcttcatcacttacagtttcagaatatccgtcagactcataaatagcccttaaagctttaatgtcacttacaggagcacctatacgaattgcagtagctattgtttccggattttctactggaacaaccctatcagcatgttttttaaatgcatttgtaactggacatgcaccttcagcctgaattccggtcatcataggtacactatctacaaaacctgcttcgtaaaactctttaacacctttccagatagctgaaatatttcctgcatttccaacaggcagaataatcctgtctggagattgccatcctaaatcccttaatatttcatatccgattgttttttgaccttctaatctgtaagggttaattgagtttaataagtaaagatgtttttctaatgcaagagcagtcatagcttcaagtgcttcatcaaagtttccgttaatggacattacttcagcaccgtggaacatagcctgtgccaattttcctaaagctacttttccggaaggtaaaaatacaatacaacgtaaacctgctctagctgcatatgctgcaagagatgctgatgtatttcctgttgaagcacagccaacagtatgaactccaagttccatagctttggtcataccaacagtcattcccctgtccttgaaacttcctgtcggatttgacccttcaactttaacatataaattgatacctaattcatcccccaatttgtcgcatttgcaaaatggagttccaccttcgttgagtgaaacaattttagattcatcaacaggtatgcattctttaaatttccataaagtatcttttctgccgtcaaagatatctttagaaacatcaaaatcactaacaagttcgagaacagatccacatttttcacaagtgtaaattatctcatcattatcatattcttctccgcatgaaacacatctaatcataaaaaatcactacatattattttaataatcatcaatataaaaatttaaccaaaaattgaaagaataaaatttgcaataggtacagttaaataaacttcaataaccccagctattgccattaaaataactgccacaccaagtaaaaccaatgactgttttaatttatcataatttttctcaagtgagtataccagtttatccttaaaagtcaaattataaaatttatcttcaagttcaatatagtcaaaatctggctttgctatattatacaccagtctgaataaaaaatggaacagcacaaatccggatgcagtagctattatacatgatgaaaattcgaaaatcccgtgaggtataatgtataataaaaccctaaaaagattttgggaactggctatataataacctacaaaaaagccgttgtatgcaagaataactcctgaaaaacaaaagaatattccaagtacaaacattctgaaaacaattaaaatgttatttgtaaaaattgtctgaaatgttaaagttataacaccattttttacatcttcagttagcttatccacaacaggatcaaagatactttgcaaataaggctgcagaacataacctgcaattaatgtacctaataaaaggataattgaaatataaacagcagttttgttttctaaaaaagctgatttaatttcatttttaatatttaacattatatcagattattagctatttcacgagcttcatcctgtttgtcatgaatttcatcaaacatttcaacaatcaattcactggcttttgctttacagtctccacagcgtaaagacccgtccagacagtcatgacgtattttttcaagttctttgtcatcatcaatcaggtggtatacaaacatttcataaattacacagttatctacctgaccgcctaattcctgctgttcttttaagctttctctaccaccagttttagctgttttaacttttttagctgcagtttcactatcttcatttaaataaattgctgtagaaggtttgctgctgctcattttatctccgcttaaaccagtaaggaatctgtgataagtggaagacggagggatgaatccgtattcatcattaagtttgtgagctatatctcttgttaatcttatatgagggtcctgatctactccaacaggaactacaactcttttaggacctccaaattcttcaagctgcggaagcaaaatatccgccacctgaacaagaggtgcctgaatatgagcaatgtttgttgattgggtaaatccataaatagcttttaattcattgaaatttgtttttttagaagccttaaaagccaagtccctgagagtatcatttttggattgaagataaacattaacattatcctcttccaaatccagacctaatgcaatataattagttaaatattcattgacagctatatctcttgccttttcaaaactcatgtctctggcagcatatgattccaaatcagctattaaaatagataacattgcacctttgtcctgataccatttcaactggtcaacaaccattttatgaccaatatgcatttggccacttggcatcattccaccaacaactgcaaagtcctcttttttattaattaaattattgaccttatcaaagtccctatgtccaaaaattactcctcttttcattaatctgtgagggttttccacatcatcaatcaagtctgaaaatttttgaattccaaattgattgactaatttatcataatctacacttgatgatgcccatggatctatcaaataaatcaccttatctacagtaaatacattaaattaaatatataattaagaattataatggtaaatctaattacctataaaaatataaatcatttctttaattaaaacttatggtcttgtccattcaacattgtagtatgtaatatccaaatcgtcatctacaatagccagaagaagtttcttgttaacaccatgagaaactctaacataacttgagaaatccagtgcatcaatctcataagtttcataaataattttaacaagatagtcggaatgtccttttccaggacctcctccacgattatacaaacggaaatctgaaccatatttaaatccggttttaataacataaccacggtctttcaaatcacgaaaaacaatgtattttccataaatctccttatttttcaaaaggtcaataagataatccaaactgcatttgatttcatcttcataaacatccaaacgacctttctcatgtaaataacaagcttcaattaaagaaagattcaaagtatctgcttcaattttaccaaatagacttttttcatgtaaagctatcggtcttttactaccttcttcaatttttatagatacaatatcattagataaatttccgcgcattaaaacaccatcaaaagaaaaaaattatatttaatggagttatttatgattacagtattatatatacctttagaaaaaaaaagaaataagagctaaactcttataaaaatattatttgccatatcttttgacagttcaatgtttttatcaccaatagatattacaaaaacaccggaatcatcatgataatcgcgataataaatatctgacccaacagatatccccaaagcagaaattttatctaaaagttcagaatttccacgaataaaagatacaataccttcagtacttgagtttaattctgaaatagacaataaattaaatttcctgtttataacttgatcaaaatcttttactgagaaacattggctgcagttactgaattccaaatcacaagcaggaataagaccgtcgctaggacctaaatctggatgatgtaacattgtacaaagtgctctttcagcttcatcagataaagtatgttccatcttacaggcttgctcatggacattttcctgtttaatatttaaaacttcaattaaaaatttttcaagaatcctatgcttccttgttattttttgagcaattttcatcccttcatcagttaaagaagctcccttatacggaacataattaacataatttaatttttctaattttttaagcatttgagttacactaccaggtgcaatccctaattccttagataaagttgtagtagagatttgttctttattactaccattacgataaagaacttccaaatattcttcaatattttcactaattccatcatttgccataagatttcacctagattaaacaattatatattggaattaagagtataaaaagtttgggatagcctaaatataatagtgaaaaataaattttaaaaataaaaaaagaagtattaactcaaaaaattgagttaataaggtaaaacatcataagttcctctgtcagtgtaagaattagtgttccaattcttgattacacctaaagagtttctggtacttgttggatcagcaacaacccattttccatctatgtaaaattgaacccatacatgaccaacatttaaaccacttgtaaatgaacagtatccagtagcaaatctggcagtcaaaccaacagacctggccattgccactaataactgtgcttggtcacaacagtttccataacctttgattaaagtaccttcagcaccgtaaacagtattgaaatatgaactataacttattttatctcttacaaatttaaataaagcatcagccttatcccttgtagagtttatgcctttgaccaattcttttgctttatcagcaaccaatgctgaagctccggaacctccagtattattgatcaatacgaaattaggtaatgttttactgttgtccgcataataagccaatattcttgaaaatgcatccaataaatcagcatagcttattttacctgcacttgaagatgcataattcggagcctgtccgttactaatgatatactgggaaactctagatgcaacatccaaatattcagttttattaatgttggttgatattttgtcaccatttggagtacctggactggaagctccaacaacagtaatatttcccaaattaccgtcattaatattaccaatagctttactcatcaagtataagaattgagataaagtgtactgttcatcgtttacaattacataatcgggcaatgcattatttgcctgaatatgtgcttttaaaaccttagcagcatccaatatagcatctatagatatgttatctcccacttcacctgaagattctggaatactttcagttaatctggtcaacactctggtagaagatgaaagtttctcattaccagaaacaccacagtaatcacagtcacagtatgcacaggtaagttctccttctgcagtacctttaggattaaccagcaaagttccgtaataaccgcagttagggcagtaatttaaccagacagtagtatataacacattaggtttgtaagatgtgcctcctacacttactttcattgtaacagttaaagagtaattgtccaataaatttgtaacaaatacaaagttaggaagtgcactgttggattgataataggataataccctcgcatatgcataaatcaatgattcatatttgatatcacctaaagtacttgaaacattacctggagctataccatttgcagacatataactagacaatgttttagccaatgatacaaattcagattttaccaactgcttattgattacatcaccagaagttttagatgaagcattgactaaaatagctgtaatcgcttttaaattaccgttagctattccttcagtagccttagtcatcaagtataaaaactgaggtacagtataattgaaattgccaacagttacaaacttaggcaatacccctttatcttcaatatactttttcaaagatgctgaagcagccaaaatggaatttatagatacagaatcaccataagatggagtgatttcatgagtgtttaatttattgaaatcaatgaagttagataaaccccatctaaacatcataacaccctttgcaccggcatcatatgctgtttgagcatcttttgacagttctgaaactggcagttttgtaatgtcattatcagatacatatgtttgtaaacctacccaaactgctgctccattggaagtttcaacaaaccattgagtaattgatgaaatccagctggttcctgaattataatttcctttataaaccataggaactataatatccagatatttgctgataaccgcaatatcctgaccatatacatatgcatcatttttttcaggcattactgctgcagaaattaaacagttaggattaacaccacgtatagcagttgtagctaattttacaaattcacttatagctgcagttccgccaggatgtttatatgcagtacctggatatcttaagtaatcaaagtgaacacctgctactcctggaagtgcagcatattttttagcttcagctattctctcattgaataaagcagtgttgatggatccgtcactatttaatggggaaagccatcctccgtcataaaatacctgcatccaaatatgaactttaataccatgagaattagcctgtttaatccatgacaatacactggattctccgtatttagtaaatgcatagaaatttaagaaaatattacctgttcctgaagctgctaaaccaaccaaatccacattgtacatgttagctccctgaacccagtatccatttccattattaatatatttggttattacaattgaactgctgccttcacagcctaaattttcattattgcctgcaaatttatatgatatttcatatgtacctacagttaccaattttatacttaaactggcaattccattagcatcagttgtgctggtataatctataccgttaactgtgaatataactttttcattagctataggactgccgtcactatttttaagtaaaactttaaattcttcagttgaattttgagtaaatactgtacttccattaacaacaaataatgaattttttctgtctacaacagtacagtatgctttaccattacttggagctaatttggaatctccgttaaatgaataagttacaagataagtacctgcatccaaacgaatagttaaactggcaacaccattattatcagtaattctagtataacttacaccattcacactaatagttacagtcttattaattaaaggaactccacctgcagttaatgtaacattgaactgctgatatgcatctttacctacagtaatatcactaccctgaataactgttgcattagtagttattacagataccatagtagagcctgtagattttttgtaacctgtatcatttaatgtatatgaaatgttgtatacattaggatccaatctaagacttatgctagcaacaccatttttatcagttaccattacataattaataccgtttatattaaatagaacagttttattgactactaaattaccgtcttcatcttttactaaaactgaaaacaaatcagttttaaataccacattattttcaggtatgaaaattacatccttaccttcataaacagaaatagtatttgatgcacttgatgccaaatatcccccattcttattaaaggtataagttgcagtataattacctggagtagtcaatttaatattatatttagctataccattatcatcagtagtacttgtatatgtaacaccacctaccttaagattaacagtctgattacttacagtatgattaaactgatcatacaatacaatacttacaacattaccttcaccagatatgaaatcataatgttgtgttttgataacagtactgacagaatcaacaactgtaacagcgaaacctacatcatatccatcaagtggattatatgcagttaatatatattttccagggaatagtttaatgttaagtttagctacaccattgttatcagtaacacgattataaaatacaccattaatattaaacttaacagtagtattaactaaaggagtgccatcattatgtaagaaagtagcataaaactgatttttatccaaatataatttatttaaatcttcagctacaactgtaggcaataccttaacagtatttccacattcataaccgtcattaggattatatgcagttaatatataagtgtcaggacgaagcttgatacctaaactagctacacctttatcatcagtaacacgactataaaataccccattaatattaaacctaacagtagcatttattaaaggattaccacggccgtctaaaaaagtggcatgatatgaagtcccgtctttatagatcattacaatatcctcaccttttatagttggcagtacattaatatctgaagtaatgctagccggagcatattcagttgttcctttgtaactcacagtaacatgatacaaaccagagtataaatttatacctatagaagttgaaccattttcatcagtaatcttattataagtaacaccattaattaggatacttacagtttgattagctaatccgtttccattttcatcagttaaattaatcatgaacctagtaccattcttataatacaattctatactaggtgcatctaaattaacagctttttgctggttgccatccccaattacattattgttattttcttcaataacattactactggagaaagaaacattactatttgattcatcaacagataatgaatcatcagcagctgttaatactgtagaatttgagtcaacagtatttgcatccattgcagagactgcactaactgacaaaaatacagtcagaatcatcaatgcaaagatcattacacgttttttcaaaatcacttacctccattataaatttaatttaactataaattaaaaaattattttcagtacttaattatattaagaatattgtatataaatctatttatttaataaaactgcttaaatagctttaatttaaaaaattaagcattaaaaccccagaatattaagaaattaataaaaattatattgatttaagagataataagttaaaattacaataagtaatcttttaagttttataagattatgaaattataaaagattataaaaatttcgtttaaagtaaaataaaataacaaacaagttataaaaaccaaaaagataaatttgaatggaattatagtaaaaaacaaacaagtaaatttagtaaattgaaaaataagcaataaaaataaaaaataaaaaaagatgtaaataattttacatcataggtggcattccacccatacctccaggcattccacccatcggaggcattccgctagcatcatttccggactcgtcaggacctgaagagtttaatgcatttctagctgcaatcatatcatcaatacgtaatatcatttcagcagcttcactagcagctttgatagcttgtgttttaatcctcagtggttcaataacacctgcttcttccatgtcaacaagtttgccggtaaatacattaataccgatttttgaagagtcttcatgagcagcttttaattctgcaattaaattaatggtatctaaaccagcattttcaattaaagttcttggaataacttcaactgcatttgcataagctaaaatagctaattgttctcttccacttacagattcaccatatgctcttaatccttttactaaatcaatttcacaagctcctccaccaatgagaactttgccgtcttcaatagtagctgctacaacacctaaagcatcatctaatgctctgctaatttgttcagttacataacgggtacttcccctaagtacaatggaagatgcttttggattttcacattcttcaatgaaagttaatttgtggtcgaatattttatcaacatatacatgacctgcagaacctaatttgtcagcagttaaatcttcaatatcagttacatactgagcaccggtagctttgttgattctttccatgtctgattttttaactcttttataagccatgattcctgctttgtttaagtagtgttgtgccatatcgtcaatacctttttgacagaacaatacatttgctccggatgcaacaactttatctactaaatctttaatcatttcttcttcattgtttaagaaagcttcaaattgtgcagggtctgtaatatcaattttagcatcagtgttgatttcttttaattcaataggatatttaattaaagcaattttagcatcttcaacatcagtaggcatgtttttagatactggatctttatccataacaataccttcagctaaaaaggaatcttcaactgaatctccggaaattctttggatattaatgttgtcaatatctatttcaccgtcttcggctattcttaaagctgcatctactactaaatcagctaatttatctttagcataatctgatcctttacctgtcatagcagtcatagctacttttttaagagtttccctatcatctgcatccatagctacattgtttaaaatttcaatagatttagctgctgcatttctgtaaccttttacaataacagaagttgcaattccatcttctaataattcttgagctttaactaataattcaccagctattacaacaacggaagtggttccgtctccaacaatgtcttcttgttttttagctgtttctacaagcattctagcagcaggttgagtgatatccatttctctcattatagttgcaccgtcattagtaacaataacatcacctaatgaatcagttaacattttgtccattcctttaggacctaaagtagttcttacaatatcttttaaaactttagctgctgtaatattcattcttaaagcatctcttttggaatacctttcagtaccttcaggaagaatgaatattggttgatttgccatcatatcaccttaattaataaatttctataaaaaaacaatataaaatcaaaaagttttatatattaataatgagtttgaggttatataaaaactttagcatattcaaaattgcataacatatatatatactataaaatgtaacatatacattacagaatgtaaaaattaatttacattaaaaaatgtgattattatgaaacttaagaaaatagttttaatattactattaacattagcactattttccatttcaaatgtaagtgcacaaaatattgatgttaatactacaaacaatattaatccattaaatgaagttttaatagatgaaacaatagccacatctaatgaacttacaaataaatcatctataatctcaaatgacttagagaaatattataaagatgataaaggattctgcgctacattttataatgaaaatggaactccactaactaataaaaatataacttttagtgttaatggagtaagttatattaaaacaactgacaataatggtaccgccaaattaaatattaatttagaatcaggtaactatacaataatatcatacaatccaatcaccaatgaaacaataactaataatataactgtcctatcaagtattaacggtagcgaccttacaaaatattttaaaaatgcaacacaatattcagttacattgtatgataaaactggaaaagctttagttaataaaaccgtacgtttcaatataaatggaatattctacgaacgtaaaaccaatgaaaaaggagtagcccagttaaatattaacctagatcctggaaactatattgtaacggtttacaacctgattacaggtgaagaaaaatccaataacattaatgtagtgtcaagaatacaactgctagatttaaataatgcatcaaatgtaatactgcctgaaggatatgttatacctgtaatgtttattggtaatggaaaggcttatgctcaatgcagagcaacaactcttgacgaaaaaggaaaccccttagctaatcaactagtaacatttaatataaatggaatcatttataaaggcactactgacaaatttggtataatcgatgccattatatatgttaatgcagattggggaaatacataccatatatgtactgcaacattcggagaatcatttgcttcccaaactgttatagttaaacgttttgttatgggttaactataaaataaaattaaattttgaaagtttataaaaactttcattcttatttttttaaaaaaaaaagtataaagacaaataaaaaaattattcatcttttaaagattgggctaattttttacctaaatcataacattgatctaaaacatcatcatcaggtatgaaaatagtgtcaaattgatcaacaatatcaaaaccagctgcttccaaatcagcactcatttttttattagctcctccaccccatcctttagaaccgaatactactgcttttttggtgtatcccgttgctttaaagttaagagcatccaaataataaataatgtctccaacacttggatatgccttgttcataatggtaggtgcacctaaacagattgctttactgtctaaaacatcagttacaacatcacttctgtcatcttcatgcaggaagtacattttaacttcaaatccttcagacataataccttctgcaatggatgctgccattttttgggttgaatgatgcatagtgtcataaattaaagttaccttatccttacatacaccgttagcccattcattatatttgttaataattaatgaaggatctttaaagatttgaccgtgagaaggtgcaatcatcttaactttactgactaaatccagatcagctaattctttcatcttattattatacattaaagaagagttaacaaccagattagcatagaacttttgtgcattatttaataggattgtttcttctacctcatcactaaacctttcactaaaacagatatgttgaccaaatgcatcattagagaataatattccgtcttcaactaataatgtaaacatgctgtccggccagtgaagcattggtgcatttacaaatgctaaagtttttccacctaaatctaaactgtctccagttcctacaacattaaaatcatagtcttttaaagatggtaaatgattttttaatccgtttacagccatctgtgaacaataaacttcaacatccgggaattttttaacaaattcaggaagggaaccgctgtgatcgttttcaatatggttttgaataattacatctattttaaattctcttccttcttgctggaatgcatcttttactctaccccataactgtgcagaggttccaggatatacgttatcaattaaagctactttatcttcaccaaataccaaataacaattgtatgtagttccatctaaactgtaaccgtgataatctcttaaatcccaatccaatacaccgacccaatatactccatcagtaattttagtagcatctgctttcataaaaaaatcacctaaatataaatttatcaagatatattctgttcgtaattatattaataattaatgggacattaacaaaacatccagaatgcacaaataaatatatatctaataatactatttaccttgattaaattaaaatggcaaataataaatagtaacataataacatatattatatatattgaaataataggtgatttacaatgtgttctacaggaggtccaatggcggacattgatttgaaaaaattaaaaacaaaaagatacagatgtttagattgtggaaacgatttcaaaggccttggcagaaaagtaatttgtccatcctgtcaaagcgacaatgttgaatgtaaagagtaagcttcaaacctgtttactctatttttattttttaggtggtactttgattattgagtttaataatgatgaaatcctatttctggaaggtgaaaccgggatggtaggaatcataaaagtagcctatgaaaataaaatgttatttatagctacacagaacaatgaagaaattgtccaatttttagaaaaagatgacttaatagctgtatctaactttaaaaaagacaagcgagctatccgctctcaggcatatttaacccgtgaagaaaattctccacttgtaattctaaacaaagaacatccctccaccaaacgactggagacagttttatctgtaggtgatagagtctgtctaaattgtaatatcactcctggaacacaccccgaacaggatgttttatgttcctgtgattcactatccggtttagaaatcagcaaaacagaaaccggaattaaattaaaccaatactttgacaaatacacaattgaaaaattttagattaaaatgaaacttttagaatttatttacacattacttggacagggaatagtctttataatcatactaattattatattatttataatagctattacccttggtaaaatcctgcttaaaaagaacataatcatatttccaaggtttattctttttgttgtagatgtattttactcacctttcaaaacaatagctagactgctgaaaatagacgatgatatgattgacagaatcagcattgaagtcagggatgatgtaaataaggaaaaattcaaaaaaatacctgctgaagaaactttaatctttttacctcactgtttaagacacagggactgtcaggctgcacttcaaaaagaaggagtaatctgtacagaatgcggcaaatgttccattggcgttatcaagaaaaaggcagacaaactgggatacagtttatatattgttcccggatcaagctttgttaaaaaaatagttaaagaaaacaacttcaaagcagttattggagtggcatgtcatgaagacttaaatcagatgatgatgctgctttctgattattgtcctcagggtgttttactttccaaaacaggatgttttgaaacaaaagtagatattaaaaaagtatttgaaaaattaaattccaaatactaatcatcataatattttataaagtccaaagattcatcagcctgactgaattcatcaataaagtcatgcaaatcctttataaattcttcttttcttttatctgaatctctgattttagaataatctttttttatagccaattccattataatatcatcagtttctaaagttaattctggataaaatatattttcatccatattatcctcttccaagttcctgatgagctctagctaaatgacctgctgcaagagcaccaactaaagataattctccagccaaaacagtagctgcaacaatttcaccaaattcacgagccttattggaacctgcaacaccaagaatatccaaaccctcatgagcagtttctaagcttgtacctccaccaacagtagctatcggtacatccggaaggtttactgagaaatacaaatctccgtttctgttttcagctgttgtaatacctaaagaaccttccactgcatgagctgcatcctgacctgttgccaaaaagatagctgcaaccatatttgcataatgagcattatatgccatagaacctgctgctgcagatcctattaaatttttagctatatttacttcttcaatagcttcagcagttgttttaagttttttatttactatttcttcaggaattaaaatatctgcaacaatactttttccccttccttcaatcatgttaattgccgcaggctttttatcaacacatacatttccgcttaatgcaatgtgtcttccagttgtttcatcagccaatttatctaaaatcttttctgaagcaatagtaaccatgttcatacccatactgtctccagtagagtaaacaaaacgtggataaacataagttccaacaattagaatcggatcaatttttaaaagcttaccatgagatgtggtggattctgcaatttctttaagttcttggaaattatcaataaaccattgtttaatttttaaagcatcacttgctgaagaggttttaattaccggtgctctggtcataatatctgaaataacatgagcatttactcctccagatgatgtaattgttgatgcacctctgttaattgatgctacaagtgctccttcagatgtagctaacggaacataaacctctcttttacagtaatctccgttgatttttaacggtccggctacacctacaggaagctggattgttccaattggattttcaatgtttcttgcagatgccctttccatgtctaaagaataattagccatatgcggtaattcacagcctgctgttttttctataaattcccttctaatatctgtagcctcttttggtgaaacatatttgtctacctggtataatttcatttcaccatttaacaatttatcaataatttctttagaattcatttaaattgacttccttactaaatctacaatttctgatggcattttagctacacttacaccggcatcagttaatgcattaattttactttctgcagtacctgaacttccatgaataatagctcctgcatgccccattcttttaccaggtggtgcggtcctacctgcgatatatgaaactaccggtttggagatattgtctttaataaattctgctgcattttcttcagcattacctccaatttcaccaattaaaacaatagcttcagtgtcatcatcttcttcaaattttttaagaatatcaatataatttgtaccgattacagggtctccacctatacctacacatgtactttgaccaattcctccacgggtaagctggctggctacttcgtatgttaaagttccgcttcttgaaattactccgacattaccttcttcaaaaatatgagtcggcataattcccagtttaccaacaccaggagttataattccaggagtgtttggacctataactgtagtgtccatttcacgagcataattcattatttttaaactgtcatgaacaggaatatgttctgaaataataacaaccaaatccaaatgtcttatagattcaaatgccgcatcttttgcaaattttgcaggtacaaaaataattgaagagttaacgccagtttcctcttttgcttcttcaattgaattgaaaacaggaacacctaaaaagtcttgacccccttttccaggagttacacctgccaaaatatttgtattatattccaacatttgttcggtgtgaaaagatccctgttttccggtaatcccctgaaccaaacattttgtatcattatctaataaaatcataaaacaaccacctttttaacgtaaaattcttgttttgttttcaaatggaactgccaaatcaattacatttccattcataaaagctgtagcagaaaatataacacttccaggcaatacattacagttagtgcctcttttaaccaaatacacatttttatttccaagtgctgctccaatcatcgcacctgctattacaccgacagattctatattttcaacagtagctactactacaggatcatcagtttccggtgaaacataacctacaccaggaatttttttggatttaggttctatcaaatcagaaacatcagtcatgtttttcattcctttagctgcttcaatagctgaattggcagcatttcctacaaacgattccccaccatatgtatcaaaacctaaaacaatagcatcaggatatctgtcttggcgaatgctagcttcagcataagatataccttcccctgcagtatccggactttgagatattcctgaaaggtcacctaaattttcagcattgtcctttaatatatttacaataccttcattaacactttcaagtaaatcgtcctctacaaatgcactaacaactacatcatcaccagttacatttgtcagggcagcatctctagcccctaaagctttaagtttgtaaaggtcggactcaatattttctactaatgtattactacaggacacgtcattcctagaaatgtctgcacctatagctgtaattttcaaaataacaccttttataattgattataaaaataaataaaataatttttattttattgttatatattatgtcttttatttaatatataatttaaggaacgaaagggctctttcaaaaacttgtgtgatttttttctttttcattgtttaaattccaataatttagttttagcatgaatctggctagaagtccttgttctattttcattgttctttttatgtgttttgggaatactttttggaagatattttcgattttattgtttgttgatgggatgttcgtgttttccaggtgtgtcgttaattttttgaagtaaggaatgatgaatttccaaagaattttgtttgtgaacttgttttttgtatattttttgtttattaattcgtttctaagttctttagcagtatttaagtcttttgcatccaatattttataaatgtcctgttttaaacaatttaatatgtctttttcgtcttcagataatggatttttgtcaaagtaatctttaaatcttttgtttactgcttgtttcacgtgaaatttgcagaaatggtgttttacttttaatttatcgatggcttcacgatattcgtgttttaagtctgtgcctattgatatttttttctgatttcttagagattcgtttaaaaattgataaatggtcttagaatcttctgattcgaccaatttaacggaaacgagagtattcaatttaacgtcgaataaggctaaaatatagttccattcaccattaattttaacccaaagactataaaataagtaatatccagaataagtccaattatcatagttaaattgataattagagttcaataagatgttttcaatgctttgatgtgagatttcaatgttatgttgttgttttaaatcaaatcgtattttatggagccctgctccataaatttgatataaattctcaatacattcaataacaggcaatgtaatatttgaatttgaataaacaagagataataaatcagtataaaagactttaccgcattttatgcacttatatttttgaatagtgcaaatttgttctccaattcttaaaaaaataagtttacgttcataagtaccatttttaacagcattatgtgatttacaagatggacaaattgcaactctattctcaaaatgtattttacctcttttttccaatctgataagattattctcaatattttcgcaaccaaatcgagaaagatcatcaaattgacggaattcagaaaactcaggaacaaaatcgaaaagtttaaattgttttgactccataaattcatatggagcttttattttgatactagacatattaatatattagctccacttaatatattaattttactgcttttaaattaaaaataaagaaaaaatagaacgaaaaaaattcgtgactcaaaaactagtgaaaattcaaatcacacaagtttttgaaagtgacaacgaaagttatttaaaaaaattaattaataacatcactcaaaaaatataattgatgtattcacaaactaaaatagcaataccaatttttcaagcaaaaaaagaagatgtaattaaagtagctgaagattgtattgaaaaaggtgctgatgtacttgaatttagaatagatgcactggacaatcctaactttgatgatattaaagaaatcattgaagagattaactttccaataatagctaccaacagaatttcatctgaaggcggttcctttaaaggatcagaagaagaaagaattgatattttattaaaatgtgctcctttagttgattatgtggatattgaacttcaaagtgatgacagatatataaaacagatacatgatactggagtaactaccattgtttcataccatgactttcataaaactcctgaaattaatgaaatcatgtatattgttgaaaaagaacaaaaacttggagatatcgctaaagtagcttttatgcctaatgatttggatgacactttaaaaatattggctattctttcacattgcgaaaatacaatagctatttcaatgagtgatttaggcagctacaccagagttatggcttccaaatttgattccccaattacttttgctgcaggacgagatgtgaccgccccggggcaaattgatattgaaaccatgaaatcattgcttaatatggatttgaatcttatggaataggtgattagaatggctaaaaaatgtattttagcttttattttaataattatcttagctatttttttaggaatatttttaacagaagataatgggtctgttgatgtttatatagatggagaaaatgtaactgcatcaacaaatccaggattaaacactgaaattaataccaaggaactgaatgatgaaatttgcaattattctcttgaatcaatgaatatgcccaataccaatataaataccctaaaatcaggaattcatgatatttgtttaagttatggtcttgatacatccaatattaatatcgattccactttaggtgaaaacagtattcctgttatttatcaggttgacggaacttcaatgcttccaacactgcaggacggacaaaatgttttagtcaataaaacacaggatgttcatgtcggagatattgtagttgccaattcttcagaatatggaaacattataaaaagagttgacgaagttaataacaatcagattcaccttgtaagtgacaacaaaaatatagaatacactcaaatcaatggagttatatatgaaacaaagggaataagtacatgggttgatttcagtgatatttatggcgtggttataaaatattaaaaaaaataaggatataaaaaaagagatgtgcctatacagcactgtctccttcttcacctgttctaatccttattacattgtcaattggataaatgaagattttaccgtcaccaatgttgcctgtttttgcacctttttgaatggctttaacaatagtatctacaccttcatcttttgtgacaatctcaatacgtgtttttggaattaagtcaatgcagtaactggatcccctgtaagattctttgatacctttttgactgcctcttcctttaatttcagaaacattcattccttgacagcccacggctgtaagttcatttttaacgtcctgatacttttcctgtctaataattgcaacaatacttttcatttttaaaccttctagttaaaattgtatgcagattcttcgtgaagttttgtatctaatcctacaacttcagcttcatcttctactctgataccgcccatagctttgtcaagtactttagctaatacatagcttattacaaatgcataaacaatagtagctactacacttattatttgtattacaacttgatatgggtttccatataataatcctgctgcttcattaatatatggtgctgcaaagataccagtagcgattgctccccatataccagacataccgtgtataccgaatacgtctaatgcatcgtcgtaaccgagttttgcttttaagtaataaattgcaaagtaagatactaaaggagctactgcaccaattactaatgctccaggaacatcaacaaatcctgctgcaggagtaatagctactaaaccagcaattcctccagagattgcaccaagaacagttggtttaccaacaacaattgtatctaatatagtccagacaattaaagctgctgcagctgcaacatttgaaacaataattgcatttgctgcaagaccatttgcacctaaaccggatcctccgttgaatcccatccatccgaaccatagaagtgctgcacctaatactgcatatcctaagttatgtggtaataatgaaatgtcttttcttttacctaatacaagtgcgatagctaatgcagaaacccctgagttaatgtgtacaacagtaccacctgcgaaatcaagtgctcccatattcattaaccatcctccaccccatacccagtgagcaatagggatatagacaagacaagcccaaatcgggataaaaattacccaagcttttgttttcattcttccaacaacaccaccagaaatcaatgctgctgttagacctgcaaatgcaagttggaacataacaaacaatagtgttggaatagttccgcttaaatcatcaagtccgattccacttaagaagaaattagaagggcttcctataaatcctcccagtaacggagttccaaaggcaaattgataaccgaaaataacccaaataacacttacaattgaaaatgcaataaaggttaaaaacatagtatttaaaacatttttacgtttacttaaaccaccataaaagaatgcaacagccggaatactcattaaaagtactaaaagactacaaacaagaacccaagctgtatcacctgcgctaaatatatccattatatcttttctctttttaaataaattaataacaataaatcaaaattattttttaaaatttttatgaattttgattaaacggaagtcggaagtcggaatccttcttccgatatatagtagttgaacttacagctatataaacatttcggtgaaacggatttacaaaaaaataggttattataaaaaaattcaataaaaaatattaataatatataaatatataaataaataacagttaatctttaaaattaaataaaagaaaaatctgaatttgtaaattcaaaaaggaaaaatgtgttattatgaaagggcaaacaaaagcaaaattaattgtgttttttattgttgcaattattgcatttgctgcaagttcaatggctgcaaatattattctgataaaaaatccgaatgacaataccctgctggctattgaagatgataatttcacacctcaaaaggtggattatgttcctacatatatcccggaacctaaaattattaatgatactaatctaactaataaaaccgactggataaataatgcaaatattacaaacattctaaataaaacaaaaggaaatttaagtaatttatggaatgaatattcacactggtgattataatgggtgaaaaaaagaaattcattagggatagtgtctatggagacattagcttaaataaatttgaacaaaaagtattggatatgcctcaattccaacgtttaagaagaattaaacaattaggattaattaacttaatttatcccggtgcaaaccacacccgttttgagcattcaatcggaacaatgaatcttggatccaaactggctaacgaactagaattaagtgaagatgaaattgaacttgttagaatctctgctctgcttcatgatgttggacatggtcccttttcacatgtgtctgaaggagtattgtcatttcctcatgaagaattaacaaaatatgttatttccaaaacatcaatgagagattaccttgaagaaaaattcgacattaaggaaataaataaaataatttccggagaagggaaactaggtccgattgtatccggagaattggatgtggacagaatggattatcttttaagagattcctataataccggagttgcctacggagtcattgattatgaaagaataatctccaatttgaagctaactaacaacttagtattagatataaaaggagttcaggctgctgaaggggctttagtatccagatattttatgtatcccagtgtataccagcaccatacaacacgtattgccaattcaatgtttagaagaggtttgaaaaagttaataaactcaaatgaaatagacgaaaacgatatgtacaaatatgatgatatggatatggtcagcatttacagaaatagtgaaaatccctttgtacgggatatgattacccgtctggacaacagggacttatttaaacgggtaaaagttattcggctggagaactttaaaaatcctgaaaaattatacaaaacttcacaggaaaccctaagaaaagctgaagaagaaatagcttatgattttgatatggataaagattatttaactatcaatatagctgaatatccccgttttgatgaaatgaaaacacaggtaagcgttgacgggaaattataccccttaactaaaatttcaaatatcgttggagcactaagtaaagcaagattcaatattcctgacattagtgtttatgtgccaaaagaagacaaagccaaattcgagaaacttaaactagaaaattacctggatttacctgaaataaataaggataaattccatggcattcattatgatcaaatcaaactattttaggagaataatatgatagtagttggaattaccggagctagcggagtgatttatggaatcagattgcttaaagctctaaatggattaaatattgaaaacagcttaattataagtgatgctgctaaaactgtaataaatcatgaagtaaaagaacctattgaagatataatcactctggcagacaattattatgaatttgacgatttaactgcatccatcaacagcggatcatttaaatttgacggactggctattgtaccatgttccatgaaaacattatcatcaatagctaacggatatgcctcaaatacaattacaagagtagctgatgtaagcctaaaagaacacagaaaaacagttattgttcctcgtgaaactcccctcagaagcatacatttagaaaatatgctgaatttatcaaaagagggtgctgtgattttacctgcaatgcccggattttactctgacagcgatactgttgatgaccagatcaattttattgtaggtaaaatattagattcactgaatattgaaaacaatatatataaaaggtgggaataaatgttaaatgatatggactttattaaaacttgtgatgttcctggccctaccaaagaagccataagagcaatcatattatataaatcagctgtaacacccaatgacgaagtggtggatgttggctgcggaaccggaggaattacatgtgaatttgcccaaagagcaaaaaaagtaacttcaattgatacaaatcctgatgccattagcgttaccaaacaaaaccttgaaaaatttaatttgggagataatgtagagttaataaatgattcaggaagtaatgctctgaaaaatattgacaatatggacatagctgttgttggaggcagcggcagagaacttgaagatattttggaaattatagattccaaattaaatcctaaaggaagaataattgttacagccattcttgttgacactaaaatagaagctataaacaaattaaaaaagctgaattataatcctaaaatcatggaagtcaatatttcaaatgggagagttcttgaccgtggggttatgatgataagcgaaaatccaatagctatcattagtgcaaataaaagataaaaaaattttggagattataaaatgaaaagagactggaaaataaagttttcaatattgatgattattgcagctattattatttttggaaccaattaccttgtcctaaaagacacacatagtattgtttcatatgtctggctgcacataggatttattcctatagacattatcattgttgcatttatacttgaagatataatgagcagaaaagaaaaagaagctatttatgaaaagttagatatgcttatcagcactttctttactgaaataggtaatgaattaatagaagaattcagcagtgcaaatgaatttaaagctagcaccagttatttaaaagctattcctaattgggacgatgcagaatatgacaaacagctgaaaaaattaaaaaatgcaaatattgactttaatgtagatattgaaggaggcaaaagagcagaatttttaataaatcttagaacattattaaaatccaaaagagagtttttaataaacttaatcaacaatccccaattatttgaaaaggaagagttttcaggattattaatttcaatattgcaccttgatgaagaattagagcacagaccagatttaaatcagattacagatgctgattttaatcatttaaatggtgacatcaaaaggatttattcaaaattgatatatgaatggatttattacctaaaatacctcaatactcattatccatatatgatttcattaattatccgtacaaatccatttgatgaagatgctgatgttcatataaaagattagggaaatgcatcatgaatagtaaaaaacagcattcctgtatcattttatgtggcgggcaaagcagaagaatgggtcaggacaaaggatctatgattattcaggataaacctatgattaatcatatcctttcaacattaaataatgaaataaatgaagtgataattgttttaaataataaagaccgtattgacaaatataaaaatttcattaaaaaagaggactataattttaaaataacctttgctgaagatgaaataaaaaatattgggccgatgtccggaatattgaccgggctgaagcacattacatctgattatgctttaatacttccctgtgacagtccatatgtaacagaaaaattaattgaaaatatttttaatgaactggactcagaccatcaggctattgttccctatcatgacagcaaaaataaactgaaaacaagcgaaccccttcattccgtttacaataaaaatatcattcctgaaattgaaaagctgatatctgatgatatattgcatattaagggattaatagaaaaaatagatgcgaaatttatattaatagacaataaaaaattattaaaaaaagaatttagaaatcttaatcgtccatcagacgtttaaagatattcaactaattcttttgtttttgaaactgctttatcaacacagtaaaatatgtcttcttttgttaacggtgaaattccacctttctgcatagcgcaaatattaccatctttagtaacacctacatttaaacgagcactagctactttttcttcatttaaagtagggtctaaaatcaatttatcccctattttaacaaaagtacacatagccacttcattattgataggtaaatctatagtgttttcatggtcaagtacaacttcatcatcagcaatacttgcagaaggtaatttggtactttttagagcagccattacagcaagttcacaggcatcaaaaagatttccacagttatctataatatgcaaatctataaataacatccaaacatgtttgccttcttcaacacataacttatccaaatcaacaagttcactttcacgaattcccctgtcaacaacacgtgcaagttcaattgaatcttcacttggtggtccaggttcaaaagtaggatcagccattggcagcatttcacagttagtcattaaaactcccaaatccggagtatccggaaatggtgcaccaatttgcggtttaataccaacaataacctgagtatctcctattttaactcttgcagaaccttcagctttggatatcacatcagtttcaatagaaatatccctgtattcatcaagttccctgccatcttcccttttatcattgacagcaagattaattatactttcctttgtaatttcaggtacaatatcaaccatattaatcactcatctcagcagaatattttttcattaaagcttctttttggatttcatttactttcctgcatccttccatagctaaattaattgcttcttcaaattcctcttgagataaatcaccatcactttgtaataaagtaatttcaccagttcttggcatcatagctataggaacatcagcctgtccttccttatcttcaacttcagataaatcaagaataatttcatcatttaccttacctgcagcacatcctacaacaatatctttcataggaattccagcatcaacaagtgcaacggaagctgcagtaattccagcacagcgtgttcccccttcagcttcaattacttcaatgtaaatatccaccatggatctaggataattttccaacattaaagcaggtcttaatgcatccgcagtgattttggaaatttcagaagaccttctgtctggtcccggtcttttcctatcatctacagaaaaaggagccatattatacctgcaccttattacaccagtatttggttcaagtaatcttctaatatatgattctctaggcccgtacactgccactaaaattttatttccaccaacttccaaataagcagacccatctgcacgttcaagaacacctgcttcaatttttatagggcgtaattcattatattttctgccgtcctctcttatcatttcagacatcatatcaacctcataatcatcaaagaattatctgttattcaatatataagaattgccagaattattaccataggacaaaggtttatcctttttatttttcttttttaattcttcaattactttataaaaatcagtactatctttttttgactgttcttctttttcttcctgttccaattcttctttgaaattttgaagtttaggtttttctaattcttcataatcatcactatagtcatcttcttgtggcaattcaccatcaatagctaaagatagtttatttttaactttatttgttaaaccggaagtatgagcctcagcttcaatcatatggataatatctttagtaagctgttccatatcttcctcacctttaacccaaacaagaccattttgaccaacaattatcttacaattggttttatccttaatcatgttgatcatagaaccttttttacctattaatctaggaactttggttggagtaatatctacaattattcctcctctaaatttacccattcctctgccttttaagcccagtttgacttttttaacttcatcaacatcaacaactcttaaaaatagaacatccccaacatcaaataccttgttgagttcttttttctctcttccaaacacttcaaaagcaggtaaaattccggaatatggggaattaatatctacatcccacatggagaatctgacatctttaattttaccaataactacatctccttttttaggaacatatttacttttaagaggaataactctaatttttttattccttaaagaaactagtcccattaaagaagaacaaattttaccattctctttaaaggtacctcttcctgagtagtattcgtcatctgccaatacttcaccaggaataactaaatctttattttccacatatatcataaaaatcccataagttgaaaattaatttaattatttgatagttttcgtttctgcttcaccacttgaaatttcagccattttagcggcgaaatcatcttgaaggccaccaggcatctcaacaatgccaatccatgaaccgtcttgctgccattcttcattaagaatttcaccaaaatgatggattgcagagtaggctcctcctgctgaagaacccggaaggcgaacagctactttaactttttcaaacctaatcggaataagtggtttaatagctttcagggctgtttgtacttgttgatcaactgaaacaaaaggatcaaatttaactttagcttcattaacagcattttcaatcctttgtgcagggtgaggaagacctgattggggattaatagcttctctagaaattttattaataacaagtcttcttttatcttcctgcatttgtcttttttgttcagcagttaattgaacatgtcctttttcaagtataactttagaaactccaatagggtctgtagtttcaaatattttaagcatagcttcttcagaagctttatctccttttttagagtccttaaaaatttcttcaacagctagaagatcttcaatggccacatcctgcccatcaggatttctaaattctgctgctaaatccggatcgaccaatatttcaaaatgttccccacaatattcatatttagctattattgcttcatctacatttaccattgaaaaaacccctaaccaattaattatttattcttcactttcctcttcactttcttcttcagatacaacctcatcaatgaaagtctgtacttcttcctgagaaagtttagtgtatacttcttcaccacatttaataacagcaatttcaacattgtttgcagtagtttcatgttcagttgcttcattgattgctgttagtgctaaattaatagcttcatttaaattcatgtcatctttatattgatcttcaaagatatccatagctgcagatctgcctgatccaatagcagttgctttatattcaattaatgctccactaggatctgtttcgaataatttgcaaataccgtcatatactccaccaatgattaaagcagaaccgaatggccttaccccaccgttttgagtatacatctgtaacatatcacataattttttagataagctatctaccctaataggttcactgtatgtgattttatttatttgagcttccactcttgctctttcaactaaagctctagcatcagcaacaagacctgaagttgctgctccaatatgttcatctattttgaatattttttcaatagatgttgcttcaactaaattagaagtagttcttttatcaactgctaaaacaataccttcagaacatttaattcctattgaagtggttcctcttttaacagcttctcttgcatattctacttggaaaagtcttccatctgggctaaatacagtaattgccctatcatatccagcattttgtaaaggttgcataaattaatacctcacatttttttaatattataataaacttaagttcaactactataaaaatacaattattttaaaaaataaaccaaattctccatgaaatggtatttcattacatatctgtaatgatatagttttttaaatcttttttccataaattcaattcatatttatatgcgtatattattaataaagttttctattttaaaataactaaaagttattaaaaactttttcataaccaaacagcaaaaaattaaggaaaaaaccaattaataattcactatttaaaagaaattttttatcaattttcacttttagtgttttgataaaaaagagtctaaatctcatggttttgtttgtaaactttccaatagcttacaaacgtttttagactcataacaactttttttaaaataatttttttcacagtttacataataataaaagtaataaaaaaattataaactttaccaaaaataaacggatgatgtaaaatgataaagttaaatttaagtttcacctctccaagaggtgaatcatgtgttaaatcatataacaataattttagatgtaattttaatcatattacatattattaatctaataagataaacgattaaaataattgatagatgaatataaaagtttttgattttttacgcccacgagctgaagttttgcgtaatttttccttttatttttcaataaatttctgacaggctttgatagttccggataaaccgatagttgaaactgaaatatcttttctattatgtttataaattaaagcaagagaagcccttacctcatcaacatactctctttggcagcgaagaattgcctgataatgattatactcatcggttttttcaagctcataaaacttcataacccataaactaaaattgcctgttccattttcaccaaaaaagcgaatacatccattccaaacaatattaaccaaatcatctttagaaataacacttttaactttaatatccaatgccaaatacctgttatttttcctaagtgtagggggaagaaccttaagcttcatcattaacctccctaactccttttaaaaccatgtttttcctgtttttattaaattccaaaatgttttcagctgaggtaaatgatttgtcaatttcactttgagttaatccaactgaaagaaatactgagctgaaatctttagttgtcttaatatcaaaaacggactctgctcttgaagacaaaattaacgggaagtcaaatttcttatgtaatgaaattacatccttaatattagctattgttttagccctatatgttaaataagatttcaaaatatctataaagcaaatttcaacagctacattattattcaaagattctttagccaaaacctgattaagaccactgtcatatcgttttaaataaggtcttgataaaacatccaactggatattttccaaaacagcccgatttacttttaaatctccaccaattacactaatgcatgatgatttatttctgaactttctggctatttttctaatttcattaacattgccggaatctatttctaaagtataatctatgccaatgtccaaattatcctgcaaatcctttttaaactctaaagctttggcaaatttattttgattataagaaaaattaatatgatcccaaccatactttgaagcttcctcagctaatttcaaattattatcatagctgtttcctttaacatttaaatcaaaaaacattttaaaaatcctattgaatcatttatattaaatattaaattttatttattattaatagttatggaaaaagcattaaaaaaaagaaaataaatttttgtagactactacaaaaatctaaaaaattcccaatggaggagaattaaatattgcatagacaattaaagccataaatacaatatttataagaactccaaattttatagaactattaatattttcccgcctggaatattggaaaacaatataaaaataatctgcagagattaaaaagaacaataaaaacatgaaataagtaaatgggaatagacttacatcacttccagttaccaaagttcctatcatagctaaaacaagcaggaaaataaaaatattaccatatctaatattcatatctaacacatatttttttaaaatatttattcttttatttaaaaaaactagaataaattatcacattcatcagattattacttaaaaatttgatgattattatattatttataattaggataataaatacttttataattttagaataaacatgaaaaaataattgacagaatacttaaaaaatgaacaaaaaaataaaaaataagtgattgcaataatcacttaaacagaaaccgatgacggcaaagtaccggtacttccatattgaagcaaaatagctatttcaatatccaacattttagacggagaaatatctggaacaccacctgcataaattccgacatagtttggaacctgaccgtttctatcaatccatgaagcaaatctgtcagacatatccacataattagcctgagctattgaatttgaataatcacgaccgctaggatgaggtgcataagacggatttccaacagaaatagttgctccgctatctccatgaccaatcagggacacggattttgttaaaatatagagacactgtgatttggataaggacaatgacttataattaaccgggaaattgccaccattatctttaatagcctgtgctaatccaggtgcttcagaaactggaaaactacttaaagacagtgactggactccggaatccccacttacagaagatgatgatgaagaagcatctgaagacatcccctcatcagaaccgctgaacattccagtaccgatagctgcaaaaacaacaatcaaaacaactatcaatgcaactaaacctacaataattatatttttgcttttttcgtcatctcctgcagatgcaggaacatgacttaaagttcctttatttttaatttgacttccacaatatttacaaaattttgaattatcaggtaaatcttttccacatttaggacaaaacattaaaactcctcattcgtatttataaaattcaacagaccaacttacagtttcataataatcaatattgaaagtttctgaagacgatgattcataagtaagagaatcatacctacttgcaactgcacttctagaaccccaatcaacaccagctgactgaccgttagaacctgaaacatataaatgattagtagcataatttttaataggatatgctgtaatcttaaccattattttacctgcaggaacactaacagcctgggaacctgaacctgaacccgaatatgaacctattaatttccattcaccagatttgcttgagctggattcagaacttgaagtggaactagattcatcaactgaagatgtggaatcagctgaactatctgaagaatagtcgcttgactgatctgcaccaccttcatttaaatttattgcaaaatagccgattgcgcatataagaacaataataattgcagttaaaccaacaatcaaatattttgtattatttccatttttttgttgagtcggggcttcattttgctggactaacgatgcaccgcaacgggtgcaaaatttagctttttcattattttcaaacccacaattttcacatttcataatatcaaaaaaattttagttaatcattattatttttaacacaagatacatattaatttaattatatgatttttagattaggtaataatctcttcaattaaagattcactagatgtgcatatagttacttcattacctgtgttcttatcataatacacaaacatatatgaactatatacatcaaaaggctctttaatccacccttctgttccatcaatgaattttcgagaatataatgcatctttagacatttcatttagccaagactttgattcaaattttactgtaataagaaaacaatcattatcactatttttataaatatatgtgtcaccaccatcagtttcatttactttactataacctgcaggaatattaaaatcaactccattgattgtttcaatatgtgatgttgacatagctaaaacaattaataaaataactattgctgcgacaattaatccaccaataacaagcccattatttcctaaaatctcattatctgatgatttaattgttggagatttattatttttaatatcaaaaccacattcactgcaaaaagtagcatcatcatctaattttctgccacagtttggacaaaattgcattaattacacctttttattaaatttccatcgtaaaaacactttttaacattacagaaaaaacaaaattgtttttatgttgtgtttataatttatattccaattaaaatataaatatttctttttaaaacctataaacagatttaaataaaagtataaaaagtaaaaataaaaaaaagattaaagaaattagtttccgagtgtttctctaattcccttaatagtgtaccttgcatagaggtaatttaagatactggcagcagcacgtccgatagccaatcctgcccaaataccaattaatccccagcccaaataaattccgaagaaaaatgtggctccgacagtgaaaataacttcccttataattgtccaggataaactgattgttccttttccaattccctgataaaagaaagttgaagccattcctgcaccggttaaaggtagagaaagacaggctatttgcaaatatctggttatttccggaaccaaatgtgcagtttcagcagtatatgcaaatatagtagataactgagttgcaaaaactactaaaataagagttacacatgttccaaatattattccaaattttgcaccgaatttatgtgctcttgaaatatactctccgtttttagctccaaatgaactgcctacaactgctgtaactgctgttccaatagctgtaagcggcattattgcaaacaagtataatctctgacctgatgtaaatgacgctattccaaattctccggcaattgaagaaataaatatcatatacaaagacattgcaatagacattacaagcatatccattgatgctggaatacctacttttaaaatatctttagctatgctggaatcaaatttaaattcacctaaattaacatccacatatgtgtcctttttaactaaaatccaatataatataacaatagctgagcagatggaacttaaaattgttgcaatagctgctcctgctgatccccatcctaaaatgtaaatacatatcggatctaaaattgcatttaatattacagaaacaacaactgcatacattgctcttttcatatctccttctccacgaaggataccacttgcaccatttgcaaatataaaagcaaataaacctaaaaatagaggagttccatatttaattccctgagctaatgactcaccacttgctccgtataatttaagcaagggttcctgaagaattaacaatacaattgttaaaactacggaagctattaaaaaaatcagcaaagaatgtgctgctgactgactggctttcttatgatttttagctccaacaaaacgacttatactacttgttgcaccacttccaagtcctacacttaccccattcaatatcatgaaaatcggagttataaaaccaatacctgcaatagcttcctgaccaagccctgctatccataccccatcaataatattatatgatgctgttaaaagcatagaaatcataattggaatcgccaatttcttaacagctgtttcaggattacctctcattacttcaacatttttattagccataattaccctatttcctcattttatccatttctttttgaattttctcttccatccaatcatcgtcaaatctgtcgtgaagaacaaatactttaatataatgaaatattaaccagactccccaaagaacagttacccataaaaaccaccactggtgtaaatcagtccaatttccgtgaatttctgaaagattaataaaaaataaacatacatttacaataatataacagtataagtatctgtaaaattttacttttttattaacaaggtttttagcttttttataaagtatctcttcatccattatttaaacctcattcatttactaaattgtaactctttctagctacagcccttattacatccatagtttcctcacttacttcagcaagtccgactgcattatgccagtaatccatctctctttttaaaacagaaattacttcttcaccttttttagttaattttaagatatattttcgtctattatctttatttattattctttcaatataacctttgtcttctaattttctaagagttttagctacagttcatttactttggcaaaatatcacagaggtcctcctgtgacaactccctttcagaataataaattttaagcagataataacactcacgaatattagtcagttcctttgattttaaccttgcaaacttaattccattctgagatatattatacatcaataagattaaagacatttcatcaaatatatccttttcttcacccacacccattttaaccacattattttaaaaaatatctattttttctttatcactgttcattttttatccacattattttaaaaaatatgtattaattgtacagttaaacatataaatgtttttaaggaaacagctgtttaggcaatcattttttaaattaaacaattgctaaaaagttcaattaaaatatttcaaagctttttaccccccccaaaaaatcaaatcagcaaatgcctgaaaaaattttgaaaaaaaatgtacaacttccaaaaaaatagccaaacttataaaaattgtttcaaaataaacagttgaatgttgatataatcaacagtcctttcaaaaaagctaaaataaacaccatatataaaatacaatgaaataccaaactaatatataacaaaatttaaataagataaacaaaattataaaaaaattaaaaaaataatattaattgtgttaaagatgaccataggaagaacatataatagtacaaaacattttatattatgagatataaattatactaatatgtcacaaaaagatgacgaacttttgaaattaacttcatatgttgaaatttcaaagtacagagaaaaaaccttaaaatctattggaaataatgttaaaataccaacaaatattgcaaaagacagtggtattagaacaaaccatatttctaaagttttaagtgaacttaagagtaaagaaattgtagaatgtataaatgaagaagctagaaaaggaagattgtacagattaactgatacaggtaaagaagtattggaatctataaatgaaaaagaggaagaaaactgaaactgcacttttcatacttcctttaacaattacatttttcttttattgagtctgtaaaattttataggcttatttgattttaatgtgtttttcagtccaattttgcatttgatagtctaaaaatgtcaggattccatttttggttttgtatattttctttattttttcaggattggtttgtctgtagtaattttcgactttatttgatgttttttctatattttcatcatcaagatattctacgtatctgtggaagtgatttatgatatgttttcttatgaaatcttttaaaacaactggtatggccgtatatttttgtaaatattgtttaaattgttctattgcttctttttttgagttttgtctgaaacagttttttaattcttgtgcattttcgtaaatatggtctctttgttttccattaatcttgtttcttctacaatatacttttaatttatggtttattgtttgaaacagatgaaatatgcacaattgatgttttacttctatttcatctgctacattacgatacattgggaataaatcggttgttaggcaaatgaatggtttattttctgttgattctaagataaattttttcgtgttttttggtattctgcgacgtactattcgttctgtgactggaatattgagtattgcatcaaataaagttaatctgtagtgtctagttccattaagtcttaaaaattgctcatcatataaataatagccagaatattcaaatttttcattgctgatgctttcttcgtgatttttgtcagaccagttcttgattgtttgatgagatattctgattccaaggaatatttcaaagtatttacttattttacgaagtgattggtaccctattttcattattcctggaattttatccattatttcttgtaaaaattgtttattttcaccaattaatggattattgtatattccgaatttttttccacattttttgcattgatattgctgttctttgaattctgttgtttttccattagtattttgtttgtttttctttattgtgccttttttgattattttgtggcttccacaaactggacaaatgggattatcatatttaaaagtattattttcatctaaaaatagtttatgattagtattttcaaaattaggtgttttattcaatctttttgaaataattttttcttgatcaattttttcatcaaaaaaatcataaagtttaagttgtatgaagtctatattactattgagggcagatttgttttgtttggtcataaaatattatttgtcctcacttattaaagtattttactatttttaaatcatttatattaaaattaaagaaaaattagaatgaaatttcatcaaaatgaaagttcaactgtaaaaaattaaaaaacaaataagcctataaaattttacagactcaaaaaaattaatttaaaccctgtttttaataccttcttttaaaaattccaaattttcacgattattaacatctgaagcttcatcaaagctatcaaataaataattaaatataatctgatttttaacatccgttttcacagagtccatagactcgtaacctatagaattataatccggattttttaaatcttttttatattgcagtttaatagcttcccttaaatcatgatcaatataatcttccagctgaccaattatctctccggcaaaagtattgcccagcaccatcaaaaccccaattttttcatcatcaaaagttgtttcttcaagcaaactttcaaaagaagcataacgctgatatccatgaggaataaaccttccttcaacagtatgagcacaatattcattcattaaagccaaatcattagacaaacaataccagacaaaaccttctaatgtagaagactgctttacttgaaacacatcacaaagcaaactttcaattatgtcaaacaataaaaaatgagtcaattcatgaataatagtagctatctgaactgaatcatccaaacggtcatcataatacaaaacatgcccaaattcaaatccgaattcttcacctctggcctttggcctgcattcagcaaatactcctgctatacttaatattttttctttaggagtatgacctgcaatttttgaaaattttaatttcctaaaaatatttgacaataatttactataatcttcatcagaaatttcagctttggccagcaataatttattataatcagtaaacagcttttcaaagctatcaatagagacaggacgaatttgtttattgcaattgctgcaatagctactgtcatctgaatttaattccccgcaaaatggacagatattatccatagctattctatttccgcagtgagtgcagtaattatttgctctaagattaggagttccacatacatcacattctttcataactacaccttatctgaaaacatttcttatagatcttccggcatttgacaatttaattttacgattcatggcttttttaatgtttttaccacaattagggcaaaattcaacatcataatctacaatttttccacaactacaaaccaatttggatttaacaaaacgttttggattcaattgtctgtcacagctgctgcaaaattttgcagatatgggatttttagttccgcaaacacaaattaaagctttattttcattttttaaatcaattccacagtcaacacagaaatcagcagtaacatcatttaatgtagaacaaaaacataatttttgaatatttccatcagttttttcaaaattatctaacggaaatccgcaattactgcaaaactgactgaattcatcattttcctgtccgcaaaaacaaaaaataggataatcacattcaaactcaaaattactgtaaagatcttttaatggagtctcttcatcttcaactaatttctttccacacatttcacaaaacaagttttctttagaattaacatgcccgcattcacagctaacggttgtaaatgaaaatgtaggttttggttgggatttgaaaattcttcttaatttactgtgtgttcttttaacaccgcaatgataacagtagtcattttcttttaaattcagatatccgcaggaacagacttcatatttcaaatcttttctggtgctttcaatataaggtgaaaagtctatatccaaatcaaaaaatccgatgtcgtaaattggaagcgtaaacatataatcatcaccagcatctacaaaagctgttctagctccacagcctttacagtactcttcattaagtgataatcttttgccgcaattgccacagtagttttgtaaaaccatatgcatcatcatttagtcaagtaaagataaattcttcttaaaatccatcctataatccctgtaggaattacgaatattcctgctataactatacttgcacaaatcaacagcaaaatcgcaacaacaggattaaccgcaaattcacttgaaaaaaattcagaatctacaaataaggaaatataaacagaaactgcaaaaaagaaagcagcttccattgctaaaattactcttaatttgctaatcctgtatttattttttctctcatcaaatatatgaaacaatttgaatttaaaagttggtttagtatgcccattatctttaaaatgtgattcattaaatgtattattaacctttttcttttgtgaaatttcacttgtttcttttgaatgcatggaattcataattgaattatgttttttaattgtattaatgtccatgtcaacaaaagaattgccacattttacacaaaatttggcataattagcattttcaaaaccgcatttaggacaatatttcattttaaagttcactcatatttcttatttcattaacaaattcacttaaaacttcttcccctaaaccttcaatgtattttatagatccggcacattcatggcctccgccgtcaatacctgctgaaggtatcatttcagccagtttaggaacaatattattgacgctaaatccaaatctttcattaacagcatcagtagctcttattacaccaaaatcaggaccatgtcctaaagttataattggtttatcctcacctaatgcctgaactacactatcatgaacaaaaccacaggtttttccaggagcagggaatgtaaatttatgagcatatttttcaacatcaatcatattgaagtaaatgccattctcaaaatgagttttttcaatattaggaatagctgctttaagctgagtgtcaacacgttttaaatattccttgtataaagaatcaatcatcttttcatgcttatcaatattgtcaacagctaaaatagtgtccataattcccctaccattcatgaacctaaggaaataagcttcaaagtcaacacattcggctattttagctaaatgttctttagtaaatcctttttctgctgccaattcaaggtattggtaaacttcaccacattcagcatgatctcccaaagctgcaatagccggaagatgtttgattaaatctttaatttcaggatttataatatgtgccacttcagtagccagtgctcctgcagttagctgagaatctcctccaaccagataagggtttacatgagtgtcaacatattcatcaacagcaacagttccgccaacaatttccccgtctttttcctctttagtaattaaatctccaggagagtgatggtctattactacaacttccacatcataaattttagcctgcatcaaagctacaatgtcctcttctgtagaaccattatccagcaaaacaattaacggcaatttttgaccgtgtctttccttgtcttcaagagcaaaggacaaatccttaactacatcttccaattcataaaatggagctttacttggagatcttttgaaataataatactgagcatcattacttggatttacctgttcgacaagaggaacaatagctttttccatagctactcctgaacagataccgtctgcatcgttatgatgtcttaataaaatagatctgccatctaaaatagctctcctaattttttgagctgcttccctcattttaggtttcaatctgtttaaaacatcacttttaaccaggaaatcaacatcatcaggttctgcccttttatttaatgcatcttcaattaaatcatgaagtttggcttttttctcaccttccaatttggaaatagactgagattcaatttgaggcttgcctccatgctgattaacttcacctaaaacttccacagcatccccaacatcaatatctggatatgctctaactccagcttcatcaaaagcagctacccatgtaatatttgattcatcagtaattgtaaaaatagtcggtcctgaagtttgctgaacctgtagaacttcaccgtcaacacgaaccaatttgcccattttttcttccagatcagaaataatggttcttggaatgctttttgtctgttttacaatattgtaatttttaacatatgctggagccaaatcaatttttctttcccttgatttaatagctgttataaatacaataacatcatctccaactttataattagagatatctcccctcataagtccccagacattattatttaatgttacaaaagcaccatatttttcaacacgggtaactctgcctttataaagtctatccttgtccatatccctcatttgacataatgaatccaagacataaacatctttaacttcgttttccatctcccgtattttatcacgtttcattctatcttccttccttttggtatggcaatctctacataaatcatatttttcactgattggtttgccgcagtcattacatacattaatctgaccgctgccatgacaattaggacattcttcaaaaacttcaatctgaccttttccatgacaaacttcacatggaatatcctgatctgcccctaaatcaaatttagctttcgcattactattaactcctttaaaatgatttcctacatcaaaggaatcttggtaaccagttccgccacagctatcacagtctttataatctacaactacagaacctgttcctctacattttggacacttttttttcaatttaaaaacctcattttaaagtaaaaattttatctaaataaatttggattatcattaactaacttatttcttgcattttgatactgaatagcttcatccattaagctatttgccttattaccataactacttccagtagaattatcattatttttaaaataataaatagcatgaaccaaattagatgcagcatcctgttttaattccacttcatcaatagcagtagctaagtattctttatgaacttcattaaaattataactaccattctgtatatctgacaaatctctggaacttttattaaaatcatcacttgcataaagtgctttttctaatgcttcatcataatttttattatttattaaatttacagcatcattatactctttatcaccattagatatattatcgctaatttcagccattgaattatcaagagaattcatagaaaatccaacatagacaatagctatagctattataactaaaagaaaaataaaaactaatgctctcttatagtctgacacattaataatttttataaaaacaagtacttaaaattttttttataaaatattaatataaaattcgctatttaatcagaatatgtgtgcataattaataccatatttttcataacattaaacattaattaaacaaaataataatagctgtcaaataagctgctcatctatgaaaatatcctattccacagtaaaaaaaaagaaataaattttaagaaaagcatcttaaaatttattggctggcccaaaggccgtgtaagttacagaattcccttgcaattgcttcgtttgcagcaagtaaatctgcatcaacagtaaatgtagcttttggaacatcgcctggtttgaaatgtttgatatatctttcatcaccaacgattaattcaacaaattggatgaaatggtcatcgtccatcggatgttgaacttcaccaacagcaactgtaacttcgttcccatcaactgatataaccggaacatgtttaggagctttatctccttcagtttgaggttcgattatatttttagaagagtcacagcaaactttttcttcgtgtgcatctactaaaacttcaactatgcttccgcagtcttcacatttgaatatttttccatattctaccatacaaacatctcctcataataatttaaagaaagtttatattttaaagtatataatactattgattattttcacaatattaataaactcgtgattattttttaatattcaaatagcttggcggtttaactttttaaaagattaacgccaccacttgccaatcaaggaaaattatgattgtaaatcctgaacaagtttaattagacttttcataatagttatcaatagctgccttaagtgcatctgcagccaaattggaacagtgcattttaactggtggaagaccgtccaattcttctgcaacatcattacggctaatttttaatgcttcttccaatgttttgccaatagctatttcagtaatcatactgcttgtagcaatagctgctccgcaaccgaaggtttggaatgaaatatcagtgataacatcatccttaactttaatatagatagtcatcaaatccccgcaggttgggtttcctactgttcctactccgtcaggattttccatttctcctgaatttcttggatttgcaaaatgatccataactttttcactgtacatatttaacaccttaatttatttactttgacccatcatttcttcatatttttcatcagaattccataaaggagacattttccttaaagtagctactgactctttaattgcttctactaaaccgtcaacatcatcgaagtgagtttgggaacctaaagatattcttaaggaaccatgtacatcaacatcatcaagattaagagcttttaatacaggagatgcttctaaagttttagatgaacaggctgaccctgttgatgcctgatatccttttgcatctaaaaggaggattaatgattcaccttcaatagatgagaatctgaaattaatgacattaggcagtctttcattcctatcaccattaagataagattcaggaactgcatccaatactttttcaataatttcatctcttgttttaactaatcttgcataattttcttccagattattattagctatttcacatgctttaccgaatccaacaatacctggaacattttcagtacctgacctgattcctctttcctggccaccaccatgaataagaggagttattctaacaccttttttaatatataatgctccaacaccttttggaccatggactttatgagatgataaggataataaatcaacgttcaattcttcaacatccactttaactttaccgaatgtctggactgcatcagtgtggaaaagaattttacgttctctggctagtttaccaatctcggcaattggctgaagagtaccaatttcattattaccatgcataatggtaattaagattgtttctggagtaatcgcatctttaacatcctctacttttacaataccgttttcataaaccggcaggtaggttactttgaaatctaaagtttcaaggaaatggagtgtttctttaactgcaggatgttcaatttcagaagtgataatgtggtttcctttaccttttaattttaaagcaatacctttaatagctaaattatcagattctgatcctccactagtgaatattatttctttaggatctgcattaattgcatcagccactctttgtcttgctttatctaaaccctttttagcttcgcggccaacagagtacaaagtagacggatttccataggcttccctgaaataaggctccatttcgtttagtacttcctcactaactgcagtagttgctgaattatccaaatacatcttataatctcctttttatttttttattaaaatttaaattttatctaaagcacgtgaaagatcatcaatcaagtcatctgcatcttcaagaccaatagataaccttacaaagtccggtgtaacaccagtagccaattgttcttcttctgaaagttgctgatgagtagtacttgcaggatgtattgctaaactttttgcatcaccaatatttgcaagaagagagaataattccaagttattgatgaattccttacctgcttcctcaccgccttcaatacctacacctaaaatacctgcataataaccgtttaagtattttttagcagtttcatgtgaagggtgagattccaaaccaggataacttacccatttaactttaggatgtgattccaagaatttagctacttttaaagcattttcagaatgtctttttactcttacatccaaactttcaagtccctgtaaaaacaggaaactgttagttggtgcctgagttgaccccaaatcacgtaataatcttgctctggcccttaaggtaaaagctatatttccaagttccggaacatcaccaaatgcatcccagaataccaatccgtgataacttggatcaggttctgtaaattgcgggaatttaccattaccccaattgaatttacctgaatctacaatgtatcctccaatggaagttccatgacctccaacatatttggttgcagatgctgcaataacatcagcaccatgttccaaaggtcttaccaaacctacaccaattgtattatctacaattaacggaatgtcatgactgtgagcaatttcagctaaagcttcaaaatcaggcacatccagtttcggattgcctatagattcacagtaaattgctttggttttatcagtaattgcatcttcaaatgcctgcaaatcacttgaatccacaaatttaacatttcttgccaaatctttaaaggtgtaatcaaacagctggtaagttccgccgtaaagattatctgcagatacgatttcatcacctggagatgtaatgtttaaaattgcataagtaattgctgcaagaccgcttgaagtacctaatccagaattacctccttcaatagcagctattctcttttcaaatacttcagttgttggattagttaatctggaataaatttgaccaaattcctgtaatccgaacctccttgctgcttctgcagcgtccttaaatacatatgagcttgtttgataaatcggtacagcacatgctccagtaaccggatccggttcttgacctgcacgtacacctaatgtggatgatttgtattgtcttttttctaccatataatcacctgtaatttttttaaatttaatattactacactataacatatatttttaaaaatcccatattttttttatcccttctaaactaaatatgatgtgcattatgattttcaatataaaatatatcacatgttataatgctatataacaatagttatttaacatatataaatgttttgggtaaacctaaaaatacaatttacgaaaactaaatgaaattataatgcgtgttataatatcatataacaatagacatttaaagtatataaaggtttttattaaaaaaagtaaaagagaatttgaaatcctcttttttaagcaattgtaatgttgtttcctatttggtattcgttccagatagatgtgatgatatatttacctggatttaaacggatatttaagtttgctataccgttttcatctgttgttttatggtagaatacaccatttacgttaaatgatacattttggttagctaatgctttaccttgaccgtcaagtgtttttgcagtgaaattactgccgtctaagtatttcatgtcaagctctttagtaattaaagttggcaatactgtaatgctgttggagactctgcagccttcgtattcagctgttacaatgtaggtgcccggacgtaacttaatacctaagctaacaataccattgtcatcagatactctgtggtaaaagactccgttgatgttgaaggttacttcctgaccagctgcaactttaccgtctttacctattaccttaagagtataaccggattcatttaagtaatatttaaccaaatcagaattaccaacaagtaatgatttgacagttactttatttgagttttcctcaccagtaacaagattataattggttataatatattccttaggaagcaattggatgtttaaagtagctataccttcaccattggtagatttagtatagaaaacaccattaatgttaaacttaatagtagcattaactaaagccttaccgttgctgtccaggaatagtgcagaatactgagttgcatttctaaacattttaacaatatcatggccaataacagtagatttaattgttatattacatttaacagagatattgttgtaatttgaagttccattaaacagtactaatccttcatatactccaggcattaacttaagtgccattgaagcagttcctttattatcagtaattttagtataatttacaccattaattacaaatattaaagtttcattagctatcggattacctttataatcagttaaaactgctgtaaatcttgttccatctttataaaacatgacaatgtcatctgattttaagttaagatttttattaacatcaacagtcatgttaagttgtttaacagaattaagatatttatcatctcccgaatagtacacaacaacatcataagtaccattatccaatacaccagtgataactttagcagttccattaactacagttgcattatactttttatttccaatgattattgtaacatttcctgttgcatcttttggcagacttacagttattgtagcattttctccactttgaaccctggaaatatcaacatcaatgtcatatttagctattttgcctacattaaatgaggttatgtttgtactagctccataattagcatctccactatatttaactacaatgtcatatttgccgacaggcaagtcacttacaattaaactggctttaccatccttaatattaacagtaatatttttattgttaacactaacaaccacattacctgttgcatttttattgacaaatacatcaattgtagcattttcacctacaacaatatcattaacgttgattaaaataattgaggtttctttagctacaataactttaatattaaatatttcattaccatattctacagtaattgtgtcattgtcagatattgtgtaattaacactagctgcattattaataactttagccagattatctgataatgtgccattaatcgcactgaatttaacattaaattcaggaagagcattagttaaatcataaagttttccatcgttgccttgatatttatcaaatgttgcttttataacttgatttcctgtgatattttcaataatgtttggagttacactcataataatccaatttgaaacatctacatcctcacatggagtatcttcatcccatttacctgcaccaaccaattttgaaggatcattattagttccccaccagttgtattgtgcattagcagaaggattgtatccacaattataaattacataattggaggaagcattttccaataatactgaataatgaatatttaaattaccataattataaattgcatttccataatatccattacctgcagcattgttttcaaatattgaatttaatatgtttacatcacctttagccaaaatagctccaccatccttagcagccatattatctctaaatgtggcattagttatgtttactttagaacttaaagaccataaagtaatagctcctccatttcctacagtaactctgttagattcaaaaatagagttttcaactataaggtttccactggaaatataaacagttcccaatcttgcaatattattgtcaaaatcagaatcaactatttttacagtacctcccgttgaataaacaattccatatgatgaagtgcctgaagcgatatcattgcctgatagagttgaattaatcaatgcaagattattgctgttgtatattaatccatgcccaatattatgaattattttagagtttttgattgtcattactccagtattgtaaatagcactcatagtattagctaaagcatcagttatttcattatcataaatgcttatattatttagtgtaaaatcagctcctaaattataaactgcacatccaaagttgctttttgctttagttaattccaaattagctaaattaataactgcagatttatttgttgtagaaattattttgccattattatcagcatcaataatgactttgcctgaaccaattatatttacagacttagttatttccaatccatattccagataagttcccggcgctatgtaaattgaatatccgtcacttactaattctaaagcttttttgattgtagctacaggactggtttggctaccattgttttcatcatttccttccttagatacccagacatctcttttaacttcttttataatgacatcaatgactgaactttgattggcagactttacaacaattttattgctgttttctatagtatatgaaaaagtaactaatccgttgacagtatttagaatatttccatcaaaatcaactgctgtttccggaatatgttttgttaatgtatgaattttaccaccaacacccatataatggttgaaatcaacattgacatttatagtttcacctttttcaccggaaatactttcaggagcgttcattattacccaatttttaatatcctttcccgcaggtgtgttggttccccaccagttataatcaagagaaatttcggatttgccgtcttcttccacacttgtataattaacaaatctgttgttagtgataatacaataatccacatttaaagaagacccgtctccaagataaaaaatactgttttcaaggttatttccgtcaacaacagaatttgacatttttaaaatagcatttttagaaattgaaattaaatatctgctgtttacattgtttattacagtgttaacaatatcaacagaacctgaagaaagatacaatactcccaaatcagcattaatattgctgaatgtacagttatatattttaatattattcccatatacttttaaaactgcagatccgtcattttgtgaaaatacaatgttattaaattccacattatctgctttgcagataaaggcattattggtcaaaataactttgcccaaacctgtaatagatacttccttatttattgttatctgaccttgagaataacttccttccataacatatattgtagatgaatttttagccagctcaattgctttagctattgtagctaccggagagttttcactgccgtcatttgcatcattaccctcagctgatacccaaatagcatcaatgactttggaaataattttaatagtagctgtctggttacctgattttacagtaattgtatcattattatttacagtatatggaacactagctattccattaacactatatgcaacattgtttaacaaagttccattgattgtactgaatttaacagttattggaacatttacggacaaatcataaattttaccacttgcatctgtataatgattgaaatatactcccacatcaattgttttacctttttgagcagttatattatctggtgtggtcattatgatccatttactgattttatcattggaaacagtattatttccccaccagttataatccatagtaactgcagcatttcctgatttaacattgaatattttgttaactttattatcaacaatgctggaataagatacatcaagagtatttccatttgtaagctggaaaatttcactctcagagctgtctccagcagtattgtttgaaattaccgtgtttttaatattaatattagcatttgcacttgatccgtaaataagatactgaccaaaaccagtagaagtcataccaacagtattattcacaattacagtatttaggatatttaatttacttcttgactcaacaactgattgcattggaccggatgaacctctaataacagtattatttaaagttacaactgcattttgattatcaatataaaatattcctcttaaatatgcacacttatcattttctacaacattatcagctaatttggaatttgaaatagttaatccgtcaaaaatatactccccacttccagaaacatgaataatagctgatctggaagcagttcctactacattttcaaaagtacagtttttaatttctgcatctgctgtagtgcctatgtccatagcaccatatctggctccaatatctttaaaagtacaattaattactttaagaaaaccatcaccttcaatatataatgctgcagatcttgtttcttcagatattaaatttgcaaaagtaatgtttataaattccaaattgcatccgtcttcagtacatgaaaatgcacggtttccagttcctcttataataacattatttccttcaccaataaatgacagcgttttattgatttctaaaactttttgagaatactccccatccattatatgaatagtataacctgattttgctatttcaatagctttagttatgctggctaatggtttgtctttactgccgtcgttagtatcactacctgtagttgctacccataactcatcaatacttccgtcaagattaattttaatatttttagtattggaatctttaattaaatttttaccaacacttaacgttgcaacaccattagctttagggctaacgctaacttctgcagctccgtttttgacagttatactgttctgattcaaggtagcatatttttcatcgataattgcattaagattaaatacaggcagttttgtattattaaatacaatctgataagcagaatctccagaaatagtattattaccgacaatacttaatttagctattgtaaaatcacatttatacaatattccaacagaaccataggtagctgcatttgtaccccagtaattatccctacagcttttaatatattcaatatttacatgattgatattgtttataaaaacattattgtcaatagtgtttacattcaatccattttcaagtaatgcattggaaatattgttattcattattacattactgtttataaaaacagaattatatccgctgactctgaatatgttagttgcagtattattgataaaataagaattagttacagttaatgaacctccatcagcccatattaaacttttatatcctgacttttgaaaagtaacattatccagtacaagattacctccattttgataaattaaccctttatcatctgtattataattcaaatcagttattataacattttttaaagttaaagtacctttattaacagcaaacagccttacatctttggaattgcttccatttattatgtgtgatgcaccatcaacagttgtatctttatcaattatgatacctgatgataaagaaccatcacttgaagaatcatatttataatccttatccaaacttatgttcggatttgcctgaatattcgaattcaaatcactaaatgttccaacatcctcaggagcagttaaaacatcctcagaatatgtggaattaacttgcaagccatcattatatccaacattatttaaatcttcattagcattaactaatgacatggaaaatgttaaaataatcatgataactaaaataaatctttttttaatcatcatatccccgttaacttcattttaaattaatatacattgaaacttaaagttttttattgaaataaaataattcttaagtttaatcaatatatttataatacaagcatatttatgatttgtcaaaatattttgagcaaattaaggaaaaatgttgcaaaaaacaataatttaaatataacacaaacataaatttacaagtataggagagtgtaaaattatgaaaactgtagcaatcgtaggaagtcctagaaaagacggaaactgtgatattttagtaaacaaagtattggaaaaaattgacggtgaaaaaagcatttactatcttaatgaattagatattggtttttgtaaagcctgtcaagcctgtcaaaaaggcgactgtgtaaaagatgatgatgcaagaaaaatcattgatgaaatgcttgaagcagatttatttattttctcaagcccaatttactatggtcaaatgagcggacaagcaaaaacattaattgacagattctatcaagtttcacaaaatccaaataaaagcttagaaggtacaaaagtaatagaaatatttacccaggctcaaccaagcgatgcatttgcagcctacattgattcaatgaaagttataccatttggatacatgggtatggaaataatcgataccattgttgcaaaaggagctgctggaaaaggtgacggattagaagaagctattgcacaaatagaaaaaataggagataaattataaatctcctctaatcacttatttcataacctaaatcagttagctgatttcttattttatcagacaattcatattgtttgttgtttcttaattcttgtctaacatctgaaattaaagttaataattcatcagaagatcctgtatcttttaaaacaaaatcaatacctaaaataaaaccaacatcatctaaaaattcacgaatagctgaaacatcttcatcagctaaagaatcaatttcacttttggaatcatttattaatccgaaaatagctgcaatagcttttggagtgttgaaatcatcatccatacttttaaagaattcttctttagcaatttttaatggagcataatcagaagtggcattttctatgatttcacattctaatgattcataatattttttaattttatctaaacttttttcagactgatgaagtgactcttttgaaaagtcaattggacttctgtaatgagtagacaatacaaagaacctgaatacatcagcatcatattctttaagtaattcacgaatcgtaatgaaattatttaaagatttggacattttttctcctgaaacatttaaaaatccggtgtgtaaccagtaatttaccataggactttttccgctaactgcttccatttgggtgatttctgcttcatgatgagggaatattaagtcaagcccccctccatgaacatcatattgcggtccgaagtagtattcagtaatagctgtatcttcaatatgccatccaggtcttccttcaccccatggagagttccatacaggttcatctacattttctctttttttccataatgcaaaatcaatcggatttttcttagtagttttagctatttccctatgggattccaattcttcaatgtttctatttgataattttccaaattccttaaaattgtctattccaaaatagactccgtcttcagtttcataagcaaaacctttatcaattaatctttgaatctgatcaattatttcgcccatgtggtcagtagctcttgcaaataaattaactcctgtgacatttaatttagccatgtcttcaatatatcttttttcaaacttcttagctatatcacctgcaggaattccagtttcttttgatcttttaattatcttatcatcaacatcagtaatgttctgaatataaaatactgtataacctttatattcccagtatctttttattgtatcaaaagaaatgtaagttcttccatgaccaatatgagcatcatcataaacagtaggtccacaaacaaataaattaattctattatcattcatggtttcaaaagtttctttactacgagttaaagtagaataaatttccataaaatacctcaaaaaaagcaataattaataaatgaaggcaagctagggatttgaaccccagtatcatggtctgcagccacgcacctaagccgctcggtcagcttgccacaaaaaataaaacagtaattaatagtttgactattattacatatatagtttactatttacattcagtaacttcagaacctaaacaaccctgacagtcttcatcaagatcattcttatcaatgtttaattgttttaaaacatccccaattttaatatgtttacaaatggaacatgttctaccaattatttcagtttttttagcttcaccattacgtaactgaacagctaattccttaaccatttcttttacatttggacttaattcaataccgctgccccttttatcagtaatatactgagacacagcaggctgagttatatccataagctcggaaacatctttttgtttcatacctaaagctagcaaatctttagctaattctgatctgattgcaggtattacataccatacaacaatttcacaaggcggtttcatgttaatctcctattttttcaataaatcatccaattcgtcttcatcatcttcagttaaacaaattgaatttttttcatacaaaattttaatgtgtttatcattttctttaagatgctttgtaagagtattgattgcatcagcgacaggatccggaagcttattatggtccaaatcaacagtcttatgctgaatttcaatattttcagcatttttacttctgacaattcttccaggaactccaacacatgtggaatccggaggaacatcctttaaaacaactgcaccggttcctattttagaatattggccaacagtaatattacccattactttagctccggcaccaataattgctcctttttctacagtcgggtgtcttttagttttttgtgtgcttgttcctccaagaattactccctgataaataagtacatcatcaccaacaattgcagtttctccaacaacaacacccattccatggtcaataaaaacacgtttacctatagttgcgccgggatggatttcaatacctgttaaaaatctggctaaatttgaattcattctagccaataactttaaagagtgattccatagataatggctgactctatgcataataatagcataaaaaccaggataacataaaaatatctctagagtactgcgtgctgccggatccttctcctttattgtcttgatttcactctttaatctaccaagcattaacaaaccccaaattgtatttagaatatgtatatctataaaaatataacatatagtatatacattttctataatacataatatataaatttattcaaataaccagtcaacagataaatatcttgaaccgtcatcaggtaaaatagccaatattcttttacctttattttcatcccttttagctacttgaattgcagcccatgttgctgctccagatgaaattcctgcaaagattccttcttttttagctaaatcaagtaaagtgttacctgcatcttcatctttaacaggaataatctcatcaataatatcagaatcataaatagacggaacaaaacctgcaccaataccttggattttatgaggacctttaactccttttcctaaggtttgggaagactcaggttcaacagctataatttgaacatcaggattttcctcttttaatacttttccaatacctgtaatagttcccccagttcctacaccagcaactacagcatcaattttaccttcagtatctcttaaaatttctttagcagtagtttgagaatgaattcttgtattagcttcattatcaaattgatgtaaaacaataccatttggaatttctttttccaattcatcagctttagctatagctccacccataccttctgaacctggagttaatactaattctgctccaaagatacctaacaatttccttctttcaatagacatggtttcaggcattgttaaaattaatctgtaacctttagcagctgcagcaaaacctaatccaataccggtatttccactagttggttcaataattacagaaccttctttaagcaaacctttttcttcagcatcttcaatcattgcaactgcaacacggtcttttacacttccagttggattgaaagattccatttttacatctacttctgcatctaaatcttcagttatattatttaatcttacaataggagtatttccaatagcatcaataacactatctaaaactcctctttttaattctgggacatttaccataattatttctcctaattaattccatttaaggtatattataaagggttaatcattaattgtcatattttggaatacctaatataacaatagttattgtttataactactgttatataacaatgtttttatttataaatgtttcggaaaatcagcagtaatcacaaatatctgaaatcggacacatttcacattgaggactcataggtttacagatagtttgaccaaactgaaccatcaaatcatttaatttaatccataattccttaggggcaattttagccaattccacttctgtctgttcaggtgttttggtatttaccaaaccaattctgttggaaattctgtgaacatgagtgtcaacaggaatagccggaagttcaaatgcataaaccagaacacaattggcagttttacggccaacaccaggaagctcaaccaactcctttagattgtccggaacttcaccaccatactgatcaatcaaaatccttgaaacctctttaattctagctgcttttacacgataaaaacctgaacatctaattagctcttcaacatcatcagttggagcatcaactatttcataaatgtttttatatttgccaaataagtttttagtagcctggtctgtattttcatctcttgttctttgagataaaattgtcctgactaaaactttgtagggatccttatttacaaactccctgattttatataacttatttaactcatctacaattttaataaccttttcagtttctgttaattccaacaccaacacttcctaaattaactccagttcaactccaatttctgacatggcttcaatgaaattaggaaaagacacatcaaaaacttccccatttttaatttctatatcatgttttagaccaaccaatgaaaatgccatagccagcctatgatctttatgtgaatcaacaacacctgaacggattcctccttcaatagacatgccgtcttcaaattcttttaacttgcagcctaatttcttaagttcactacatgtagtagctatcctatctgtttctttaactctggcatgtttaacacctgtaatattagtggttccatcagccagagctgctaaaatagctactgtaattaataaatcaggagcatttgacaaatcaacatcaataccttttaaattaccttcagatgagatttccacataatcatcaaaaatctctatttttgcacccatcttctttaaaatattcaatattaacttatctccctgtttagaatctttaaataaatttaatatttttgcatttccaccataaatagctacagctgcaagcaaataagatgctgatgaatagtcgccttcaactacatagtcacaggatttatattcctgtttagatattttaaattcatcaatgcggcaatttttagattccctgtcacagtcatcatgacgtacaaagaattcattttcaattttaacaccaaatttagccattatatcacaggtcatatttacataagggcgtgacttgaattcaggcagtacaaataaatcaactccattttcagataaaggagcagaaatcagaattgatgaaataaactgagaactgacattgcctaaaatattagtttcaccacccacataacctggcttgattaaaataggtgctttcccattaccattaattgaagctgcacatacacctaatgaagccaatgattctgttaaaatctccataggccttgtctgcaaagagtcatctcctgttaatataacttcattgtcagccaaactggctatgcttgtcattaatcttaaagtagttccggaattacctaaatcaataggaacttctgatgaattgtgcaatttaccattggttccgatcacttccaaataatcatcttttttagtgatatttgctcctaaagctctgcatacattaatggatgacaaaacatcctgtgaaaaaagcatatcatgaattttggatgttccatcagctaaagaagctaatataactgccctgtgagaataacttttagagggtggtgccttaacttcaccaccaatattggaaatagttttaactttaagattcatactgataattatattttataaattattatatttatctgaaaagtaaaaaatttgaaaaaaagaaatgaagtgaggttttttttcaattaaattatttaactctttgaagtacaattgatatgaaatttaaatatttgcaagctcctgcatcaacagcttttttatctccggcagcatattcattatcacagttaatccaatctgtccaaagttcttcatttccttccatttgtttaattgaaataacctttgatttattggatttatcaactatattcttccaataatccatatcatgaatataatctaactgttcctcattccaggaaagcaataattcatcaggcaaatcatcatgacaatcttttttcatgccaggaactgcaatatacacataacccccaggcttgataaatggaattattttttcatctaaaaagttatcatctcttccaaagtaattatatgaatctgcacaaattatcgcattaaaaaattcatgtgcaaatggtaaatcattagcatcagctttaataggaattatttcatcacctgaaagtcccatttcatcaaaaaatttcttgttttctgttgggtcgctccacaaatcagttggaaaaactttaaaaccatattcttttacaagaaatactgaagttaaaccattaccactccccaaatccattacagtagcagaatcagaaatattgtgattcagtaataattcttcaactaattttaaaggatttggacccataattttattttcaactaaatttttatcatacttttttgatttctcataattcaaggtaatcacttaaaaaattgttaatttaataaaaacaaattaattttagataaaaaaaagaataaaaactttactattaaaaaaaataggaattgaagtaaaattatctaattacttcaacaataacatctaaattttcagactgcaggatatccacttttttaccggaagctcctacaatttcttttgagatgtttaataaatctttaccaacagtaatctccccaatagccaattcacctgaattttctaattcatcagctatttcttcaatgtccctggattttaggtaacctatgatttttccggcatcttttttaaacatcggtccgatttgagacatgtcaggttcaacttcaatgattttttcatggacttcaggttttcctgttttaatagccaaatcatcaattttaagagttccttcaatatcctgtgaaaattcattgaacacttcaactaaattgccgtcattggtataaacattgacttcagataactgagcgttaagaggtatttttgaactggatttgaatcttcttacttcatcgattaaatctacagtgatattacctttattttcgtattcttcacttaccaaatcttcattaacttcaggccaggaggttttatgaatagattccccgtcaccgaagtactggtaaacttcctctgcaaagaatggtacaattggagataataattttaatgaagtttcaataacatttcttaaagtgtatttagctgcttttcttgatgaatcgcttacatcatcattgtacaatctgtattttactgcttcaatgtattcatcacagaaatcatgccagatgaacttttcaattgatgtgattgtagttgcaaaatcataatttgcaaatgcattatctacaactttattgaggttatttaatttagataaaatccataaatcaaggggatcaaagttatcttttatttcatcatagtttacctcttcatcaaatatctgcatactaatgaatctgaatgcattccagaattttcttaagaatctgtaaccgtgtttaatgtctttccagtcaaatattacatctgaacccggtacactgttagctgcccatgttcttaaagcatctgcaccatactgttcaattacttcatcaggtgcaattacatttcctctggacttactcattttgtatccgtcttcaccaaataccataccattgattacaatatcatcaaatggttttttaccggttaaagcaagacaacgaagtgtcgtataaaatgcccatgttctgataatatcatgtccctgtggacggatatttgccgggaaattgttttcataaccttcattaggccatcctgcaattgaaagcggtgaaatggaactgtccatccatgtatctaaaacatcctcttctccgatgaattcttcacagccacagctgcatgcttttttaggtttatcatgagtcggatcaactggcaagtcttcaacatcaggaagcattactttaccacaatctttacagaaccagacaggtataggagttgcaaataacctttgtcttgaaatacaccagtcccattccatagaatctgcccagttaatcatacggcttttcatgtgttcaggaacccagttcatttcttctgctgcttctttagtttgctcgattaacttatttacagctacaaaccattgttttttaactaaaatttcaataggagttttacatctccagcactgaccaacattctggtcaactttttcctgttttaaaagatatccttcatctttcaaatcttcaatagttttagctttacatgtagccaaatccattccttcatatcttcctgcaacttcagttaatctgcctttttcatcaatagcatcaagaatttccagattatgtttatttacccaggctacatctgttttatccccgaaagtacaaaccattactgcaccggtaccaaattcagggtctacttcttcatcagggtaaatttttactttctgatgagataaaggcacttcaacatatttatcaactaaatgagcatatctttcatcatcaggatgaactacaacagctacacaagcagacattaactccggacgggtagttgcaatcattactccttcatcttcaggattagcctctttgcctgaaactttagaactggctatattatcataagaatcttccatagctggcgggaagttaacatagtttaaaaatgtttcattatcgctgtattccacttctgcaaaagcaatagctgtttcacaacgaggacaccagttaaccggatggattccctggtaaatcaatccttcatcatacatttttaaaaaggaatactgtgtccttttcatgtattccggagtcattgtaataaattcacggctccaatcctgtgaaaaacctaaagcttgcatctgatctttcattttagctatgttctgggtagttaactcaatacaatactctctgaatttagctcttgaaacatcatttttcttaattccatgagtttcttcaactttaacttcagtaggaagaccgtgacagtcccatccctgagtaaatagaacgtctaatccttttaatctcctatatcttgcattcatatcaatataaacccaattcaatacatggcctaaatgaatagaacctgttggatatggtggtggagtatcaattatatatctaggtttagttccatcaccgaggaatttataaagttcctcatcttcccatttttgctcccaaatcttttcttttttaaaatcatagtctttaggaatattctcatttgacatatcttttctccaaataattaaataaaaataatattattaaatatgtatttctttatttaaaaatatataagaaaaatttaaattatccggaaatcctttttgaaattttgttgaatcaaactaatattttaagatgcattccttatttatacatccatacggtttagtgctgtttattctactgaattttcattttatttttatttaacgatgaatttcaagaggtatttaatttcttcattaatatctcatcagataaattcagtatcacagaatttaaaaaccatataacagattaataattaaaataaatcaatatgcaacttctgctgtaaaaaaaattagaaaaatttcaacagagtcagaaacttaataaaaacagatactttaataatgattaactacactaaataataaatgtataaaagaatataaaaggactgttaaaaatggaattattatggttttatgttgcaatcgtattagctataagcgacacaatccacacacaaatcgtatggaaaatctttaataagttctaccttattttaggaggaataattaataattcagtaaatgctccatggaaaacatggattatacatgaattaatggaagcaggattccactttatttttgtgtctatagcatttttaaacttagaaataggaatattagcagcatttattcattttgtgatagatgtaagccacacattacttattagcagtcatatgaatgaattagaacacagatcattacattttgtaattgaatcattattcttcatagctatttatggattataaaaataattttattggagtatattaaatgccagttattacattcaaatatcaagatttaaaagatttaggaatagatatggaaaaagacgaattgataaacactttaccaatgatgtcaagtgatattgaagactttgatgatgaagaaatcaaagtggaatttttcccgaatcgtccggacaatttatctgtagaaggagttgccagatcttttaaaggctttatcaatcaggaaacaggacttccaaaatacgaagttacaccatcagatgaaagtgtaattgtagatgccaaagtagctaaaatcagaccttatattgcatttgcaaaaatcgaaggtgtggattttactggtgacaaacttaaatacattatggatttccaggaaaacctccactgggtaatcggaagagacagaaaaaaagtagctatcggtattcacaatgcagatgttgtatcccagccatttaattacatagctactcctaaagatgaaaatgcatttgttgctcttgaaaaagatactccaatgactcctgaagaaatattaacccagcatgaaaaaggagttgcctatgctcatcttcttgaagattttgataaatatcctttaattttagacaaggataatcaggtactttccatgcccccaatcatcaacggagaacttacaaaaattgatgaaaatgtgaaaaacattattgtagatgtaactggaactgacgaacgtgcagttaaccagtgtttaaacattatctgcagttcatttgcagaagtcggcggaaaaataaaaagtatggaagttaaatacgaagacaaaagcataactactcctgatttaactcctcaagtaaaaaatgtccatgttgatgtagctaacagtttaattggtggaactgacttaaatgctgaagatatacaacagttattatcccaggcacgttttgattcagaaatattaaatgacaatgaattaaaagtttacattccatcctacagaatagatatccttcatgaagtggatgttgttgaaaacattgcggtacaatacagaattaatgatgttgaagctaaacttccagacatttcaacaatagcttacgaacatgactggttcagatcagaatcccttatgagagaagttatgattggattaggattccaggaaatcatgagtttaatgcttactaatgaagatgcacacttcagcaaaatgaaacaaaaggaaattgaccacgttcaggtagcaagacctattacaattgacagaaccatgattcgtaccagcctaatcaacagtttaatggagtttctagaagacaataaacacgaagatttacctcaaaaaatatttgaaatcggtgatgtcctatacatggatgaaacccaggaaactaaagtaagagcttccaaaaaactagccggattgatttgccactcaagtgcgaactttactgaaatcaaatctgttgtaaccagcttacttcaaaacttaggttattccatggaaatcagcgacagcaacaatcccagttttatagctggaagggtaagtgatgtaaaaggaacttcagctaatggaaatatatccggtttcttcggcgaattctctccggaagtaatcactaactttaccctagattatcctgtaatcggatttgaaattgaatttaacccacaggaataattcaattttctaattactctttttttaattttattttatcaaaggatttaaagataaatcacttataaacaatttttccaattattagacaatttagataattatcctgtcaataccacagttttttcatttgaacatcaatttcagagtaatttacatcaggattattctgagaagaattgttaactgaaatgctttgtgaatcttcaccaggctgtgctgtttgctcaacagctatcaaaacaccgccaacagccataattacaattaaaaataaaacccagttattcatggttattctccgattacagttatattaattatcctgttgtgtcttggcccgtctaattctataaaaaatactgactgccaagttcccaaatttaatttattgttagatattggaacagactcactagaagagagtaaaaatgattttaaatgagattcagcattattatcaatattatcatgtttataactaaatttattggaaattatattagataacacaaattccaaatcttcaagcagaccttcctcattttcatttacacaaatagctgatgtggaatgtttggaaaatatatttacaattccattactgatattggaattagctattatttcattgattttagatgttatatcaataatttcaaaagtcttatttgtatccaaattaatctcaatattttcaattagcattataaaaatattatatgaaactagtatttaaaaattaaaaaacaaataaaacctgtaaaattttacagactcgaaaaattaagaaaaattcataatctaaataaaataacctgtaatatattacataaatgcaaatgtttcaggaggtaaataaataatattatcttctttgacaatatttgatttggtatttgaaataattataccatgagaagaattatatgtactaatagcacgtttaatttgacttttatcctttttaccacagcttacttcaattggaataggtttttctaatcctctttgaacaataaagtcaacatttttcccactactttttttattgctgtcatcatagtatattttataatttatgtgatttttattatccaaatcatgaaaacttgaagctacataagtttcaagcagttttcccatatatgctgtttcatcctcaaaggtagcattgcctatatttaatataagattatgttttaaacttgatgttgcaaaaaaatattcataaggttttgttgttcgttttactgatgaagtaaacggttcaatatgaaatattaattgtgttttttcaagaatatttaatactttagtgactaaagcaatcttggcatcaaaatgatttgaaagagaaccttttgaaacttcaccgggattttgaaaagcaaaaaaattcaaaatctgaaaagcaagatattgtgtatcattatttatacctccaatattggccatatccgttgtaacaactttatccaccatatcaacaatttttttagttatatcattagtattttgataaaatgaagatggaaaacctccaaattctaagaaatttttccattcagacatgtcatagtttgaaaaacttgaatatatattaattattcttctttctaactctgcaatattttgcacatttccgtcaaaaatcatttgaattaatgactctgaaatatcatttttaaaatttccatattttaattttaaatgttctgaatatgttaacgggtaaattggaatatttaataatctccttgcagcatcaggattataagaaagttttagtgcagatgatccactgaaaatcatgaaaatatttttagtaccgtcaaatattaattttccatttaatacccattctttatcatattgtgcttcatcaattaaaatgaatactggtttagataatgtttcaattattgaattatgatatgtttctaaataggaattgacaacactaaaaatatccgcattacctattttttttaatcgatcacaagaaaaatacaaaatattttcaggagatatccctctttcttttagaagatattcatatacctgaaatagcagagttgtttttccaacatcacgtacccccggtaaaacaagaaaacgatttatattatctccttcaagaaaattatcaatatattttataatattatcataatcagaacgtttattaaattttttatctttgtgtgttaactcctgatttaatttcataggtactgacaatatttgatttctaatatatttattttgcaattcgttcattgttttgccccctcaaaataataactattactatatatagtcatagttatttatatatactactatttttaacagttatagttatttatatataactaacctttttaatcatcatagttttaaaatttaaggttacatcatcatttagtttatttgtatccaaattaaacctaatatttccaattatgaaaatattatataaaaccagtatttaaaaattaaaaaaaagaaaaatgaaaaaatgtttatcacattttatttttacgtttatatcctattattaataaaaccaataaagcgattattgcaagaataataactcctgatgtattttgaattactttagatattttatttggagacactagctcataggattttccttcttttgatgaaccgtcatcacttggagaaccactgctgtctgaagattttgctgcactttgatctcctttagccatagcatctttaccgcttaaagattcatatttctgatagtaatcagaactatttgttccaagattttgtgaaaattcatcagagtttttgatatttgcaataccactctcaccagaagcatctcctgaaccagaactgtcaccagttttattacctgagttatcaccatcagaaccagacggtttgccgtcagatcccatgttgtcatctttaccagaatcaccattacctgaatcgtcttttttattataagaaattacattctgctttatttttttaatttcctgattatgttctccgccaacctgaatttcaacttggtggtcaacattaggatctactttaattactgccttaccattttccaaagttgcagtatacatattaccgtcaacttcaacctgaactgcaatagttccagcttcttttactggagtatcatcttcaaccatttgaattcctataccgttaggtaatgatattgcatttaaccttaagattttggcaagcaacagcgggcagacaaatgtgttttcagggtcatcagaattaaaaaaattcggacctaatgtaatcatattctgtaaaggattatttttagcctggaagttttcattatgtgcaaatgaattatatgacacataaactccattattagctacagcactatatgcatccccgaataaaagaccattaccagattcaaaaccacccaattcacagtcagggttttgaatattgtgaatcatggtatttgctttaatttcatctccccaggactgacaatttatataaataccatttgtattgtaattaaggaaattatgagtataggaattgttaaaagatttgccgtataatgaaattccgttaaaactattattgcagcaataatttgaagttatattggaattatcaatatcataaatctcaattcctgatctgccattgaacatcattgtgttattggctacataacaactggaaacatttttaagctgaagcccgttttccttggcattatttaaaacatttccaaataaagttacattctttgagtttttaaccaaaacattatttccggcatcaacaatagaattttccctaataatggtattgtccgaattatcaacaataactccataatctgatgatgcagctacaatattaaatccggataagacactgcctgcactattttttgtgaaataaaatccaaaagttttatcaatatttaactcctgagctttattggacagctctccagatgtataaaccgtgctgttaacattagagataatatttacttttttgtcaacaactaatgaaatccccttatattccttgctaacaaaattaaatgtatctccctgtccagcattatccaacattgattgaatgtcatcattggacaagtcggaagaaacatcatagatagtagttcccataacaatgtcatcattactgtattgtaattcatcagctccgtagacagatgaaatcaggattaaacctaaaagacatatgataaaaagatttaacagttttttatatttcttttcaatcatgtcaatctaccatcaacatacattataaatcaataattatattgattaaatttgtatatggaaatcaaagcatataaatattttcaaataatttagcactttataaacaatttaaacaaaaaataacaattataccctacttttaaagtaaatatattaaaaattcaaatcgaaatatttattataactataaacaaacgatatatcattaagtacctaacaagtatttaatatcattaaatgaggtagaataatgaataagaaaggattgatattatccatattcatatcattaattgttattttatcttcaggctctgtttttgcagaagacataagcaatgcaaattctgatgacagcgcttcaagtccaatagcaaatgatgcagtttatggagaaataacaacatcttcaaattatactgttcatactggatcaaatagttcaactattcaaaacattataaacagtatgcatgacggggatgtattgaattttgaaaaaggtgaatataaagacatttgcatatatattgataaaaatattactgtaaacggtaatggtgcacaattaatcggttatcaaacaccgggaatcaacaatacaaatattccagatattgttaaaaacacaacaaaaactggaggatacggaataagtaattttgcaactgtttatattcttaaaacatcaaatgtaaaacttaacggattaactatgattagtttaaacagcacaacttattccaatgctgtactttacgcttaccaatccaaaaatttagaaataatcaacaataccataatcggatcttcatggggtatttatttacagacttgtgtaaatactacaataaatcagaataccattaaaaatcaggcaacaaccggtattttaaactttggatctgcaaaaagcataataaaaaataataaaattacaaatgctgtaaaccacggtattgacataagacacggaaccggaccaaacgtaacagtattcaacaacaccatcatcggttcaaaagaaggaatataccttatgcattccggaggacatactgtatataacaacacccttattaactgtaccatcagttcaataacctgttatggttcttctaatatttacatatacaataatacaatgttcaaatcaagaatgggagtattattgggttcaggattttcaaatattaccattggtgaaaataattacaacttagctaatttaccttaccctcctacttttgtatattatgttggaatcgcagattctgcatatcaaagtccgcaaagtgtaagtggaacttatagtgacagcagtacttattctccagaatacaccaataaaattgatattgaagctcctaaagatattgtaattgattataatggaatattaaaacctactggaactacctacactgttcctgtcggcactgcaagtgaagatattcaaaaaatgattgattcaatgaaagacggagacacattatcctttgagaaaaacggaatttatgaaaatatctgtatttatgttgataaaaacattaaaatacttggaaataatgcaacattaatcggatatgaaacaaaaggtgttaacaactccaatattcctttaaaagtatggaaaaaaactaatgaaggaggatatggatgcgtttacttctcagtattatatttattcaataccgataatgcagttgtatctgatttgaatatcgttggaaaagctccaggatataatccaaatactgttggtacaactactgacgaatataaaactacttcaatttactcagaatccaataaaaacataacaattaccaattgtgatgtaaaaggatcatcatggggtattttcttacaatataataaaaatgcagttattgcaaataacaacatccatgaccaatacacaacaggattaataaacttcggatcagctaacagtattattgcaaataacacagttaccaatgctgtaaaccacggtattgatgtaagacacggaaccggaccaaacgtaacagtattcaacaacaccatcatcggttcaaaagaaggaatctaccttatgcactcttccggacacaaagtatacaataacactattattaaatgtactttaagctctataactgcatacggttcaggtaatgaagcaatattcaacaacacattaagtggaagcagaataggcataattgttggtggcggatactacaatgtaaccatcggcagcaataattacaatttagacagattaccattccctccatcattcccatactacattgttcaggcagacaataaataccaaactcctgacaaaacacagggaacttactatgactctgcaaaagaaccaaaagcagttattatcgttgatgacattaccatgtattataaaaatggaactaaattacatattactttaaaagacaacaaaggatataatttagcagatactccaattacagttacaataaatggtgtttcttacaataaaaccactgataaaaatggtgctgttgaaatgaatatttatttaaaacctggagtatacactgcaacagttgcttatgcaggaaataaaacaattggagcaaattccgtagatgctaaaattactgttttaccaactataacaggtaacaacataactaaaatgtatcaaaatggaactcatttcttcgctgcatttgtaaacggtcagggaaaagcattggcaaacaccaaagttacatttaatatcaacggtgtattctacaccaagcaaaccaatgataaaggaatagccaatttaaatatcatgttaagacctaatcattatattttaactgcatacaatcctgttaccggtgacgaacaaggatttagcgtagatgtcaaatctttaattgaagctagtgatttaactaaatattacttaaacgcttccagattccaggcaacaatatacaacaaagacggatctttagcagtaaataaagaagtaatctataacatcaacggtgttttctacaccaaaactactgatgaaaacggtgttgcaagcttaggaattagcttaagacctggaaattacattattacaactatagttgacggcttggctatgggtaataacgtaactgttatgccaacattagtaactaaagatttggatatgaaataccttgatggaagtgactttactgcacaaaccttagacggtcaaggaaatccgttagctaaccagaatgtatcatttaacgtgaacggtgtattctatcacaaagtaactgataaagacggtattgcatcattaaagataagattaatgtccggagaatatatcattacttcatactggaacaatttccaaactggaaacacaataaaaatagcataaaaagaggttaaaaacctctaattttttcttttttaaaaaaataattttaaaatcagtaactgtttcttctagaataagctatataaacaatgaatattcctattaaaagaagaactatttgtggaaatattgcaaataaaacaaccggaatcaatttcaattctgctaaaatccataaaagggcataaactacaattaaaattcccagaagcatagccattttattagctatttccctaaaatcatatggaattccacttggtattggcattataacaccttcacaattcttttataccttcagaagtaccaattatgactttatcaaccatctgagtaaaaataccattttcaacaacacctggaatagaatttaaatctatttccaaatgcatagggctttctattttttcaaatttggcatcaatgacaaaatttccattatctgttataaccggtccgtccttacgctcacccattcttatttcacattctgcacccatgtcctctaaagtttgtataaccacacgtgatgcatcaggaattacttccacaggtaccggaaagtttccaatttcttcaacatattttgattcatctacaattacaataaattgttttgcagagtaatccacaattttttccttggtgtgagctgctcctccacctttaacaaggttaaggtttttatccacttcgtctgcaccgtcaacagccaaatcaatgtcatgctcttccaagctggtaaccggtatgttccactgtttagcaagcagtaatgactggaatgaagtaggaattcccatgacatttattccttcatcagctattcttttgcctactgcttcaatgaaataatgagttgtagatccggttccaagtcctaaaatgtctccgtctgtaacatattctgctgctttataacctgcttcttttttaagattcatatttatcatatccttattttttaaataacaaaacctaatgtaagtttattaagtttatatccttttttgcattcacctttatgtttcccatgatttttcaaaacaatacatttgtctccgtctaccagtccttcagggaaacagtaatcataatattcacattcttcatcacagtcagcagattcataggaaaatgtagatccttcaaaaatactttttgatgaagaaagtaatgttatgttagatctgtcaacttccactggaataactgtattttcagcatgaaccgggcacttttgttcattgtcacgaacatcaatgattttatatttcctatttttttctaaagagtcaacacatgatgctttaaatctacaattttcgcattcatctacagaaccataaaaaataaactcattacccttttttgccaaatctttaccaattaatgtaatcattttatcaccccagtttttagagctaactcataagctgcatcttcagatataccgttatcacctaaaattgtatatctttcaggtctaatagtatgtgccattgttaatgcatcaatgacattttcatcactaattcccaattccttagcagatgttggagctccaacagcttttaaactatctctaataaatttccagtccccaccatataaatacatcatcaatatagttccaacaccgcactgttcaccatgcagacagggtttatctaaaattttatccaaagcatgggaaaatgtgtgttctgatccgctagcaggacggctggagcctgcaatacttatagccattccactgctaaacaaagttttaacaacaagacgtgcactttcctccaaaccaggtttaatactgtcaacattgtcagtaatcatttttgcagacattatagacaatgaagctgcagattcactatatgactcgttttttaaacggtgagccaattgccaatccttaatagctgtgaaatttgagattaaatcagcacatcctgcagacaataatctgaaaggtgaatttgcaataatcttactgtctgcaataacagctatcggtgcatgggctttagcagatgttgaagttttaggattttttattgaagctaaaggagatacaataccgtcatgtgaagcagtagttggcattgaaacaaaaaatacatttttatcatatgaagctaatttagctacatcaataacttttcctcccccaacacctaaaacattagtgcctgaagtaatcatttcactgacttcttctactgaatcatatgatactttttcaacaattttaacatccacttcaatatcctgattttcaagactttcaatagcatgttttgctgcaatatcatatgtattcggacctgttagaaccaaaactttattgtccaaatgcaaatccttgcagatttcgccggtttcatatataacatcaggtccgatgtatacttcacggggcatttgtatttttctagtattcataatatctcctaaacataatatacatttgtatatctttaattagtagttataaataacttattattttagactgtaaaaaattttctttaaatagatttaataggcattaacaactgatatataattattataaaaatttaattaaggtgatatggtggaaaattttagtgaatggtttcatgacatattagaagaagctaacataactgattcaagatatcctattaaaggaatggctgtatggatgccttacggtttccaaataagaaaatatacaacaaatttaataaaagaagtatatgaccgtgatcatgaagaagttttatttccacttcttgttccagaagcagaactggctaaagaaggattacatgtaaaaggatttgaagatgaagtttactgggttactcatggaggtaaaacacaattaaatgaaaaattagccctaagaccaactagtgaaacatcaatctatccaatgtattcactatggattagatcccatattgatttgccgttgaaatattatcagattgtaaatacattcagatatgaaacaaaacatacaagaccacttattcgtgttcgtgaaattactacctttaaggaagcacatactgctcatgcaagtaaagaggaagcagacattcaggttcaggaacatattgaaaactataaagaaatctttgatacattaggtattccatatactttaacaaaaaggccggaatgggataaattcccaggggcagactatacaatggcatttgatgcaattatgcctgatggaaaaaccctgcaaatcggtactatccataatttaggccaaacctttgcaaaaacatttgatataacatttgaagataaagacggagaacataaactggtttatcaaacatgcgcaggtttatctgatagggtaatagcttctgcaattggaattcacggagatgaaaaaggattacgtcttccacctgaaatttcaccaaaacaaataactataattcctattttatttaaaaaaggaaaagaagaagttttagctaaatgtgaagagcttaaaaaagagtttgaagctgcaggattacgtgtaaacattgataatcgagacatcaggccaggtaaaaagttctatgactgggaattaaaaggaactccaataaaacttgaattaggccctagagatttggaaaacaacaagacaatagctatgcgtagagaccagctggaaaaaatcgaacttgatttagatgaaaacctcgtaagcaatgtaatccgtttaattgatgagttaaatgaaaatctcgctgaaagtgcaaaagaattccacacagaccacatcaaatttgcatctgatattgatgaagtcagaaagctaattgaagaaggtaatgttgtagcagttaactggtgcggagacactgactgcggagagaaaatagaagaaatcactggttattcagttttaggtatctatgaagagcttgaagaagcaggcaaaaaatgtatactcagtgacgaagatgcaaaatatgttgcattaatagctaaaacatactagagatgaaactatggatgacatttatggaataatacctgtcagtaaatttaaagaatgtaaaaccagattatctccatttttaagtgaggaagaaagggaaaaccttctaaaagtcatgcttaaagatgttactgatactttaagaaaatatactgataaaataattataatcagtgctgatgaagatgttttaaattatgccaaaagcttaaatttaagtgttttgaaagaaaatgacaattcaaatttaaataaagcattaaaacaggctatggaatattgtaaaggcaaaaccaaaaaagtaatcataatgccatccgacattccactcatcggtaaaaccaaccttaaaatggtaattgattcaagcaaacagcttgatttcattattattccttcaaaaggcgggggaacaaacactataattatgaaaccactggctatcagaaccaaattcggagatttcagctataaggaacatgtaaatgccgctgacaggaaaaacttgaatccgcaagttcatgactccttatttatggctttagacgtcaatacaactgaagatttaggggaaataatagttcatggtgaaaatactgaaaccagacgttatttaaaagaactgaaaataaatgttgaatcagtacacggcagcgaacgtttgaaagtcacaagaggcagttaaatgattgtaatgtcaatagctggagtagacccttcaggaggagcaggtatccttgcagacatcaaaacatttcaggcacttggtgtttacggaaccggaattgtaactgcacttactgcccaaaacccccaaatgatgtactccctaaaagctattgaaactgactatgttgaagaacaaattgatgcagttttagacagctacaatgttgaatatatcaaaacaggaatgttatattcaaaagatatcatcaaaacagtttctaaaaaaatcagagaatataatctgaaagctgttgttgatccggttatggtggcaacatccggaggagaattagccaaagatgatttgagtcaaaatctgcttaagtatttacttccgaaagccatcctaacaactccaaatgtttctgaagctgaaaaattaaccgggattaaaattgctgatgaagaaaaagctgaaatagcctgtgaaaaattaggaaaaatctgtaataacattataaccggcggacatctaaacggaacaaatatcacctgtattgatggaaaaatcagtacatttaaacaggaattactgaaaacagataatgtgcatggcagcggctgtaatttctcagcagctattgtaagttatttaagtcaaaaaaacgatttgaaaacaagtattttaaaagcttcagaatatacttacgaaagtataaaaaatggaaaatatggaactttaatagctaaattatagctattagaaatcttccacatttaatttatcaagtacttcttcttgaattttaataaattcttcggattctctttttctaagtcttggcatatctacatcaaagacttctttaattttacccggatttttatccattataacaattttatctgcaagataaatcgcttcatcaacatcatgagttacaaaaacaattgtatttttaaatcttttccaaactccaatcagctgttcctgaagcatgtgcctattttgcatatccaatgcagaaaatggttcatccataagcaaaataggtgaatggttaagcaaggatctaataattgcaaccctttgtttcataccacctgaaagttcatgaggataactatctttaaagtcaattaaaccaacactttcaagatatctttctgcagccttaagattttcctctttagttctgtcttttttgagattaagaccgaacatcacattttccaaaactgtcagccatggaaataatgaatattgctgaaaaataactgccctatcaccagatggttttttaacaacttcaccatctgctataacttcccctgaagtcggttggtcaagaccagctatcaaacgaagcagagttgttttaccgcaaccggaagggcctaaaagacaaacgaattcaccatccccaatatttaaattaacatcatctaaaacttttatatcatgatccaaaccgcggccatgaaaagatttatttatatttttaatttcaattgccattttaaactacctaccagaatactcttttttctataagtccgaagacataatcaaggattaaaccaatcaaaccaataaccaacatacctacaacagtagtacctgtatcaaataaatttgtagctgttaaaattaaatatcctaaaccgctacttgaacctatcatctctgcagaaatagtacacattaaagctattcccacaccaactttaagtccggaaactataggcggtactgcagaaggtaaaataacctgtgtaagtactgttttatcatctgctcccagtgtttgtgcagattcaattaaaactttatcggttcttttaactccatcaattgtgtaaataagaatcgggaaaacacagcctatgaaaataataaatatagcaggagctgttccgattccaaaccacaatattgaaaatggaatccaagctatcggaggtattggccttaatatactgattacaaaactacataaagtttccaacttgctataccatccaagcaatattcctaaaggaatagctacaatagatgcaagaatcataccaccaaatactttaaataaagtatccatagtatcaacaaaaagttttccagattgtattatattccatgcagaattgcagacactacctggacttggtaagaaataaggattaactaactctaaaacagaagttatgatataccagataattataattaaaattggtaaaattatcggtgtgaacttatctttattcattaaatcacttacataaaattttttttacaattattaatattgattgtatttttatataaatatttcacatgattttaagtagataatcacaaatcaaaattgtatccaaaggtatatatattgcaaaaggtaaaataaatgttacataaaataaaagtgaggtgtagctttggaagcaaatagaagatttttttcaaaaattggatttaattattttgcacttggaataatcgtattggtgctaaatctattcatcggattatttataagcataattaatccaaatcttttatctaatcaaacaatgatgacatttttctcagctatttggacttatctcttacccttaccaatatttatttatataatgagaaaaacagaagcaaaaactcttgaaaaacataaaatgaccgttaaaacatttgtaatatgcatatcaattacaatgtttttaatgtggatcggaaatataatgggagttattataacttcaggaatcggctcactgatacagcatgaggtagccaatcctattaatgatgtgataaacaattccggtttagttgcaaacttgattataataaccacaatagctccaatctttgaagaacttatattcagaaagttattaattgacagaactataaaatacggaggtacaatctcagtacttctttcaggattattattcgcatttttccatgggaatttaaatcagtttttctatgcattccttcttggaggattttttgcaataatctatataaaaacaggacaaatcaaatatacaataggattacatatgattataaatttcataggatcagttgtcagcctatttgtctcacaaccattaatggacttggctaacggaagtgtgatttcaccaacaagcacatttggtgttattttatacatattaataactttaggattaacagttatgggtttgatttattccatcaagtatttcgataaaagccggtttgacggaagcgaaaaggaaataattctaaaaaatccagtaagtacaatccttttaaatccggggataatctgttttatattactgatgtcatatacaatatttacatcaatagcttaaaaaataaaataagaagtttatgcagtttctactacattaacttctatttcccttggttcttttaatacagaacgtgtacttaaagctcctaaaagcatagttgataaattatgtatcaatgaagatgttgatggagttataattccaaacatacccagtgctattaaagaaccgttaatgccaattatactgtgataattagtatctattttatttaacataccaacactcaattttctaagtgttattaaatcatataaattatcagacaataaagaaacatctgcaacttctctggcaatatctgaagagtttttcattgaaacagacacatcagcagcagccaatgcaggagaatcatttattccatctccgaccataataatagttctgccttcttcttttaaactttcaacaatactggccttatcttcaggaagcacctgtgagcggtattcagttatgcccaatgcttcagcgctgctttttgcaccactttcactgtctccagtcaacatgataacattttcaatacctaattttttaagctcttcaataacatccctagcttcttttcttacagggtcgttaatacatatgataccttcaagtttattatcaatagccaaataaacaaccgaatattcacagactttttcgtcaatgagtttttcatcttctttggatatttctacaccttcatcatcaaataaaaagtgtctgcttcctataacagcacgtttgccattataacttgttgcaataccatgagctacaatatattcaacttcactatggtcttcatcatgttttagaccttcctcttcagcctgttttacaatagccgtagcaatactatgtgcaaaatgctcttcaatacatgcagacattcttaaaatttcatctctggagtaatctccaagagaaattacatcaacaacttttggagttgcattagtaagagttcctgttttgtcgaacactattgtatctgcagttgcatatttttcaaggaattttccacctttaaccatcatcctattatctgaagcttctttcattgctgaaataacagataatggagttgttaatttaagtgcacatgagaaatcaaccattaaaacagacaatgcttttgtagtatcccttgttatcagataagtaaggaatgttgtaaggaaactgtatggcacaatagagtctgccaattcctcagctttactttgagcatctgcttttaattcttctgaattctcaataagatttataattttatttaatctggtttctttatcaaaagaataaacttgaacaatcagattaccttcttcaacaacagtacctgcatgaactgtttttccaggcattttatggacagccaatggttctccagtcatggttgcttcattaaccatcccttcaccgtcaacaactttaccatctacaggtattacatcacccatatgaactttaattttatcatctttgttaatttgggatataggttgttgtatttcctcaccatcttcatttactacccatacagtatcaatatttaaagttaaactttcttttaaagtattttttgttttttgtaatgtgtagtcttcaagcaaatcggaaattgataataaaaacatcatagaacttgccggatcgaaatctcttttaagaagtgatccggtaactgctgcaccatcaagtagagcaacatccactctgaaacttgttaaactgtctaaagcatgccatatatacttaatagctctataaacagtcaataaattcctaattggaataggcaatacaattttacctaatacccttctcacaagcatacctgataaactaacccaaaaattattagttaactcatttgaactcatgtacatgtcaggttcaacttcaaccaaatcatcctcagttattttatcaagtgctgcaaagactttgtctctgtttttaacatcatcataatagattaaaatacttccgtttctatgagatgtgaaaacttttttaataaaattattttctaaaagcaatgaagaaataccataaccctcctttttggtgaaggcagcctggcctgaacgaactctgatacgagttccgttattatacattacttggtatttcatgttttaaaccttattcgtcatcttcaacataaattgcttttttatcatctttattagcatcaacaacaatgtcctccgcattttgaaccatgtcctggtaacattcttcagcatctttttttgcagctaaaacagcagccatacccttagtacatccttcttttactgctttagattcaaggatttttttacctgcaatagctgcagctattcctccaacaaaaattaatgcgtgtttatgttccattaatttatcaatgtattcttccatattatttcctccgttataaaatattattaattaaaacctaaattatttaggtctacctaaaacttatattggttatattatataaatgttaggtatacctaaaaaaaacaattatgaaaacagataatttaaaatataacaattgttaataatatctaataagagggagttcatatggaatttatcaaaacaatagatgcaattaaatggaaagatggaaattatgaaaaaacagaagaaaaaactgttgaagacgaatatgcttacttatttattgactgcctacctccaagaaagttttcagtttatccgaaaaacttagatgactttgcaatcggatattgtcttggagaaggtttaataaaaacaaatgaagatatagaagaaattaaagtaagtaaaacaaatgtattagttaaaactcgtcttaaccatactcctgaagaggattttgaacagtacgatatagttcaaaaaagaaaaggagagtgcgaacatgcctgcgtttgcagattacttgaatatcagggagtaaattcagacaatgccggaggaataagatcccagttaaaaacagtgactccaaacaattccactttaaaaattgatgcaacacagattataaaagatatggataatttaaaagaaaatgccaaaatctggcaggatacaggaagtgttcatgtagctcagctaatttataaaaataaaagcatcataagagaagatgtaagcagacatgtagctgtagacaaagtcattggagctgcttttaaatcaggatatgatttgacacaatcatacatcacatacagcggaagaatgcctgcagatatgcttataaaagtaataagagtaggaattccaatcatcatatccaatgcagcacctgcagcttcaggatatgaaatagctaaaaaaggcaatataacaatggttggatttgttagaaataacagatttaatctctacagcgcaccgcagagaataaatcttgaaaaataaaattattgtgtttcgataacactatttaaaatttgaacagctttactgaaagcaggcattccagaagttaaaaggacaatttttaaaacatccattatttcttctttggtaatgtccaattctttcattccgctttttatttgttttttagtagctcttggatctgctcttgaagctgtaattccaatagctattaatttttgagtcttataatcaagtgcatatccgtcgtaaactacttcacttatatctttaacaagctcgtagaggtcaggatattccccttcaagttcatgaattccttttccataaaaaacttcatctttcatataaccactcccttaattgattggttattatataaaaaataagttatatataaatgtaatcagttattttcaatagcttcacgaacttttttaatagcgatttcctttttagccggatatgctgctattttaactttaagatgaattgaatctccagaatctacaattgtaattttttcgtcaactgcatcttctttagataatcgtaaaaataaatttcctttatcatcaactttgcgttccaaatcattatttaatttatcaagttgattttggtctaattctaagagtaaattaaaaaaagcttttgtttgtcttttcttatctacaacacctgagagtataatgattttatcttccattaatccttctgcatcttcactttcaatttcagcatctggaaatatgttgtagatggcctgagttaattcatcgagattttcactctcataaacaaactctctaaatctgatattatgaatcattttatcaaaaaaggtattaagaaaggagatttatttttttctccttgcttgttcactaccttttcctttggaagttaatccacgtcctttagttccagcactagttaagcctctgagagctctgttagtgtgttttttggagcaaatccaattgattttttcatcattaacaatagaaggactttgtggatctactaaaataacttcataatatttatatttaccgtcagcccatacccagtaagagtttaatacttctaaattagggtattttttagctacacgttcttcagcaatcctttgaatggatttagcttgggtaattttgtttacacccattcttttaggtttacgtcctccgataaaacgagatttccttcttccaccacgtcttactctggttcttactaaaacgaaaccttttttagctctgtaacctaaacttctagctctatcaagcctggttggtctttcaattctttgaactgctgattgccttctccatttaggagctctttcccacattaattcccttacataggattcatctgggtttttccatgcatctctaatatatttatacataataacaccttttgttcagcttttttaaaaagccacatccatgagacattgtctcgaaaaaagttatgtaatcgtcaataaatcaacgataataaaatatttgttttgtttatttataaagttatggttaaacatataaagaaaaattagtattgagtgttaacgaattatttataattaatcccatataaatattaatgaggatgaaaagtatgaaaatgcctgataaattagattcaaaactgctggctccctgcggaataaactgcatcagctgtgagagatatcaaaatccgtgtgcaggatgtttaataggtgatgacggaaaaactaaagccagtttgaaatgcaaaataaaatcctgctttgatacaaagaattttagctattgcggaaggtgtagtgaatttccatgccctcaaatgaaaaaacacagcaaaaaatacatcaaaagatatgatttaaatacacttgaaagtgccaaaagaataaaaaatatgggtattggcaaaataacagattcagaccgtgaaaaatggacctgtccacaatgtggcggagtaattaaatttcaaactaaaaaatgcagtgaatgtgactattcattataactctttttttaaaagtaatacttatggctaaaataagcttataaaagtaatactcccttattttttaaaaaataatacttaatatataaataaaataaaaaaaaagtaatacttaatacttttaggcaaaataaagtattttagtaatactttttttagtaaaccttattaattattacgataataaaaattattaggttgttattatatcatactaaatattatattgatattactaacaagctacttttttaataattaaaacgaaatgtgaaaaaaatggatagaaaatatcttataggtgcaatacttgtaattattgttataattataggatgtgctgtttatttcggacagtcacatgtagaacgtgctgatgacgaacttgtagttgcagcttacagtcacggaggagaaccagaatctggttttgatccgattttaggttggaactattattcagaacctttaatacaaagtactttattaaaaatgaacagaaatatgagttatgaaaatgatttagccactaattatacaataagtgatgattataaaacatacactgttcaaataagagatgatgttaaatttaccgacaacacaccattagatgctgaagatgttgcatttacatataatgaagctaaaaaaactggagctagcttagacttaagtaatatgaataatgcaactgcagtaaacccaactacagtacaatttgatttaaacaaatcagattccactttcctagataaattagcatatattggtatagtaccatctgattcctacaacaatgaaacttatggaagtaaccctgttggatcaggaccatataaatttgctcaatgggataaaggtcagcaagtaattttagaaagaaatgacaattattatggagaccaaccggaattcaaaaaattaactattcttttcgctcaaaatgaagctgcatttaatgctgctaaaaataaagaagtagatgtatctgctgtacctttagcttatgcaaaagaaaatgttgacggatacaatatgtatctcatggacactattgatgtaagaggaatttccctaccaactaaaatgaatactggtgaaaagaatcctgacggtggagatgtaggtaacaatgtaactggagatatcgcaattagaaaagctctaaactatggtattgacagaaccagcctttgtgaaggtgcattaaacggaataggatatcctaattacgatggaattgctcaccaattaccatgggcaaacaatgcaactgctattgaagacggagacattgcaaaagcaaatgaaaccttggaaaaagcaggatgggttgacagtgatggtgacggaatccgtgagaaaaacggaaccaaagcatccttcgaattatattactcatctgatgctcctgaaagacaagcaattgcagtttctgtttctgaacaagcaaaagaaatgggtattgaagtaaaagctattggttctaattgggatgaaatggatggaattaaaaattcacaggcaattgtctggggattcggaagtactgacccgtcaacaatctggtcagaataccacagttcccaggcaggtattggatacaataacccatcatatgtaaacgacagtgttattgatcaacatattgacaatgcatttaaacaatcacgtgaaagttcatattccgaatggtctaatgcagtttgggacggcagtcatggtatttcaccacaaggtgacgcatcatggttatggatcggtgaaatcaaatacggatatttcgtagatgacagcttagacatatccaacgatactgctcttttacaacctcacggaggagacatatttggaaacatatatgactggaaacgtgtttcatcaatagaaaaatgatttaaatgattcaaatcatttaaaatcattttattactttttttggacaacgatattatgtcaaatcatgaaaaaatactcaaatttttaggatatcggctggtaagatttatcatcctacttattgcaattattataatcagttttataatggtcgatttatcaccaataaatcctgtaaagacttatatcagtaatatgattgtcagtccagaacaagttgcagcattggaagcctattggggtgttaatgaacctataactgccaaaataatgaattggttaggtaatattattcatggtgatttaggaaattcattaatatttagaatacctgttatagatgttattaaagaaaaatttttcgcatcattaatcttaatgatgacatcctgggcaatatcaggagttcttggatttttattaggaattgttgcagggtataaaaaagatacctggattgacaaagcaatcaaagtttactgttacattttacagtctgctccaacattttggattgcattaattatattaatggtattcagtattcagcttggatggttcccttcaggacttggagttccaattggaagtttaagccaggatgtaactatatgggaatggttaaaccgtttaattttaccggcatttacattaagtatcttaggtgtagctcaaattgcattgtataccagagataagttaattgaagaaatgaacagtgattatttcttatttgcaaaagcaagaggagaacacggatggtcacttattaaaagacacggaatcaggaatgttcttttgccagcaattacactgcaatttttaagtttcagtgaactgtttggaggagcagttcttgtagaacaagtatttacatatcctggaattggacaggctgcagtttcagcaggtttaagaagtgatgttccattattattgggaattgtcatattcagtgcaatattcgtttatgtaggtaatttaatagcagatattatttacaactttgtagaccctagaattaaagaaggtgaagaggatggtcaataaaaacaaaaaaacatcaaaattaaatatgaatctaagaacaaaaacattattgactatatctttaatagtattacttttagttttagtaataattaccagcttatccataaatccaggagatattaaaacaaatttccagctaatgaaccaggctccgtcatttgaacacttattcggtactgactggataggcagagatatgtttacccgtacattaaaaggattaggattaagtatccagattggaattgttgcatcaatattaagtagtataatagcagtgattcttggattattgtccagtttcaacaaatattttgacacttttgtttcatggattgtagatttattcctgtctgtgcctcacatattggcaataattcttatttcaattgcattaggaggaggggcatttggagttactgtcggtgttgcattgacacattggacatccctaacaagagttcttagagctgaaataaaacagattcaaacttcagaatatgtaaaactatctaaaaaccttggaaaatctaaactttggatagctacaaaacagatattgcctttaattgtaagtcagataatagttggaactatattaattttccctcatgcaattatgcacgaagccagtgttacatttttaggattcggattatctcctcacgaacctgctattggagttatcttatctgaatcaatgaaatatcttgcaactggaaactggtggttagcactattccctggtttatctttattaataattgtattgctctttgatatagttggagaaaatattaaaaaattacttaatccggcaagtgcaaataactaggaagtgtcaagatgaataaactattagacgttaataatgtatcaatctcatttatacaatacacaaaaggattaaaacagcaaaatcttaaagtaattacagatttaaccttggatattgaagaaggagaaattttagcagtattaggttcaagcggatctggaaaaagtttattagcacatgcaatattaggcattttaccggataatgctgatttaaatggagaaataaaatataacggaaatgttttaaatcaaaaagcaaaagaagaaattcggggaaaagaaatttcattaattccacagtccgttaattttctagaccctttaatgaaaatagctgaccaggttattggagaatgtgaaactgaagaggaatgccgtgaaaaacaaataaaacaaagaaaaatatttgaaaaatacggattaagtgaagatgttgacaatatgtacccattccaattatccggaggaatggcaagacgtgttttaatttcaacagctcttctttcaaaccctaaattaataattgctgatgaaccaactccaggattagatcaaaaatcagttaaagaaaccttaaattatctaaaacagatggctgatgacaatgtaggggtactgttaattactcacgacatttatgcagctttagaagttgccaacagaatttgtatattttattccggttttgtaattgaaatagttgatacaaaagactttaaagaaggtaaaaacttattacatccatatactcaggcattatatgaagcattgcctaaaaatggatttaaactaactaaagggcatcagccattacacggagaaattccaaacggatgtccgtactatgaccggtgtgattctcctttagaatactgtaatgaaaaaagacctaacttaattaacaacatcagatgttttaaatacaatcaggaggaataaaatggaattaattggaaaaaacataacctacaaatatccttcttcaaaaaaatatgttttaaaagatgtggatatcacattaaacagcgataaaattactggactaattggagaaagcggaaagggtaaatcaacattatgtaaaatattatctaattatattccaaaatatgatggggaagtttatctggataatcagatacttcctaaaaatggattttgccctgttcaattaatttttcagcaccctgaaaaagtaatgaatccaaaatggaaaatgaaagatattttagaagaatcctggaatgtcagtgatgatttaataagtgaatttggtattcagcagtcatggatgagcagatatccaagtgagctttcaggtggagaactgcaaagatactctgttttaagatcactgaatccgaaaacaaagtttttaatagctgatgaaatgacaacaatgcttgatgcagtcacacaggtgcaaatattggattcagttattaaaattattaaaaaaagaaaaatgggattacttattgtaagtcatgacttagacttaatcgataccatttgtgatgataaaatttatttaaaagatattaataatatttaaactattaatatcttattttctagcttttcctactttacgggcgattaccaattccccaacagatattaatcctgcaaagaaattttcaagacctttggttgcccaaatagcctcaccaaaagtagcttcccttattgttgcttcataatcttcaggttttacttttttaccggttgcccttttagaaacaatagctgctgcagccattaattcatcccaggttacaccttttaactgtttgcacattgcaacatataacttgtaaactttaatatcataaagtgcagacaaaagttctacaatatcacaagcacgaatcattcccacaacctgattatcatcatttaaaacaggtacagtaacaaatttattgtttgctgtttctataactgcaagtcttgaaggtgcattttcattgatagtagttatttcttcataggaactcatgatttccttaattttatcattaccttcacgtaaccccttagtaatttcaaaagaagttacccatccaaccaaatgtttattatcatctacaacagggcatgtgaacctacgtattttttccatggtgatagaaacatctttaacactgtcctcaggacttatatatacaaattttttatccattaactctttagctttcataaaacaacccctttagtcaatttcaacaaagttcaacgccccaacaggacagtgacttgtacaattaatacatcttatgcatttatcattattcaataccactttctcttcatctaaccaaatagcttccacaggacagttctcttcacacaaataacagttaacacattcgtcctgattaatttcaagatttttagtgtgaacaataggtccgatagttctgtctaatttaacagagtcattttcgcaaaattgaacacaggccccgcatccaatacataactttttattaatgaccggatacaatacatcatcttccagttcaatatcaacatcaatgcccaattcttcaaaataggacttgaactccaatgtgaaagcatcagttgggcaaaatttagcacagttatcgtaattggcaagatcagaataatcaatagaaatatcattcattctaactaccctatgaggacgactaatactagctaaattatattcaatagcctcatcaccttcatcatgattatatgaaactttattgtctattaatttaatagctgaaacaggacatgtttgaacacatatttcacatttaacacaatcatgagtgattttagctattttaaaaatattagctggttcaatagcatcaaccggacattggtcaacacacatattacatcttatacaacgtggtgctatagcaatgatttctttttgagaaaagaatttatttaactcaaactgaaaatcatccccactatcatgtatttccacagattttaagagaatttcacgctccaaactacttatctgcttatcaaaagatatattcatactattaccaactgaataattttttatttaaatttaatttttgtttttaataattaataaagattatttaatttataaattcctttaaatcttttaaattagggaatttttccattccaaaaccttcaattgccttactagctacccaatttccaattttacaagattcttcaagagaataaccatttaatttaccgtataaaaatccactgttaaagctatctccggcacctgttgtatcaacaacactgcattcgtaggtgccaacatcacattcctcactatcagtaattgcaaaaacaccttcggaaccttttttaacaacaacagtccgaataccttcatctaaaatatgaacagctatttcttttacagacaattcatcagcacagtcaatagctttgtaataatcttcatacaataatcttaattcattttcattaattaacaaaatatctgttttatccaaaatcggctctaactcttttaatcctttttgaacatataacattccaggatcaaagctcagtaaagtattatcattaagtttgtccagcagttcgatttgagtcttgaatgaatcgccaacaaaggaagtgtaatgcattattttacattttgaaagattcaataaattaatttcatccagtactatttcatcattaactccaggatcaacataaagacagcgttcgcctttttcatcaacaaaacctaatactttacctgtgttgcctttatctgcataaatcaaattattagtataaacttcattcatggccaaattcagttcaatcaaatctccgtcatcatcttcagctattttaccaattatggatgttggacatcctaatctggccagcccgattacagtatttgctgcagatcctccaggagtatctttttgagatttaatgaaactttcctcatcattacatgcaatattttctactgtatgcaatttgtcaacattcaaagctccaaaacctattacatcaacattaatgtcactgtctaaaaattccattttaaaaccttattttagaatatctaataaattaatatttttgtctccaagttttccgtcataattacctgcagatatgctaattacaccatcaacttccaaagcagcatcaattcctgcttttacagcttcattcattgcatcttcacttactgcattaattacaatttcaggaatataattaacttcaccaggaactttagattcactgcctaaacgctcttttaaagaaggacagtaaacatgatttgtagtaggtccgatttcaggataattagtttccggttttgaagctgcagaacatatgtcaaatggtgcaatagctccagtaactgattgaattgcatcaagagctctttttccaccttccaaaacagcttcctgagtttcacacaaataccagaagttgcctcccatagtacctttgtttaaagataatttttcttcaatttggaaatcaggtactgcaattggaacattaatcaatttacggccatattcttctacagtccattcatagccgtcaccacaatgtccgacaatatccatcatttctatatattcatcacttttttcatcaggataatcaaaaaccctcataaatggtttgactaaaatatcctgtctaatcctgtaagataattcaaatgcgaatttttcaacattatctccaccaagccagtattgtaccactgcaccgtatctgccgtcaggagtttcgctttttgctaagaatccttcaactccaccttcaactcttccgattacagcacttggagtggatgttgaatcataagctgctctttcaactaattctttagtagggccggttattaaagctcttacatattggccttcaaaagcttcaaaaaatgtattttctactttttcataactcatcatattaccttcttaataattattaacctaatccaccaacgtcttcgccacggatacgatttctcatttcaatactttctttcaatatatcttcaaaattatccgaatcaactattttaataagtggatatttaatatttttaaatattctaaaaaattcttcattaatttgtgaatcaattttataatcttcaaataactttttaatattatctgaattattataatcatcaataaaagttaaaactgcttttttatcattgttagcataaatattagctattactgctgttgcaattgcacttggagatacgatagctatttgagcttcccttaacggataatcattaccgttaaaagatatactgattccatcatgctcacgggcaaatctcaatggttcaacatccgtaatgctgtctccaatatagagaatttcattaatattgatattgtcacgagatattatgtcatcaatagctaattttttaccttcaccgccaataacatcaatatttttaatattttcataaatccccattttaggaatttcactgaagaaaatatcatcgaacagctcataatttttaggattttccagtatctgctttttaaattcagcaattttaagtatttcttcatcaataagatttaactcatccatatcaacatcagtataatatgtgttttcaaatggaaattccataaaattagatactgcttcaatatattgaccatagctagtactaactatgtaagtattcatagcactttgaaggtattttaatagaaatcttgaatcgttaactacatagatatgttcccgtgaaaaattaatcaaatcttcatttttaagattttcaacagcaaaaaagggcaagattaatttcagtgtgttgcctgctttataattatcttttttaacttcatctacaagataatcatcatataaactaagaattttaaataattcatctccatcctcaatgaaatgtgcacataactcaaaagcattgtcatttaaagttaatggaccttcacagtctgtaataaatgatttttcaaacacataatcacctgaaattaactaattttattgcagttacaggacaaattgcctcacattgtctgcaataaatacagttttcctcattaaaagtaactttatccccttcaagtatcaatgcatcagtcggacaatttttaacacaaattccacagctttgacatttttcactggccaatgaaaagtcagcttccctttggcctttcagatcagacctgctgaagaacaaatcacatcctttactatggaaataatcatcataagctcggattgctccaaactgacagtctccaacacatcttccacagtaaacacatttattttcatctatgacaattggttttggagcatcaagtgatattgcaccagtcggacaactgtttaaacattcaccacatgcaatacattttttgtcaaatacttcaatgccgcggtttatcaaataagattcaaacagcttgccgaattttttaatttcaatattttcccctaaacttaaattcaactctctgttcatcatgtcattgacattatattgaatatatccctcataatcaacatcatcaaattccaaagataatgtttttgatattttcttaagagaaccgtttaatccaattaaatcaatagataatcttttcatatccttatctacaatttcagaaaccatgtcataagacttaatctcactatataatttaaatgcttttttacgtgaagaatatttaatagctgttgacggacaggaatgcatacactcctcacatcttgcacagtatcccggattaatataaggcaatttattagttttggaaacattgattgcacctgctgccggacaaactctggtacaggtcatacaaccgatacaaacatcctggttaacaataataacttttccgcctttaactgtttttggaagaagctgaccatatttaattgcatcagtcggacagactctaaaacaatatccgcatctgacacaggtatcaggatttattacactgtaagcttctccagtgtcaactgcatgaattttaattgaacctgttttacatgcctgaacacatgccccgcaggatttacataattttgtgttgatatttggaacgttttccttaattggttctgcaatatccacatccatatgtattgcatcataaggacaagcattacgacataatacacaaccaaaacaggtactttttattttagtaaaaccgtcattaggatcaacatatattgcttcaatcggacaggactcaagacatggcttgtctgtacaatttgcacatttgctctgattaattgaagattcaacatctacatcccttaaaggtcttggagttttagtataactatcaatcataacactcaacccataactacctcttcatttaaatttgaagctttgactgtaacatttactatcttttcaccattttcatcctcttctaaagagaatttggaaatgaaatatttaattgttgaaaacggacaggactgataacaaatactacagcgtaaacatttattttcatttctcacaatagtgtcattcttttcatcaaaggaaattgctttagtagggcaatccggaatacacatttgacatttcttgcaggtttcactatcccagtcaataattctaattttaagtctgttaatagcattagttaatatttctaaagctatctcttcatcagatattatttccaatgctttatcaaaaatatcggaaagcgggaaattatactgtaaaagcctgtcttttttcagggaccttaaatcttcttccttattgttaatgtatttttcaagaaaagttacaacctgagctatcagctctttttgatcttggatattgtcaacgaaaactcctttcatagcaccgtttaccggacaaacatcaagacattctccacatgaaatacatttaaatggatttacaacaaccttgccgtcatcttcaacatggattgctccgacaggacattgtttcatacattttttacatctgatacaaagataatcgtcaatgataaattgtcttttagaaggaataatattaaattcaggcttcaataaatgattttccccacattctaaagttttaggttcagtcggacagacttctgcacaaaaaccgcatctgatacaggcagatttatttattatcggataagtaacgccttcctttgtttcatcatcctcatcacgaactaatttaattgcatttggagacggacatgaagaaatgcaagcaccacaaccaatacaatattctttaattacatttggaaagtttctaaatctggatggtttttctacaatttccggactggttttggcattagtaaatccctgtgcccatgcttttctggcaaaatcataaatataccacatcaaagaagacattttaccttacctcaaaaatatttttagtagttgtattgccttttttatcagtaatagcaactctttctgcacatgcaacacaaggatcacttgatgcataagtggatactgcatctgcaacagtagcaacatccttaatcatatattttgcacaggaatccatatttgaaatacttggagtcctgatggaaatatgtttaattaaattaccgttggtttcaatcatataacttacttcaccacgaggagcttcatttctccattcagcatatcctgatttaatatcaacaggaacacgaatatctcctttaggcatgttttcaatagcctgcctgattaaactgatacactcaggtatttcatcaatcctgtttaaggttcttgcataattgtccccttcttttctccagatggttttaaaatcaaagtggtcgttgtaagtataatggtcttcccttaaatcatgctttaatccggatcctcttccaataggacctacagcttttcctttaatagcttcttttttagtcattactccaacattacgggaacgcattccaatagcaggaccttctgcataaatctctcttaatcttggaattctctcttcaataattttcagattatcaagaatcggtttgaaatgacgttcatcagcatccattttaactccacctactacattccaacccatattaactctatttccagttaacagttcaatagaatccattgcatattcccttatatccaaagattgcatatataatgtttcatgatcaatagatttgaaaaatgtagaattaccaagcaaatgactttgaatcctgtctaattcatttgtaataacccttaaaaactgagctcttaaaggtgcataaactccggagattctctcaatagtttctgcaaatgattgagtatgttcataagaacatattccgcaaactctttcagccaaataaatacctttttgccaagttttaccttcaattatcttttcaatccctctgtgaacataaccatattcaatttcggctttaacaactctttctccttcggtctgaagttttagccttatcggttcttttaaatatgggtgaatcggaccaataggtaatatcatttcttttccctcccacgattagcaatagcctgtggacccacagctaaaattgcctctaaaatttcactaggtctaggtgggcaaccaggtatctctgcatcaacaggtataaaatcagaagcaggagcataaacttttccaccttcctgattaaatacatctcctgattgaggacaatttccaacagccactacaatttttggttcaggagctttatcgtaaactctctttaaattatcaacccactgctcggtaacagcaccagtcaataataaaacatcagcttcacgaggattgttatgaacataaataccatactgctctaaatcatatcttggagaagttaatgcaaccagttcaacatcacacccattacatcctccgcaattcacaatacaaacatgaattgagcttttcctcacaacatccttaatagcatttaacatctataagcctctcaaaattattaattattatatttatactattcattatttatattctttaataaattaaataaatcctttctaccctcatctaaagcaatatcataagatttcccatcaataatctcattagccactttatttttaagttcatcaccctgttctacagacaataactccaatacatccacataccagggcaaccttaaatcagcatccaatctttcaagtaaacatttgtgattggcaatttccaatgttccatgtaatgcttctaaagaagacatatccaataaatccataaacaaatcttccaaatcttcagttgtgcatccaaattcttttgaaaaaggaattattatatcttcctgccatttaaaacttccaatcactctttttttcattaaattaagtttagcttcattatccatacaatcacaactagattaaatgcattatcaaataaacaataacagcagcaattattcctattaaagtctctatcctaccatatcccggtctttcacctattacaaaaccagccaaaagaagaccgacagctatcaaaccttgagaaaattgacaattaactgccagcatccaaccaataactgaaaccacacacattacaacatttaaacctttaacaatgaaaggttctccatgctgcttataactgtataataatccaattattgaccctataataaatgcaagtaaataaattaaaaattccaacataatatcatctctaaactggtctaaatcttattataaataaacatataatcactataaaagttatgacaaaaaataacttttctaaattctcaatatggtgagaaaaatgccctttaagagttaaaataattaatgcagtacaaaataacattaaaataaccatatatccaattaaagttgtatgaaggaaagtagttattaaagtaagaaccactgcaccaaatccaactaaagaagttaaatatattgtagctttatcattcatcatctcaacctcatacaaatatcattaaaagtgttccaacaaaacaaaccgcaccaattgttatctgagtcataacagaatggttcggatttaacattggagttacagcattaataaatccagtaataaatgttataattatcattcccaaagcataataaaccggagataaaggtccaaagaatattgttaaaaatacccaaagcatcacataccatgaaacagactctgaaaacattataaatcctcttaagaatccaaagtgttctgtttcaaatccggaaattaaatctttaccttttgtaattccaaatggagaatacggagacttggatataatcagcataaagaacatcagagcagctaaaggaatggaaaatgccaaaggaccatgaactccctgatatgctataatttttccaatattcatggaatctgtttttaaataaacaagaacaatagctgcaaataatggaagttcagtagctgcagataaaactgcccttacacagctcagtttaccataaggagaaccagaacttgatccggaattatgttccacaattttgtaaactgcataaacaccaaacaggataagtaatgaatcatgagctacaggacctacaataacaccaacaacccaaattatagccaaaataacaacaataccaacataaaatggcattgaaacagtttttggaaatgaagattctttaaaaaagaactttaaagaatgtaataaatgctgaataattggagggcccggtctaagctgaacacgagcaatgacttttctgtgcaaacctaaaagcaaactgcctgcaaggaatgcgattattacattaattaaaatatctgccatcaaattcataataccactaatatcctgtaaatggttcttttatcctttcttccttatcatcttttctcggtttggccattgttaataaacctaaacctaaaatccataatggaattccgaaaatagctattacatacacagcccagctggccatatcaaatattaaagcagccaatatagccaatgtagagattgccaataatataatacttataattttttgaatatccatactctcactaccataaaactaataataatatctccactgctctaataataacaaataatgaacttaaatgaataataaccaaaaatggagaacctggagttctaaacatttctgccttacttgcaaagaatggtgcaacaccacactctcccaaaattccaagcagcatcagtaaagcaccaaaaatcatcattggagttgcatgcatttgatttagcaccagcaaactcaatgttccagaagaagcaaggacaatagctgctccaccaaataacggcaaactacacatcatagctattaaaccataattaaaagcagagtttaaaacactaacctgccttacagctgaaacaataccaatattcacaataccaattaatgctatgaacaaagtaaagttaaacaaatctccagtaatcattgcccctgcagaagctataccacagattacagataaaaatcttctttgcttaaactcttttggacctactttcacatctgtatttccaagtttcatgaaagtagcttcgacttgtgtttctggtttacttacagctatcaataaggtaaaccctaacattacagcaaataaaaacaaattaagaggtgtgaagtacaatacaatatccccaaaaggaactgtacccaataaatttccaccaagtgtactaaaatccatatttacttactccttattcatatcttctctcataagcactccaattaaaccaacttttgaagctacttttaataacaatccacaagccgctaagaataaacttaataaccataacttaggcattataaagaataatgcaaatccaataatccataaacaccaagcaatacctgaaactccaccaagtccttctaaagtgaaaacaggcaaacctcttgcttttttagaaattgcatataataaaattcccccacccgctactgcaccaccagtaaatccggttaaaaagataccataagctattaaagccaaagcaatgaaattaggtgctgtagtcataatttccaaatccaaattaaatggaatcgggaataatgaagtgccttcaggcaagcttcttttaggattctgttcaatgatatgcatttcccttgaaagtaaaatctctgaaatagctaatgtttcagccagttcaactaccaaaccaggtaaaatcagagattcagccaaatcagttcctacagcagaaacaacaaaaatcattgcaagaccaattaaatctgtaagaataagtatatgaatttcttcttttttcatagcaatagctattgatcctataaatccgataatcaaacctgcataaattgccggcaaatacattgatataaatgcttgaggaacaaactcaggaaccaataccattaattatccctccttaattgcctggctctggatttagcatcatttattttaacttcattagctacttttactgaatcccctatagccttcttaacattatctcttatttcgttttcatcattttttctattcattgtataattcatagacagccatgaagctataataaaggacatcatcaatatggaagattccaatattgtatcaaaaccacgagtataatacaatatttcgtcaattaatccaccaggagaagaataaatagatgtaccgaaatatggtgaaatctgagaaacccataaagctactggtgacatatatgatgtaatcataccaatttcttcagcattttgaggaaactgagccataactatacctggagtttttaaaatttctcctcccctatcataaggtgctacagctaatccagcatccatctgttcttgaggttcaggtctgggataaatttgaccaggatttaaactcatcggaacaataaaacctattaaaaggattattcccaatgaaaaagcaaaaatcctcggaacattttttggattagccaatttattccataaagctcctatcctcatacgtctgcccccatttcttctaaacgaataattgctctaaacaaaacaaaagtaataacaacagttgttgcaagtaatgttaataaagctaaaacatgattataagttaacagcaccaaacaaactccaatagaagccacttctgtattgaatgttcttataatagggtcttttacacctggaccccatgcagtagctaaactacctacaatagctagaaaaataccaacataaaagaacagattaacatcaatcatgtaactcaccacttttaacttttctttgtctaatttctttaattttaacaatagccataataaaaattaaagtacataaaggatcagacaatgcaacaaacattgcaacatccaaatatctaaatagcaccacaacaagtaaaaaacctgcatccattatggaaaacataattactttgtctaatggttttttcaataatattactccaaatgctccgattaacattaaagctattgcaataattgatacaacaaattccatttcaacgcctcaatcaagaattatttcatcatcaagcttatccaaacttgttgcaatagcattagcactaattgtagaacatatgaaaaatgcagcagcaactacaaatgcaaatggtgttttaattaccaaagctattaatgcaggaactccaaagccaatgacatttaaataaagcaattttgaaactctattttcagttattaaagcccttaatgccacatatattaatattatcccaattattatttcaacatacatataatcactctttagcatgcctattgaactttttagctattttacccaggataatagatgctctgacttgatcaattccttgaattgttaaaatagctatacatatccctgctataaacatttcaggagtcaaacctacaaatgaacatacaaacaatataacagttatagttaaagaaccggtagttccggcataacctggatctgcacacaatctatttcccataaatacaaagaaagcggccagtatacctccaggaattcctaaaatcatatatccaatagacgctattaatgtaccggcagaagcatcaggagaacataaaatatttccttggaaaaatccaccagcaatatctccatttcgtttttcaattgaatctccaacagtctgaacccctttaactccaggctgttgtggaagtccaaaataagtatcaataataacgaagtttaaccaacagataacagatgctactataataccaattatctcattcattagccggcctcctcttcattatcttgtaaaggttttggaaatacttcataaaacaaatatttcacaaataatgcagttaatacaccaataactacagacaacactaatccattgtagataaatgtataacctaaaacaaagaaaagtgaaagaatacctatagctattactggagtaggatataacgcacttacatcaaaagaatacatatatggtttacttggtaataatggaactcgtaaaattaaagcaactacaattgatactgcaattgctacaatataacataatgcagcatcaaaactagaaatattaatatttgcaaggccataagcaccactataaacacatgaatgcaccatactaagattaaacatataatattcctctctataattattaattattacaaatgaaaatatataaatgttgttacttaaaaatagcttatacagcaataatagaatgtcaagtggtctaaatgaaaaataaaaatataataataaccggaggacttggttttataggttcacacattgcagatgaactaatcgaagacaataatgtcactataatagataatctttcttcaggaaaagtagaaaacttgaaaaacccagctcatgaaaatttgaccattataaaaaataacttaaatgatatgaatttagatgaaacatttgcagatacagattacatattccatcttgcagctatggccagtgttccattaagtgtaaatgaccccatcaaatgcaatgacaataatgtaaactcaactatcaaattactgacagctgcaaaaaaccagaacgtgaaaaaagtaatattttcatcatcttcagcagtttacggaaacaatgcaaacatgcctttaaaagaaagtgaattgatgatgcctacttcaccttatgcggcatccaaagcaaattgtgagttatatctgcaggcatttgaagaaagttacggtttgaaatcaatagctttaagatattttaatgtattcggccccaaacaagataaaaactctcagtatgctgcagtaattccaaattttattgatgcaatactcaataatgaacatcctataatctacggagacggtcagcaaacaagagatttcatatttgtaaaagatgttgcaaaagcaaatatagctgcagcagaatcaaattataccgggcctgtaaatatagctacaggtgaaaaattaacagtaaacagattatatgaaataattgcagattctatggaaagcgatttggaacctgtatatgttgataagagaaaaggagatattgaacattcaatagctgatattgacaaaatgagtgaaattaatttcaaagctgattcatccaactttgaaaaacagattaatgaaaccatacaatggtttaaagaaaattaaaaaatagaaatttagtggaatccgcaatgagagcaggtttcacataattcttcttctgaaggaacggtttttccagtttcctgcaataacacagacaatgcataataatcttcagatgcattttcttctcttaaaaccggagagatacctttaaaaatacatttaatatcaccagttccaccaatatctacagcagttggttcacccatctgaaatctgttgaaatattcaagaacttcatctcttaaagctgaaggtactctgaaattaaatgaaagtatattattttctttcattttaagtccaacatatttttgttttatttcataatttaatcctaatttctttttaaaaattacaatatcagatatgtctgaagatgccatttgaattcccccgaaatattttttttaactaaaaattacttataactttttttagtatataaactattctttcataaaaaattaatttttcaaaattcataacgaattatcacgatttttaataaggtttatataaattaaaaatcatacttacatcattataataattattgttatatatataataatacactaataattttaataaaattaacatataactgaggtgtttactttgaacgaatataataaaaatattggtaatagagtaaaagaattaagagaactctctgatattaccattcaagactttgcagaggaattagatattgatgaaacaatgtataaacaatatgaaaatggtgaagtagacataccagcaagtttcttatgcgaaattgcaaataaatttcaagttgatttaggtttacttttaactggtgaagaaaccagaatgaatattttcgatgttacccgtgcagataaaggtatttcagtagaaagaagaaaagagtacaaatacgaaaatttatgtaccaaattcattgacaaaaaagctgaaatttttattgtaactgtggatcctaaagaagacgcagttccttcattaaacagtcaccctggacaggaatttaactatgttcttgaaggctctttaaaattttatatccacaataatgaaattacattaaacgaaggagattcaatcttctttgattccagccatagacatgctatggttgcacttaacgatgaaaaagctaaatttttagctataataatgtaaaaccacagaggttaataatatgacatcattaattgaagattatgtaaatagagttgattttgactcatatgaagattttcacaaaaattttaaaataacatatcctgacaattttaatttcgggtttgatgtaatcgacaaatatgctgaaatagaccctgaaaaaatcgctttaatctggacaaacgatgaagatgaaaaacacactttcaccttttcagatgttaaaaagtatagtaataaaattgcaaacttttttactaaaaaaggcattaaaaaaggtgataaagtaatgcttaccttaaaaaacagatacgaattctggtttaccatggttgcattgcataaaatcggagcagtagctattcctgcaacccacatgttaaaacttcatgatattgatttcaggataaaaaatgccaatgtcaaacttatcgtaactgttgaagaagacagattaattccagattatgaagaagctcaaaaggaacttggcactgatttggtaaaatgtgtaattgaaagggatcttgacggctggattaattttaataaagctatcgaagaggaaagcgatgaatttgaaagaccgaccggagacgatgaagtgcttgcagatgacatttcattaatttatttcacatcaggtacaagcggacttcctaaaatggtagctcacaaacaaacttacggattaggacacattccaacagctaaatattggcataaagtagaagaagacggtatacaccacacagcagcagataccggatggggaaaagcagtctggggaaacttctacggacaatggattgcaggatctgcagttttcatatatgattacgacagattcaacggtattaaattacttgaaaaagttattgaaaataaagtaaacactttctgtgctcctccaacaatatacagattcttaattaaagaaaacatcaaaggatatgacttttcaaacatacatcatgtaacaacagctggagaaccattacctcctgaagtatcaaaaaggtttaaagaaatatccggactgagaattaaggaaggattcggtcaaaccgaaacagtattgactattgcaacttttgactggatagatgcaaaattaggttctatcggaaaaccaagcccgttatttgatgttaaattattaaatgaaaatgatgaagaagttgacataggtcaggaaggtgaaatctgtattgatgtatctcatggcataagtcctggtttatttaaagaatattacaaaaatcctgaaaaacaggctgcacaatggcatgacggctactaccattgcggagataccgcatggaaggacgaagacggatatatccatttcataggaagaaatgatgatattattaaaagttcaggataccgtattggaccttatgaagtagaaagtgcagtattatcccatgaatcagtaagtaactgtgcaattactgcatatcctgatgaaataagaggacaaatcgtaaaagctacaatcatattgcaaccaggatacgaaggttccgaagaacttaaaaaagaaattcaaaatcatgtaaaaagagttacagctccttataaatatccaagattaattgaatttgtggatgaaattccagaaacaataagtggaaaaataagaagagtagaaatcagaaataacgataacaaaaaggaatagatggtaaaatggctgatgtatcatatccaataatacacaaagaagaatgtaaaggctgcgggagatgtgttttaggatgctcccaaaatgttattaaaataggtagtgagcttaataaagcaggatatcgctatgcatattacagcggagaaggttgcagcggatgcagggattgtttccttacatgcccagaacccttagctctcgaagtttatgtatatactaaaaaggaggaagacaatgactaatcaaatggtaaaaggaaatactgcagttatcattggagcaatgtatgctggatgcgactgtttctttggatatccaattacacctgcaagtgaaattcttcacgaagcatccaaatacttcccaatggttaacagaaacttcgttcaagcagaaagtgaggaagcttcaatcaacatgatatatggaggagcttcaacaggacaccgagttatgactgcatcttccggacctggaataagtttaatgcaggaaggctttacttatctggctggtgcagaattgcctgcagtaattgttgacattatgagggcaggaccaggattaggtaatattggacctgaacagggagattataatcaggtagttaaaggtggaggtcacggtaattataaaaatatagttttagctccaaacagtgtacaggaaatgtgcgatttaactatgaaagcatttgaattagctcataaatacagaaatcctgttgttgtacttgctgacggtactcttggacaaatggctgaacctttagaattcccaaaagaagctgttgaccctacaatagatgaatcctgggcagtacgtggaaacaaagacacaatggaaaatttagtcacttccattttccttgattttgaccagttagaagacttcaactttgaaattcaggaaaaatatgctaaaatagctgaaaatgaagttgaatacgaagattacaaacttgacgatgctgaaattgttttagtatcttatggaattagtagtagagtagccagaagtgcagttgatgtttcccgtgaaaaaggattaaaagtaggacttttaagacctattacattatcaccattcccagaagaaaaaattaaagagcttggtgataagggagtaagtttcgtttctgtagaaatgagtaacggtcagttattggaagatatacagttagctgctttaagaaaagaaaatacttaccttgtcaacaggatgggtggaaacttaattgaacttaaacagattcttaaaaagatttacgaaatagctgaaattgatgaagaattaccaaaaggtacttccgaaaaaggaaaaacaggaaaatatattattgattagggatgtgaaaaaatggatgaaaaaagtttagcaccaaaaaacctagaagattatgaattatcaatacgtaaacgtcctgagtcaatttatccatcttttccaagaaaaggtgaaactaaccaaaccactacacattactgtgcaggatgtggacacggaattatccataaattaattgcagaatgtatggatgaacttggaatacaagaaagatgtgtcatgatttctcctgtaggatgttcagtatttgcttattactacttcaactgcggaaatgtacaaacagctcatggaagagcacctgcagtagctacaggtatttccagagcagaagataatgcaattgtaatgagttaccagggagacggagatttagcatccattggtttaaatgaaacattacaagcagcaaacagaggagaaaaaatagcagtattctttgtaaacaatacagtttatggaatgactggtggacaaatggcaccaacaactttagttggagaaaaaactgttacctgtcaaacaggaagagatcctgattatgcaggatatccaacccatatgtgtgaattaattgacagcttaaaggcgccagtatttattgaaagagtttcactagctactcctttaaaaatcagacttgcaaaatatgctatcaaacaggcattaaccattcaaaaagaaggaaaaggatattcatttgtagaaatcttatccccatgtcctaccaacttaaaacaagatgcaaaaggtgttcaagacttccttgaaaatcagatggaaaaagagtttccggtcaaaaacttcagaaatgaattgaaagacagaaaaccaattataagacctgaaaatgattacacaatcgattccctagataaaatattcaatgtagacagaagcggagactccgcttactgtgaaagtactggtatggaacctgtaaccataaaagtaaccggatttggaggacaaggtgttttaagtgcaggtcttacaatagctcaggctgcctgcagtgaaggcaaacatgtttcatggtatccaagttacggaccagaacaaaggggaggaagctcaaactgttccattgtaatttctgatgaaaccataggaactccagttgtagaagatattgacattctcattgctctaaacaaaccgtctttagagaaatttgccaaagatgttaaagaaaacggaactattatctatgattcccgtataggtgatgttgaagttgataaaaacatcaatataatcaaagttccttcaattgaaatagctgaaaaatttggaaacacaagaactgcaaatactgctttaattggtgttttaatggaattgaagaaaactttagcaccagaatcctatgaaaatgctattaaacatatgtttgcatccaaacctaaagtcattgatgtaaatattgatgttttaaaagctggagcgcaatgggtaaaagacaactcttaaattaaatgtggtttcatgacatataaagaaatagctaaaaaatacttggaaaataatggaattaccataggagataccattaaaatcaataaagaggatatctcctatgaaggtatcttattagatagatctgaagatagtgaagacggatatttagttttaaaactagacagcggatacaatgtcggtgtagctattgaaaatacacaagctgaactgattcaaaaaggtgacaaaccgaaaattggttatggggctgaagatatagctcacgacccttcaaaacaaaatatttcaataatatctacaggaggaactgtttcttcaattattgattatagaactggagcagttcaccctaaatttacagcagctgatttaattaaagcaaaccctgaattattagattatgccaattataatgttaaagcactgtacaatattttaagtgaaaatatgcaacctaaatattgggttgaagctgccgaatcaatagctaatgacatatctgatggttctgacggtattgtaatagctcacggtactgacacattacactacactgctgctgcattaagtttcatgttaaaaacaccggttccaattgtaataacaggagctcagagaagttcagacaggccatccagtgatgctaatatgaacctcattgattctgtagtagctgcaaaatcagatattgctgaagtcagcgtatgtatgcatggaagtttaaatgattcctacacttatcttcataaaggtactaaagtccgtaaaatgcacaccagccgcagagatacatttagaagcattaactatgaaccaatagctaaaattgaaaatcattctgttgacattaaccctaattacagatacactaaaagaaatgaaaatgaattggaagtcaacagtgctgttgaagaaaaagtagggcttatcaaaagttttcctggaatctgtgaagagcttattgaatatcatattgataaaggatataaaggtcttgttattgaaggaaccggtcttggacatgtcccagacaaattaataactcctttagctagagcacatgatgaaaatattcctgttgtcatgacttcccagtgtttatacggtagagtaaatatgaatgtttattccaccggaagagaaatattaaatgcaggagttatatctggaagagatatgactcctgaaaccgcttatgttaaattaagctgggttttaggtcaaactaatgatattggagaagttgcaaaactaatgaataaaaatatagctggagaatttaatgaaaagtcttcaatcaaatatttcttaaattaaggtcgtgtgaaaatggattgggaaaaattaggacttaaaatgggacttgaaattcatcagcaattaaatactaaacataaactcttttgtccttgtaaaaccgagttagttgatgaagattacaatgaaattgttgagagaaacttaaggccaacacaaagtgaacttggtgaaattgacagggctgctcttcaggagtctttacgtggtttaaacttcaaatatgaatcttatgaccaccacacttgtcttgttgaaagtgatgatgaacctcctcacagcttaaataaagaagctcttgaaatctgtattacaatagctgcattgatgaatatgcatattgtagatgaattccatacaatgagaaaacaggttattgatggaagtaacaccggaggattccaaagaacaggacttgctgcaactgacggttatcttgacactccttacggcagggtagctattgaaagtttaggtcttgaagaagatgcagccagaagaattgaaactactgaagattacactgaatttagattagacaggttaggtattcctcttgcagaaattacaacagatccgtctatgcaccatcctgatcaagtccgtgaagttgcatatatgatcggtcaggttttaagaagtactaatgtaaaaagaggtctcggaaccatcagacaggatttaaatatttcaattgaaaaaggagcccgtgttgaaattaaaggtgttcaaaaccttgatttaatgagcgaaattgtagaaaatgaagttcaaagacagcttgcattaattgaaataaaagaagaattgaacaaaagaaatgctgaagtgcttgaagaaattcatgatttagatagcttatttgaaaataccaagtccaaaatattatcttcagcagaatccataaaagcagttgtattaaaaggtttcaacggacttatcggaaaagaagttcagcctggaagaagatttggtactgaaatagcaagttatgctaaaaaacgtggagtttcaggaatattccacagtgacgaactacctgcatacggtattacacaggacgaagtaaattcagtgaaagactatttgaatgttggttctcaggatgcattcatcattgttgcacatgatgaaaatgtagctatttcagcactggaagaagttaaaagaagagctaatctcggatttgaaggagttgttgaagaaacacgtaaatcattagacgatggaaatactgaatatatgagacctcttcctacagctaacaggatgtatcttgaaacagatattccattatttaaaataactgatgaactggtcgaaccaattaaaaacaacttaccggaacttcctgatgttaaaaaagaaagaattattaaagaatacaatttaagtgaagatttagccagccagctagttaaaagattagaagctgatgtctttgaagagatattaactgatgttgaagtagatccaacaccagtagcttcccttcttgcttatgatttaagagaaattaaaagggaaggtcttgacattgatattttaactacccgacacttaaaagatattttccaacttttagcagattccaaaatagctaaagatagtgttaccaaattaacaacctgcgtaatacaatcacctgatgaggaaatcgaaataacagctaaaaacaataatctgactttgcttagccatgaagaagttactcaaatcatagaagacattgtcaataaaaatgaagctatggttaaagaacgccagatgggagctatgggtcctttaatgggaatgagtatgaaagaacttaaaggcaaagctgacggaagtattgttaacagaatagttaaagagtccattcagaaaatgttataaaagagttaataactcttttacttatttttatttaaaattcaataatactgttgattaacatccataaaataaaaattataattatctatttaaatagctaatttagctgtttaacgatgtttttacgatattacttattttcaaaacaggaaaaaactttttatttaaacccttttaaatattataaatggaggtgaaaatataaggaaactatcaattcttcttatattcttacttttagtaatcgttattcctgcagtttctgctgaataaaatgttacatccgataatattgataactcgataactattggtcccgaagattcaatacaaacagcagtaaatgatgcaaatagctcagccaccatttatctaacacccggaacttattaccaaaacggaataaaagttgataaaaacttaacatttcaaggaaagggaaatgctaaagacatcataatagatgggcagcataaagacagcattatattaatcaattctgtttcaacagtgaaatttattaatataacctttataaacggtgatggtcatgattacggtggtgcaatccacagtgaacacggtggtaaggtatatgcagatacatgtatctttaaagacaataaagcaaatgaaaatggcggagctatttcagtagcaggagaacaattttacaaacttagaaaaaaaatactaacaaaggataattacatccggacctcttgaagtaaccaattcaattattgctaacaattacggtgaaagtggagtcatatatgttgatgaagaaacacccaatataccttccaaggtaatattccacaataatcttataatggacaattatgcgaagaacaataaaatctttgtaattgaacactcaatagcaaaagattccaatattgatagaaatgattttggaactaccaatacaactataatagttgatgacaaaacaggcaccttccaaataccaactaaattcatcagtataaatccaataactcctaatccaaaaccaactaatccagtaactccaaacactcctgcaaatcctgaaactaatacaacaaaacctgttacaaattagcagcaacaatcatacagacaacattattaacaatatagtttcagccataagcaatgaagttaataaaattgtttccaatgaaaataaaattgtcagcaactctactgaaagtaatgtgaatgtaggaacagactcttcacaggaagcaaaaaccggtgactctgaaaaaagtgttcatgaacttcttgacaaagatgtttcaaaacaaacacaaattaatccaataccttttataatcgtgttaattattgtttttgctgttttaatctttagttattacagatataagaaaaacgaataattaatctcttttttctttttttaaacttatcaaaataaaataatactttcattaattttaaataatcccaaacaatataattaaattaactaaatattgaggttattaacatgaaaacttatgatataatcatagttggagcaggtcctggaggattaactgctggaatctatgcaggaagacaaggaacaaaaacattaattttggataaaggactggctggtggaattggtcgtgaagttccactaatggaaaattatcctggatttgacacaatttcaggttttgaattagttgaaaaaatgaaattgcagtgtatgaaatatattgaattgcatgaaaatgaaattgtaaaaaacatagaaaaaaacaatgataacttccttgttacaacacataaagatgaatactgcggaaaaacaataattttagctactggaagttcacataagcatctggaaattcccggagaagaagaatatttaggcaagggagttagctattgcgctacctgtgacggattattctttaaggacaaagatgccataatgattggtggtggaaatagtgcactgcaagaagctattttcctggacaatgtcggctgtaatgttaccattatccatagaagagatgaactaagagctcagcaatatctgcaaaaggaaattaaggaaagaaatattgatgttatttacgatacaacagttgaagaaataaaaggaaatgctcttgtaaattctgtaattctaaaaaatgttaaaactaatgaatacagtgaatttaaaacacagggagtttttgttggcataggatataaaccacataatgaattagccaaaaaattaaatgttgaattaagtgaatccggagaaataattacagataaacatcaaagaacaaatattgaaaatgtttattctgcaggagatatatgtggcgggttaaggcaatggattgtagcatgtggagaaggtgcaatagctgcaacttccgcatatgaagacatacacaatcacaaataaattaaaaacgctcagataaatacacatatatgaaaaatgctataaccaatactataaacaatggcaataaccacatgaatatttttaatagcactactgcaattaaaattgcaataataatataaattaaatctctaagttccatgacaatgtgatttatttaatattatatataaagtttaagcaaatagtggaaaaatggaaagaaaatggcaattaatcatattcttcatagcaatgatcatattatctgcagggggatatgggtatatcattagtgaatttacagcacctccagaaatggaaacctatgactttggagagtttaccatggaaatacctgaagacagcaatgttaaattagcatgttctgatttatcattaagtgtatatgttggagacaattttcaagttataaaaattaacaaaacattttatgaaaatcagaatgaattaaatcatatattggaacagacaagcattgaaaatttaaccaactcttcaagaattgtggaaacttccaacaacatcacatactaccaaataacagatgaaaataatatcataggatttgaaaatgaaacatacattgcaataaataataataacccaagcagcatcattataatcggcagctatgatttggatttgctaaaacagataacacctacaataaaaaacaaataatagggcaaaaatgcccttatctttttttacattattaaattaaaatacttttatgcagcgttatttttgtaattggcacagatttacttgtggctacatcaataattttttcaaataaaataaagactatgtgctgattttagagcatttacaatgactgtttcgtcagatacaaaatttgaacaacaaaattcaaattcaaaattttcaaaaacattgaaattaatttatgaaaacctatttttctttttttgagtctgtaaaattttataggcttatttgattttaatgtgtttttcagtccaattttgcatttgatagtctaaaaatgtcaggattccatttttggttttgtatattttctttattttttcaggattggtttgtctgtagtaattttcgactttatttgatgttttttctatattttcatcatcaagatattctacgtatctgtggaagtgatttatgatatgttttcttatgaaatcttttaaaacaactggtatggccgtatatttttgtaaatattgtttaaattgttctattgcttctttttttgagttttgtctgaaacagttttttaattcttgtgcattttcgtaaatatggtctctttgttttccattaatcttgtttcttctacaatatacttttaatttatggtttattgtttgaaacagatgaaatatgcacaattgatgttttacttctatttcatctgctacattacgatacattgggaataaatcggttgttaggcaaatgaatggtttattttctgttgattctaagataaattttttcgtgttttttggtattctgcgacgtactattcgttctgtgactggaatattgagtattgcatcaaataaagttaatctgtagtgtctagttccattaagtcttaaaaattgctcatcatataaataatagccagaatattcaaatttttcattgctgatgctttcttcgtgatttttgtcagaccagttcttgattgtttgatgagatattctgattccaaggaatatttcaaagtatttacttattttacgaagtgattggtaccctattttcattattcctggaattttatccattatttcttgtaaaaattgtttattttcaccaattaatggattattgtatattccgaatttttttccacattttttgcattgatattgctgttctttgaattctgttgtttttccattagtattttgtttgtttttctttattgtgccttttttgattattttgtggcttccacaaactggacaaatgggattatcatatttaaaagtattattttcatctaaaaatagtttatgattagtattttcaaaattaggtgttttattcaatctttttgaaataattttttcttgatcaattttttcatcaaaaaaatcataaagtttaagttgtatgaagtctatattactattgagggcagatttgttttgtttggtcataaaatattatttgtcctcacttattaaagtattttactatttttaaatcatttatattaaaattaaagaaaaattagaatgaaatttcatcaaaatgaaagttcaactgtaaaaaattaaaaaacaaataagcctataaaattttacagactcctttttttaaaaaattattcccaaaatttagtacaaacatataataaataaaaaaaactaaaataataacattagattagggagtaaaaaatgacaatattagttattaataataaaggccaatataatcatagaattcaacgtagcttacaatatcttaaaattccaactgaattagttccaaatacattaagtatcgaagaaattgaagctaaaaatccaattggattgattttaggtggcggaccttcaattgaaggtgctggaaatagtgaagaatatattaaacattttgatatacctattttaggaatctgtttaggacaccagctaatagccaaggcttacggtggacaaatagacacgtccaatactgaaagctatgctaaagttgaaatcaatattgttaatgatgaaaacttattttcaggattagctcctaaaatggaagtctggtcttcccacaaagatgaagtgaaaagtatccctgatgattttgaaattttggctaattcaaacttatgcgatgttgaatcctttaaacatactgaaaaagatgtttatggaatacaattccaccctgaagtacatcatactcctaaaggatcaactatattcgaaaatttctatgaaatttgtaaaaaaaggtgtaataatgattgataatccagaagacttaaaagaaaaagcacttgcaaataaaccaggtttaagaagacagtatgtcaatattcctgtaggagatgaagaatacgggttcagaatctccggaattggtgctaaagctataaaattagaaaaatatgtcaaatatgatgaaatatttgaagcacttgaagctggaaatgaaaacggtttggaagcaatggttaaacaaatcattgaagattatgaagaagaaaacgaagaagaagcagaataatcatttgtggttgagacaatgttaggtccagaagaatttattaaagatgctatccaaaagataaaagagcaaataggtgatgaaaaagctattattgctttatccggaggagtcgacagttcagtatgttctgttcttgtccaagaagctattggagataatttaatagcaatatttgtagatcatggtcttttaagagaaggggaagtggaagaagtaactaatacttttaaagatagattaaactttaattatgttgatgcttctgaagaattcttaaacgctcttgaaggagtagaagatcctgaagaaaaaagaaaaatcatcggaaaagtatttattgatgtttttgaaagagaagctgaaaaaacagatgcaaaatacttagtacaaggtaccatagctcctgattggattgaaagtaaaggtaaaatcaaatcccaccacaatttagcactccctagcggtatggttcttgagttagttgaaccaatccgtgatttgtacaaagatgaagtaagggaaattggtttattattagacttacctgaaaaagtagttcacagacaaccgttcccaggcccgggtcttgctgttagagttattggctcacttacaccagaaaaacttgatatttgcagaaaagcaaataaaatagtaactgacgaaatagaaaaagcaggtattgacaaagatgtatggcaatatttcgcagtattaactgacagtaaagttaccggagttaaaggagaccaaagagacttcggttatttggttgttttaagaatcgttgattccgttgatgctatgactgcatatgttcctgaattaccatggaaggttattcaaacaatgtcacaaagaataacttctgaaatttctgaagtaacacatgttgcattatccataagtgataaaccacctagcacaatcgaattcgcttaaaaacaaataatcagtacttaaatgaaaaaaatttaggtactttcaaatcttttttttaattaaatacttattttcactagatttaaaatggcaaatatgaaaacaaccaaaaatgcataccttgaaaaattaaccaaacaaatacagatgaaatctgttaaagttggaaaaaatttagagggaagcacaccaccgtctgtttttattggaagatggtcatatcccaaagtctatgcagggcctatgatggcaaatcaattaggagatactgcaattatggattctccggaatcctggattggagagcataaaaatcaggaagatataattaaatacagaatgggtctcgtaagaggaaaacaactaattaaaattgatgatttagataatccttttgttgaaaaactacaggacatctccctggcttccaaagcaattgacagtgaagccacttttggcaaacgtcccacaggagcactgctgactgaagacagtatgcctcatggtccaagtgcagttattgaaaaatttgatatagatgcagtccgctgggacaaacaattggaaaaaacctattatgacactgatttgaaagccagtgaagctgttctaaacttgcacaataaagatgttccatttacagctatgcaaaaagcattttcagtaggtgcctttggaacaaaaaacaaaagaaaactggttccgacaagatggtcaattacagcatgtgataccacattggcagaccaattcttaaaagaagtcagaaaatttgaaaagattgatacatacagggtttatgaattcggaagcctgaacaattattatgtaatcatattgactccgacagaatggcagtatgaatggtatgaagcatttattaaaataataggtaaagaagaaattattttctcagactatgaaacaaatggtggaaaaaaggaatactcaagagttggcggatgttattacacagctaaaatggcagttcttgacagtttatttaaagagaaaaaacaggcaggattacttgttttaagagaagcttacgaaggttatgtgccattaggagtatttaatgttagagaaaatatgaaagaagctatgaaaaaatcatataaagaatttgaaaccttaaaagatgctatgttatactgcggaagcaaactaaaaataccggttaaaaaatatgtaaagcagggaaccctgttaaatgaaatgcttcacacaaaacagactacactggatcaatacttcaaatagtgataatatggaatttaaatttaaagaacctcataaagaaactagggaatctatggctaaagtagccagtggcgaaaatccttatttaaatgacaagaacaacagttttgaaaaaaactgccaaaaaaaagtaaaagaaattacaggacatgaatactgcgaaataaccagcagcggaaacaacagtatttttatagcactgtcagctattgaaggttcagtcattataccagaccagggaggatggaatggttttaagcaaattgccaactatttaaataaggaaataataaccctcaaaacagatttaggattgataaacactgattatttaaatgaaatggatattcctaaaaactccgccctaatatttacaagttttgcaggatatagtgcaaaccaggatacaaaaagcatttcaaaatactgtaaaaacaatggaatcacaacaattgaagatgcttctgcaggaattggagatgaaaaacaggagttgggaaatggaaatttatcagacatcataattgcttcaacaggatctccaaaaatcataaatgttggaagcggcggctttatcagctcaaataaacctgaaatttttgaaaataccaaactgcctcaaaaattaagtaaaactaatgaaataatatgcagtggtatagataaagaacttgattttgtaaaaagtaatttggaacaaacaataaatgcaacaaacatattaaaaaaacatataaataatacatttcatgcaagtaaaagaggcgttaatgtaattatccaacatgacaaaccgaaggatataatctggaaagtgaaaaaggaattgccgataaatcatcatgctttcattacaaaatgtccgaactataatcgtctgaaagaaaaaggacttgtaattgaagttaaaaatttggattacagcagtttaaaaaaagaaaatcttgataaaataattgaagttgttaataatcaactatgagtttagttatcttatcaattattatatcatcaatatgcatgtttgccagctcatttttatcaatatcataaatcttcattaattttaattcatcagctattaaaacattattatctctatcaaacattaaagataattcatcaacactttcatcagaacagtttattaagatagcgcacaaattcatttttccttccttaaggccaagaatttcaaaagctttggaaatctgtctttgagcggaacatcttaaacaaatctcaacacttaaatcattggcaaggttttcatgtcttctgaaagctaaaaaaagcctgattaacaccatgttccacatgccttaaacttgctattgcatcagcattcaaaagctggataatttcatcatcactatttttaagactgttaattttatccagtgttttgctgacagaatcaatatttcctctaaatcctaaaactttaatttccataaaaacaccctaattagaaagtaagcggttaacaccagaaatatatgcctttacactggcattaataatatccggctcagttcctcttgcagatatgattttatcccctttctgaagtttaataattacatcaataagtgcatcagtacctccggtaattgcatctacatggtattcaataaaatcaatatcatcaaagatatccaaagagttaacagcattgattgcagcatccacaggaccaatacctacaccagcatttaaaacttcctcaccgtcaactgtcagttttacagatgctgtaggcataaccttattacctgatacaatagtaacctcatttaacttaatcctgtctttatgattaatttctaaaacattatcagctattgcctgcaaatcaacatcagtaactgttttacctttatcagcaagaactttaatattgtcgcaaatctttttaagctgatttttactgacattaactcccagctcttttagtctaacatccaaaccatgagtacccatatgcttaccaatgacgaacctgcgtttacggccaacaagttcaggagttatagattcataagtagcggcatttttaataattccatcagaatgaattcctgattcatgagcaaaagcattctcacctacaattgctttgttaggctgaatataaacaccagtcaatcttgccactaattttgaaatggtgtaaatctcatgaattttaatatctgttgaaaactgagggaataatttgtatatgccaacaacacattcttcaaaagaagtattgcctgctctctcaccgataccatttatggtagaatggaattcagatgctccccctttcaaagcggcaaatgtattggcaacagccaaaccaaaatcattatgacaatgacagctaattggaacatcaatatcttcttttaattgcttaaacatttcaaaagaagattcaggtgttaaaataccaacagtatcacataagcaaaccctatcagcaccatgttcaatagcattaacataaactgtctttaaaaaatcaatgcttgttcgggatgcatcttcagcagacagctcaacagttaacccatgatccttacaataatcaactgcagagttggacattgccagcaactcctctttagtaatttttaatttatcaaaaatatgcaaatcagaagtaggaacaactaaattaactgcatcaacatcacattctaaacaataatcaatatccatttcaagaggtctggaaaaactaagaatctctgcattaaaattctgttgagttatatctttaatagactgtctttccccttctgaagtaattgctgaacctgcctcaataaaattaacaccaatttcatcaagtttagtagcaattcttaatttctccaatgaagttaaagatacaccaggagtctgttctccatctcttaaagtagtgtccaatattttaatattcataaaatcaccgcagacaaaataatcatgaaataaaaaaaaaaacagataaaataaaaatattaaaaaataagtaagtaatgtaatagaaaaaggcttgcagcgaaatgaaattcccatagaaaaccatagtacacaaacaaaacacaaaaggacttcactactgggatcgaaacgagaccaggtataacccccatgctatgaccgcaaaacctatattctaatacgtcataagaatgaaaaataaaaataaacaaaaccgtacaactttcacccgtactattaacacctaaccaaattattcccaagtttagtactataaaatcaagtatagtaaaacttaacaataatctataaaatcatgcaagcgaacaattggaagtagcggactaaacaactcggaaaaaaaacctcgaagcttacatccctaccccatcaaacaagtcttctactcgcgtcctaagcaatctattttcaggggatacctcaggcttagatgctttcagcctttatcacctagcgcgtagctgcccggcactgccttatcagacaaccggtcgaccagaggcgccgacaactcgttcctctcgtactggagccaccttcccctcagactactaacacatccattagatagcaaccaacctgtctcacgacggtctaaacccagctcacgttcccctttaatgggcgaacaaccccacccttgggtgctgctgcacacccaggatggaaagaaccgacatcgaagtagcaagccgcagggtcgatatgggctcttgcctgcgaccacccagttatccccgaggtagtttttctgtcatctcaggcccccatcaaggaggactctgaggttcgctaggcccggctttcgcctctggatttcttgctgatcgaaatacagtcaggccaacttttgcccttacactctacggtggatctctgtcccacctgagttgacctttgggcgggcttgataccatttcaagcccgtgccgccccagccgaactgcccatctaccgatgtcctcacacaaagtaagttagaaacacagtcataagaaagtggtgtctcaagaacgaatcatataaacctggcgacttataatcgaattctcccacttacactgcatacctataaccaagcttcaacgacagactgcagtaaaactctacggggtcttcgcttcccaatggaagactctggcttgtgcaccagaatagcaggttcactaagttctagctagggacagtggggacctcgttctaccattcatgcaggtcggtacttgtccgacaaggcatttcgctaccttaagagggttatagttacccccgccgtttactggcgcttcactgaactgaactccagcttcacgtgccagcactgggcaggtgtcgccctctgtacacacccttacgggctagcagagagctatgtttttattaaacagtcgggcccccctagtcactgagaccagctattcacatagctggcaccccttcttccaaagttacggggccattttgccgatttcccttagctagtttaccttaaaacgccttagcctactcagctaggggcacctgtgacggatctcggtacgaaatagtaaaatacaaaactaactcccttttcaaggactccatgaatcagttaaaccagtacaaaaacgaccagctcataatgcctacacctggttctcgctattacacctctccccaggcttaaacacgtaaataggacgacaatcctacaaaacatatctcgaagtgtcagaaattagccctcaacgtcaccgcaaatttactatgtacaggaatattaacctgcttccctttcgaccagctcaacttatgactgaccttaggatcgactaacccttggctgacgaacattgccaaggaaccctagcccctccggcggtaaggattctcacctcactttgctgctactactaccaggatccacatacctgcaaggtccaaaggaactcacgccccctcttcaacccacacaggtcgccactctacacaatcaccaaaaaaaaggtgttccatggtatcggcaactggattaattcccgtccattttaggtgcctctgacctcgatgggtgatctgttacgaactcgttaaagggtggctgcttctaagcccaccttcccattgtcttgggccaaagactcccttacacttatccagtatttaggggccttaaccatagtctgagttgtttctctttcgggacacaagcttaccccgcgcccctcactccaaccttctacgacggtgacgagttcggagttttacagtacgccgagaagtttccctccctaaacgtccaattagtgctctaccccgccaccaacctccagtcaggctgaccttagagtcatttcgagtggaaccagctgtcgccggccttgattggcctttcaccactattcccaagtcaaaagagtgttttgcagaacaacaaccctgcgaacctccatcgctcgtaagagcgacttcatcctgctcaggaatagatcgaccggcttcgggtttcaatgctgtgattccaggccctattaagaccttgcccctcaacaacgctgcgggcatatcggtttccctacgactacaaggataaaaaccttttagcctcaccacaacaaagaactccctggcccgtgtttcaagacggacgatgcaacactagtccaacctcctcatactacaatgttaccactgattctttcggaagaattcattccttacgcgccacatctggctgtcactatctggtttcaggtacttttcacccccctataggggtacttttcagcattccctcacggtactaatactctatcggtcttgagacgtatttagaattggaagttgatgcctcccacattcaaacccgatatccaacggatcctactcaagaaaaaatcatacacaaaacctcaaaaagagaatatatctacgggactatcaccctctacggttctaaaattccaaataaaattcgatttatcccacgaggcctaaaagtatgtctatacaccacatctccctaatattactaaaagggattcagtttgttctaagtcgatttcgctcgccgttactaacgacatcgcatattgctttcttttcctccgcctactaagatgtttcaattcggcgggttcccaatcctacacggatcaacacaaaaaaaatgtgctaggaagtcccattaggcaatcttgggttccaaagatgtatgctcctcgcccaagcttatcgcagcttaccacgaccttcataggcaactcaagccaagccatcccccagatagcataagtagcaaaattttacaaatgaaagatttataaacaaattaagcaaactattactaaaaaaaaatatctaatacacaagaaaaaaagtcttaaaaaattttaaacaaaccatcaagaagaaaaaaccaaactaaaatagtcttttcaacaaaataatattgtttaaaaaaatcttttttcgaaaagatcttttttgaagattattataacacataaactaacaaataatctggttagttagtgctagtagggttacttatgcacggaaaatcatttaaatattttcccttcacacctgtttcacgacaaaacggtgctgcactaataaaatggacccaccgggatttgaacccggggcctctgccttgcaagggcagcgctctcccagtctgagctacgggcccataaaaaggttttgtaggtgtgtttgtgtaatcatctaataacacacataaaaatgtaatcatataataattataaagtgtaaggaggtgatccagccgcaggttcccctacggctaccttgttacgacttcgccctccttaaaaaaactagattcgaatataacaaaacattacatcctcatccaatccctttttgggtggcgtgacgggcggtgtgtgcaaggagcagggacgtattcaccgcgcgattgtgacacgcgattactacgcattccagcttcatgagaacgagttacagtcctcaatccgaactacgactaagtttagaggattacctccgcctttcggcgtcggaacccattgtctcagccattgtagcccgcgtgttgcccagaggattcggggcatacggacctaccgtcgtccactccttcctcctatttatcataggcggtccccttagtgtgcccggcatccaaaaaaggatccgctggtaactaagagcgtgggtctcgctcgttgcctgacttaacaggacgcctcacggtacgagctgacggcggccatgcacctcctctcagctagtcaagcaaagtcatcaacctggctatcatacagctgtcgcctctggtgagatgtccggcgttgaatccaattaaaccgcaggctccacgcgttgtggtgctcccccgccaattcctttaagtttcagtcttgcgaccgtacttcccaggcggcggacttaacagcttcccttcggcactgggacagctcaaagccaccccaacaccaagtccgcatcgtttacagctaggactacccgggtatctaatccggttcgcgcccctagctttcgtccctcaccgtcagaatcgttccagtcagacgccttcgcaacaggcggtcctcccaggattacagaatttcacctctaccctgggagtacctctaacctctcccgatctcaagtctaatagtatctccagcaattcccacagttaagctgcaggatttcaccagagacttattaaaccggctacggacgctttaggcccaataaaaactgctaccactagagctgccggtgttaccgcggcggctggcaccggtcttgcccagctcttattccaaaagctctttacactaatgaaaagccatcccgttaagaatggcacttgggatccccccgtcgcgatttctcacattgcggaggtttcgcgcctgctgcaccccgtagggcctggaaccttgtctcaggttccatctccgggctcttgctctcacaacccgtaccgatcaaaggcttggtaagccattacctaaccaactacctaatcggccgcagacccatccttaggcgaaaaaacatttaaacaaaaaaccattacaggaataattgcctatccagtattatccccagtttcccagggttatcccagtcctaagggtaggttatccacgtgttactgagccgtacgccacgagcctaaactcgttcgacttgcatggcttaatcgaatcccaatagcagtagcatctgccaggatcaaacagaattgaatgaaaaaagcagataatcataaaaaagctaaaatttatgaagtacgctaaaaaaatatagacgagtaaatacactgatttgataacaataatgtaatcaaattcaccacatctacaaaaccaacatcacactcaaaaaactcaagtgctcattaaatatgtttagctatatgtggaaaagcagtcatcatagtcataattgtcaatacaatgtaacttagaccaacaccatataacacatagcacatctaatagacaaggaaattatatcaacaaattcaattaaaaattattgcaaaaataaatcaaataaaaaaatattaatgtaacatctttaatttatcaaaaaacaatagttaaactaatgattcataaaaataaaaaatttaatcaaatagacataatgaaaattttaaaagtcacaatgaaaagcaaaagtaaaaaatctcttttaaaataaataaattggaaaaaaagcaaatataatatataaataagtaaaatcgattactatgtaatatataaacttacctatttatttataaataaataaaaaaaattaaacatttttcttacgaataactgaaattatccttgttaaacttctatgcattttgattccatattgttcaactaattcaaatccaacttcctcaatcataggatttaaatcaacataatgaggactagccatacacaaataggcatcatctttcatattatcataaattgaatggaaaaactcattgaaaatctcatcaccctcaatatctccagttgaagtagatattccataaggagggtctgtaactacactatctaccttttcatacattttaagttcacgtacatcaacattgaatgttctataatcagttattccacagtaatccaaattgattgcacttccatttttcattttccagttaacatcagatcctgcaactttacatccaattaatcctgcttcaataagtattcccccagttccacagaaaggatccaataccaaatctccggaattaaccctagacagattaaccatacaccttgccaattttggactcattgaacctggatagaaaaacggtcttttatgaggttttatttcttcaaaatgttttttattgagtttaaatttttcaatagctatataaacagtattttcataagcaattaatctgattaatgaatcaggttttttcagttttacttttatattgtcacattttgataaaattaatgatcctgtctttcgctcagcagccacagtatcaattggagagttgaatctttttactcttacagcaaagtttttagaaatatatctgctccagtcaatagctaaaatatccctttccaaatcatctatagaggatttaaatattacctcatccacttcatgggtgtatcctaatctttttacaagtgtctgataatatttgtctgagttttcatcagaaatatcctttaataaaatcaaaccttcagttattttagaaatatccaattccatatcctcacattcaataactgcttttagttctgcaagaggtaatttgtcatgttcctgagattgtatacatagtaattccattaacttcacctgattttttaaaaaaaaattattttttaaatttgtcgaaatgtcttctgatgatagtttctttagagtcttttgtttgggtacctatatcattttcttcaaattttgaatcctgaatgtcctgatcattataataaagttcagcttcattttccccatagtaatcatcatcactataagaataatcatcagtactttcattataatagtcattatcatgaagtccattacccctattgttaacagcaccttcaatattgtcttccaaagaatctttcatgtaaggttcatattcataattatgccttttttcctcttcaaagttcaattcttcaggataatattcataatccctaacaggttcttttctgtaataatcctgaggctcataatattcatcttcaccataataaccgccatcctcatactgtcttctttttgagcggtagtcattagatggttcatagtattcatcatcagaataatattcaggctgctgtctgtttatagaaaaatcatctctataatgtctgcttcttagattattctgattggatattcttgaaaatattatattttcaacttccttaacatttgaaatattggctaatttcatctgattgttgtcataagcactataaaccgaaactgttccgacattcaatatttttgctacaatactttgagatgtgcttacatcctgaattgttccgtaaggcatgtagtttttttttagtgtataaaactcctgatttaataataattcttgagtcagttaaaatatactccatataataccagttaataagttgccagattatatacagaataataaaaagtataattacaaaaagtgcaatagcagtataccttgttaaagacaatttaacataagatattaaatatacttgcatttcaccaataaatgcaataatcggtgatgcaacagataaaacaactactaataaaataactccaaaaatagcttttttacatcctaaaaagcatattcggtttggtttgataaatagttttttcattagttattttatcatttctattaaacaacataataatgtattagaatttaattttaaataaagttttttaaaaaataagatttaaaaagtaagcctcagctcgcccatcattcatcacgtatcagagctcatagggttcatcattggcttacagattatttaagcaaacattacgcctgcttcttttataaattcatcatcatgttccttgtcaagaactttttctacagcatccatgaaatcagttactgtgactctgtctcttttttcacgaatagcaaacatacctgcttcagtacatactgccttcaaatcagcaccggaaagaccgtcagttaagctgcttagcaaatccaagtcagcttcctcatccaaagccatgtttttagtatgtatttttaggatttgttttcttccgtcatcattaggaaggggaacttctataaatctgtcaaaacggccaggccttaataatgcagggtctaaaatatccggacggtttgttgcaccgataattccgatatctcccctggattcaaaaccgtcaagttcagcaagaagttgcattaaagttctttgaacctctctgtctccgctagttgaacttttaagccttttggctgcaacagcatcaagttcatcaatgaaaataatagccggtgctttttctttagctaattcaaatacttcacgaacaagtctggctccttcacctatatattttttaacgaattcggaagctacaattttaataaatgtagcatttgtttcattagctaccgcttttgcaagtaaagttttaccggttcccggaggtccgtacaataaaattcctttaggcggatcaatacctattttttcaaataattccggctcttttaaaggaagttcaacagtttctttaacttcaactatttgctcttcaagtccaccgattttatcatatgtaatgtcaggttttgtttcaatttccattcctgtaacatttgcatctttttctgacggtaaaacttctacaataccaaaagtctgttggttcaatgcaactctagaacctggcaccaataatttttcatctaagaattttgaataatttactaaaaagctaggtccagtactgcttttaacagtcattctgtaatcatctaaaacttcagtaatagtagctaaaactaaaggaggtgatctaaatctttctacttcggaacgtaaggatttagtttctctttctaatctgattttttcattttcaattagaactttatctttttccaatttcctaactttccacattaaattacttttagctttggagttttcttcttttaatgaatctatttcttcttgcattgattcaactttctcaactaactgttcttttgaagaattctccaaatcattaatattatccataggactcatctccaataatattgattgaaaatttttataatttcgacatctatgttactttaataaccattagtaacattaacatatttaaattttattgttatgctatttactaaatgataatatttaaaatttatgggaaattaattatatacattaactaataaatacttaattaaattgaattaggaaaaactgattaatatggaatgcgaaatttgtggtagacaagtatctgacaatcctaaaaaagcaaaaattgaaggatctgtcatgattgtttgtgatgaatgtgctaaacttggaaaaatacaaaaagcacctccaaaaccaaaatttagaaaatcaaacaaacctaagaaaaataaaacaacaaaacaaaattattctaaagatgaacctaaagaagaattggttgaagattttaatgttaaaattagaaaagccagagaatctaaaaacctatcaagagaagaattaggtcaaaaaatctatgaaaaagtttctgttataaatagaattgaatcaggcaagatgattcctgatataagattaactaaaaaattagaaaatgctttaaacattactttaattgaaaatgtagaagaactggatttaagcaaatacacaggtaacccttcacagggacgtactcttggtaatgttgtaaaaattaaaaaaaggtagctatttatttgaatagctatttattttcttattttcaatatgttttacttttccttttagtttataatctatttttccgccatttttagctttatgagaataatatcctttaaaatcaggagcattatttaacttattttttaattgattgaacacatcatattcatcactaacaactacaacatgagcaggcggatgaatttttttaatttgcataatacttaaagttatatcttctttaacaaaaaaggcagtagcaactttagaacttgttctgagtttagaatttagaatcttttcaactaatgaatcagcaaattttgcatcaattatttttggtttagttgctaaatttaaatttccatgtctttccatgtccgcaattgcatttagtagttttgaattgttttctcctcttattaagattaatgccatagtatcactgttttaaaaaaaataattaatggtgaaaaatttcaccgattttggaacgatttcaataatctacttctaaatactacaagcaatattaaaattaccccaattgcagtttgtatactgcctaaaatatttagtaaatttgcatcaacaggtaaatcccaagatggagatgatttgtctccatttaatgctgtataatatactccaactgctttagagtcttttttaacattaatatctttcggttctacatgatcaactccaactaaaagaccattgttaatacctttgttaattgaagttgcaatagctgatgcatcatatccatatttagcaacggatgcatctacaatttgtttagtcgttgatgcaagtcctggtttttcacttccataaactgaaacactaaccgaatcggaagttaccgtaatcgcatttcccaacgcttcatatgcataaattgttgttaactcaccattacaaactggacagacttcataattttcagatgatggataacctaccgaccatccgcaatcatcacatgattttgaataaacttcattcatcggataaccagattcatttaaatccttaggcgtgaacatgtctccagtagataaaccggatacaagatttactgcacctccaccgtatttttcaccagaatcattagctacttcacccatagcttcagaaacaatagtagttgctggatatccatccctaatcatttttccaatgttaattgcagtttctttacgaacagtagctgcagtaccatataatgggtttccttcagaattccttaagtgaataatagctcctttttgtccaggctgtaaagtagctattccaccagaagttgaggaataaggagttacagtgatagaaccattaccgtctacagtaacaacatatgcatcaaaagaacctccaattgaaatacccatttcaggacctcctacaaccagacgggctcctttatatttagatgcaattgatgctgcagaagctgcagatgcattgttttcaagagatgcaactgcgtctacaatggaatccaatcttgagtctgaaccaccagtacccccagaaagaaccgcaaaatgatgttccttagacattaaaaatgttgactggaacatattatctgcaaaagacatacttcctgcagcagctccattcgggtctttaccagtaggatcagtaataaccattacgttacaagtagcagctacactatttatacacatcataaatattataaataaaattattggtatattccactttttcaaactatccctctattaaccctgatttgtcgtattctttaattcaactgacgagaaatcttcaataacggttactgtaacaatacctgtgtttttatccacctgaacatctgcagcagaaataggtgcaactgaggttcccggaactgttgaccgttttgcaaactcttgagccgtttgtatcgcatcctgcagtgaaacttcttttttagaagtttttaaaatatctccatgaattacactaccgtctcttaaaccagattgcataacattagatctaataatatctacaggtacaacatcattacctttaactatgattccagaaatagggacaccatcagtaacttcatcagaggatgcataagcaacatatgttattaaacgaccgcaaagaatcaagatgaatgctaataataaaattattaatgtatctcttcttatctttataaacatgtttttatcctctaaatttttccatcaataagcaatagaaaaataaattacatttattatattaaaattttgtaatatttaaattatttccttaaaatattttccaaaagaccttcagcagggtccattccctgtgcaccaattaataaaataatatcatttgcatcagcacacttgtatgtgtcttttaaacagtcacataaattatcaaaataattataatcaatattgttctgatttaaaacttcaaagaaaatttcacgctcttcatcttcaacaaaattcaaatggtcaacaacatcattacttgaagacagaactaattttatattatcatccatagattcagccaatgcttcaacattcaatttgttgatttctacacctcttgaacccctgattgaacatacaacatataatgtttggttttcagcaagtaatttacgggtctcagcaattgtagcttttataccgtcaggattatgtgcaaaatcatctacaatcaatggattttcatgaagttttgaaaaccttctgtttaatgggcggtaagattttacaccttcaacaatatcttctatatccatatttaaagatatgcatgctgcaactgctgataaaatattttgaataaagtgatgggaagtaaaaggcaaatctttgttttccaaaatccgtttaccttcataaaaaattccattatcataataaacattaggattttttgagtccatattattcatagaacataaaaaaggatgttttggggttaatttcatcaccaaatcatcatcataattcaatactgttaccccatctccaatagcattgggaacctgatttatttcatcaaaaacttcatcaatggaatttacaagacctatatgatccatagctatattagttataactccaacacttggtttaactgcactggccatcagatatgcatgatgtttcattaagtttccaagccagccctgaacttctgaaacctcaataaccagatagtccagttttccattatttttaacttcatcagaaattagtttagaaaccatagggtcaattaatgtgttgaattctgattcgctgtcagtatttgtaagaacatgtactccagtgttttttaaaatatgataaattaaatgagatgttgttgattttccattggttccagttataataacattttttgaatctggagaaaacttttcaacagtccatttaagagcataagcagtagccaattctatcttatctacaacaatcaacggaaaattcaattcttttgccttatcacatgccccatcctgaggagtttgagtaattaaacaggctaaatttttacctgctgcaatttctacccctttaccattaattttatgtcttattacaatgtcaccttctacagcatcatttaaaaatgtaaatttccctgtaaatccctcatcatcaaaaaaactatcttttccaacaatattaccttcaataaaactagctaaatcctgtataatcatataaaatcaccaaaaaaagaaaaagaaaaattagaatatgtataattgagcgagaattccaattacacataaccatacagtaacaccccaatagctaagtacaatcttacgttcagacataccataatgatttaatgtatgatgtaatggttcaacaggcaatttaataatatttgctctgtgtaacaaactaacaacaacagatgctattggaacacctaatgcaagaactccaaaatagggaatatcagatataagaactgcagcagcataacctgtacctaatacaaatgatccagtatcccccataaatattgatgcaggatacttattgaatactaaaaatcctaaacataatcctgttaaaattatgaatacaggcataccccccatatttccgcataaatataagtaacagcagcatgcaaaggaagcaatacctacaattcctgcagccaaaccatccatcccatcaattaagttcacacaattaatacaacctaaaatagcaattataactactggaaatgctaaaattcctaaattaaatccgccgatagtagttataacaccagttaaacctaataatacacctaaaagaatttgaaaaacgattttttcaagttctccaggttcagttttgattggaacttctccaataatttccactttaccttcttctaccaacttatcaatttcttttttagcttttggagtagctaccctaacttcttcattaggctcaacatcaagtctgcccaaagtaattacttcatcacaacagtttacaacaactttctgaatttctttaactttaagaccaattaaatcatccaataaacctacaattccccctgcaagcataatataagacatgattaaaattggagtattattataataaatagcaataatcaacaaaattacaaataaaaatgcaataccacccattgttggagtgccgcttttatgtctgtgttcactgacaatcggattatctgctattcttgcattaagtaagattcttctaatgcaatatgtacaaattattgcaccaaataatgttattaaaaaaagaattaacatatccccattattcattttaccacacataaattatgtatcatattaattttatttctaatgttatataaaattaatttaatagtgtttaagttattattaaatcaaatcttcaacatatctgtctaattgctcttttgaatctgccctgattgtaattctttgatatccttcaggtccgtgaaccacccaatcattgtttttaaaggattttaaaggttcgtttaaatccggacctttgtaacgcccaataggaatttctgtagcataataatattccaatttatcctgaatatccttaatggaaaatttgcctgcagccatatttaccaattcacataaagaattaacaccacaggtggctgttgttaaatatctggttccattaggccttgtgttaacttcaatagcatacagttgctgttcatcttttgaaaacatgaaatccatttcaaaaataccgtcagaacctaaattcttagctactttatatgcagtcctctgaacaagattattatccaatccttcaactaaacagggagctgttttaatcttatttaaaggatgaattccctccaaagttgtttctcctttataaattggagataaaggcacatattcaccattataccccaatacttcaatagaaatttcagaaccttcaataaatttttcacataaagcatggtcaaattcttcaaaatactctttaacatcatctaaagattcagctactttaatatcttttccgccctgtccctgaccttgctttaaaacaaccggaaactccattttcaatttgctttcaaaatcatccttagccaatatctgatattgtggagtaggtactcctatttcattgtagaactctttggttttaattttatcagaagttaatctaactgcacgaacattagctgcaattacaggaatatcagtttcagcttcaagttcctctttcattttagctacttctattaatggaggatcaataccaatcaaaggtacaacagcatctacattctgactgatagctatctgttttggactgtccatacctctaggcacgataaaaacctgatcaggcaaatccagatttatggcatcttcattagattcagtaattatgctttcaataccgttttccctaacataataatctatatcatcatacaatcttgaaccgataaataaaattttcataaaatctccttcaaaatatttataaacttgtaggctcccttttgaactgctggtgttggcttatctgaataatccatggattcaggttcaataccaacaaatattatcttaaaatcattatctcgctctaaatatttaacaaaatatgataaagacattgaatgagttgaaattccaatattaacaaaatcatccttgtctacaattttaaattcaccaggtttacatcccattaaacatgcatcaacaagaattacatgtgaaggctgttcttttctaattttacctgtgaaattctcaggaactgtcttgccatcaatgattattaaattaggattttctaaatcttttaattcattaattataaaaggccctacaccatcatcacatttaagctcgtttccaatccctaatataatcaatttttcattattttctaaaaattcttccagctgtcttttaaatgaaataaaatcacctaataataatttgcttcaatagttccaattccttttcccataatatattttaatttaacattaattaaatcattgcattttacatttttttcatctaaaggaattaacagaggcgggtttaacataggtgtaggtccgcaaaccagattatcattaagtttggtgatagttgtaattttcaatccattaactaaagaatccttattggccttaatggttattaccttttcaaaatcaggatttatatcatttagaaaattaatttcatcataaataaccggttttgataaagttttgcagttaacatcttcatcataatgaatgtaatccctctccaggtgtgcaagctctatagtattaataataccctgaggaattattttaccattctctttcagataatttcttgcatgattcaatactggaacttcttcttcatcaataagggcagtatccagcatttcacaaacaatcaaatcacattttttagaaaaatcatattttaaaacatcttcgttaacaacttcaatgtttttaaagcttttcaaattttctttagcacatctacttgctttaaaatcctgttcaatagctattatttctttaaaataagaatttagaaaaaaagataaaattccacttccgcatcccaaatcataagccaattcctgactggtggataactccttaatagcttcgtaaaatgctgaaagtctttcctcatcttttaataagtcaaaatgataaggagttgttttaaatttcataaaaaaaaataagaattaatggtgatgatcatgttcatgatctctgtcactgaattcttcaccattagcagtagttgtgagttttacgtgttctacccctttaagcctcattaatttatctgtcaactcacgaatttcactgatatctccgttaacaacaacaatttccatacaatatttttcagtcatatgaaggtgcatattcatgttaatttcatttctgaaactatgttgaatatctgcaagattttccataactccagtgtaatgatgatcataaataatagtgataattccaattctttctccttccatctcattcatccattgatgtcttacaatgtaatcctgaagagcatcacgaataccctttgaacgagactgataacctctctcttttaaaacttcatcaaaatcagccaataatttttttggtaatgacatgcttattctcatcatactaaaacattccataataatgtaatttagatataatattaaatttaaaaatatataaatgttatgaaaaaatatcaattttatattacttcatcacttattcaacaagtaaataataatccccatcttcttttttaataggtttcagaaggtttttattttccagagataaaataatgtgatacattttaaaattagaaagttttaaatcaccataaagcaaatggccttccaaagtatacttggaaactaaattcttatcatcaaccaactctttaattagattataagattccttttctttaatatttaattcaatcttctcaacatcttttttagatttgacagcattaatttccttatcagaaatagttaatttaacactgcttccattaaactcaatcaggttcttttctgataaggtatttaaaatttgaacaagatcatattcatgaaaccccaattcatcttttaaaaatttaatagaaacaccgtcaggatattcaggattgaatatttccacttgatttaaaacaacttcctctttttttgtaattgtaatcataaataatctatttatattataataattatcatttttaaaatttttgaaatcaaattatttctaaaaaaacagaagcaaaaatccctttaaaatttatattaatacttttttaatttctaatattaattaagtaatacttttttataaaaaagtatttataacatgaagcacaatctaaatataggtttgaagtaaaaacatattcaaaattattaaacatatataactattctgtcttttaattaccctcctcttttttacttcgaacttcacttttttaaaaaaaaacactattttttgatttaaaaaactgttgaagatttaggaaagtaacatataacttcaaatgcaaaaaaagaattttccaaaaaaaataaaaaaggatatttattctttatcaagatcaatacccattttacctgcaattcttgcaagcaatacagtaacaactacagcaacaatagttacaatgactgcatatattaataatcatgttactgctcctccagcagtgtaaaattcttcaattaatttttgtattgcttcattccaagctaaacctgcaacaaatgcaaatgctgtagtaattaatgttaacatagtttccattatcatttgcttatttcactagccataatcatcacctatataaaatctgagaacaatactaagatgataatattttttaaatttaatgtacaaatcatgtattaaataatttttgattatacatcttacaccattcagtaccatatattgattttattttatttaaatgtattttaaaataatcagttcaatattaaccaatgactgattacataacatacaataacaaaattaatcactttttcctaaaaatccaaaactaaaaaacttaaatattccaactataaaattaacatatatgaaagctgcaaacatattccatgacttacgcaatatttcatcaaaagacattataacaaaaaacgaattattaaagctcttaaaaaaatattgcaaaataatttcaccctatgatttaatgcttgcaacagctagaatgagagaagaaggaaaatatgttcaggccaattatcgtgaaaaatacttggaagtttatgtaaaatacttcatcatgcgtgtaaaagaaatacttgacaataacaattatctagatgaagctattgataaagaaagttttgatgaatcatttaatttattaaaatatcagtttgaaaaagaaagaaactacagcattgaagaagataagtttcctttaatttatattattactgctctttatacaacatttattttagaagagccaatccatccagtcggaactgaattccccggaagtttaaaagtagaagaaaaaaatggggagttttactgtccagttaaagacaaacaaaaagacaatgaaaatgctatctgcaatttatgtctagctgaacaaacccccagaatttaattttttctgttttcagaacctgccattggaacaccggttaaagctgatgcttccattgttaaggcccttaagttttgtttttccaattttgtaatatgggtgtttcctgcctgttgaacaagcatacatgcctcatcagtcattgcatttatataattagctactgctttacccatttccttgtaatcaagtctgtgtcttaaggacagatcctgtgtagctattcctttactacagttacctttataacacatttgacagaccctgcagcctatagaaatcaatgcagctgttgcaatatatactgcatctgctccaagagccaatgctttagctaaatctgctccagaacgaattcctccagcagctaccaaacttacatcttctcttaaattaatttcctttaatgcctgatctgcttccacaatagctgcaagtgatggaatacctgaatgttccataataacatcaggtcccgctccagttcctccctgcataccgtctacaacaattatatctgctccacccttagctgcgatttttacatcagaagctactttacctgaagcaaatttaacaatgatcggaactttccagtcagtaatttcacgtaattgagaaatcttcatacttaaatcttcaggacctacaatatccatgtgtcttgcaggtgatagagcatcagaccctacaggaatttttctgattctggaaacttctgcagttactttttcaccaagcaagtgaccacccattccggattttgccccctgacctattttgatttcaactgcatctccctgtttaagataatctgcagaaacaccaaatcttccagatgcatactgtgctataagtttatcagccaattcacgttcttcaggaagcattcccccttccccagtgtttgttacagttcctgcaagtgaagaaccaatagctaatgccatttttgcttctttacttaacgcaccaaaagacattgctccaatcattacaggagtatctaattttaaaggattttcagcatatctatctcccaatacaacatctgttccgcatggttccctatatttatcaataggaggtcttgatacctgtgcaggtattactaccaaatcatcaaagtcaggaatttttcttaaagctccagtacttctgattttatatgatgcagactgagcttttcttactatttccacaacatcagggaatccccatgcttctcttgcatcctgcggaattgcatttacttcaatagccctatttggacacatttccaaacaaattctgcacccgacacatttttcctgatttaatgggtacggttcaccctgaataatttcataaactccgtgaggacagttattataacatgagaaacatcttccacagattttttcatccctgtcatcacacaaataccaacaacaaccaggccttccaaagtttttcttacataaaaccggatttctttctactctatatggcatacacttccctcctattcaattaatgaccgtaaaatggtcttgcactttccggaactatttttttaaattcttcgtactcatcttcctttaaatcaaaatcatattcttccagtaattcttttaattcaagtttatcttcccatgttaattcgtcaattttagcattgtatcccaagcttttaacttcgcccttaacataaatcacaccacgaataatggattctgccacatcttctcctacatcacctaagataacaatacggccacccatcatgaatattccagtcatgaatcctgaatttccaccaatgacaatagtaccatttttcatgatttctccagttcttgaacctactgatttacgaacaacaactgttccgccatatattccctgtcctgctccgtcaccagctgatccttcaacaaccacttcaccgtcagttaaattatctccaacaaaccatcctgcattaccattgattttaatttttggtccgtcacacatggttcctgtaaaataacctacagaaccgtccagttcaatgtttacttcatcagttactcctgcaaccaaataatgcattgcattaggatttttaataagtattttatcataatcttttgcagattctttaacctgtgaatttagttcacgtggagaaagtgatgctgcatctaattcttttattttcactaaaaccaactcctaaatttcatacaccattacttcaccaggagaaatttgttcaatattttgagtatcaacaacttcccttaaagatacctcttcagatgcaattgcaaaaacatcgtcagtttcagccattactcccggacgtaaacctaatttatctttagctattccaataccatttggagttcctataatataagaaaaaggaccatccatatcttctacagactgttccagtgcttcttctaaagaataacctgtatctaatttatctgcaatataatgaaccaaacattcagtatcattaaaagtttcaaatacatgaccttttctttctaaaggatccctaatattccaataatttgtaatctgaccattatgaacaacagatacatctttaacaatgtaagtttcaaatgggtgtgcatgatatctgtccacaccactttctgttgaaaaccttgtatgacctatagcatgagttcctttaacctcacgcacattgtatctttttgcaatgtccaatacagaacctacatccttaatcatttcaaaatcctgacttccgttaattacaataacatcatcaattgtatcaacagttgagataagcggtttaagttctgaaaagttatttaactgaactttacatttgtaaataaatgaatctccaacagacggaagaacttcatcactttgaattggagttacaaagtttattgtatctttcacggtttcaagtaatcttggttgttctttcacttgaatttttaagatgtactcatcatccttaagacctgttccgccataaattgaataacctgcagaatcaggacctctatgctgaagttgatgaagcatattggtcatgtcattacctgcacaatgcaattttttatctttataaactataccagctattccacacaatttaaaacctcctctataaaatattcgtgaattctagtatcatcagttaattccggatgaaatgcaatagctatattatgtccttgctgaatagctattatttcatcatccaattttgataaaactttaatatcttctttggttttatcataatcatcaagggatggtgctctaatgaaaactcccaaataatcttcccctaaaatggaaattggactttcaaatgaatctacctgtcttccaaatgcattccttttaactgaaatatccataattcccaataaaggctgatcaaaatcagtttttttaccaagcaaaaccattcctgcgcaagttccaaaaacaggaattctgttatctttaataactttatctatccctcgttctttgatgatttttcctatcacagtactttcaccaccagaaatgattacaccatcacagttcgctacttcatcagcatatcttacagaaattgcttctgcttcaatacccatattttcaatagctttctttgtaatgtcgtaatgttcacttacggcaccttgtaaatttagtattcctattgtaatcatataattcactaatcattctaaacattattttaaaaaaatagcagtaattctaaaagttatagtaaaaattattaagatatagaatatttgctaatatactattatcatctcatattatataaatgtagtggaaaactacttccgactaaaaaattttctgaaaaaaagcaatgataatgatatgaatttaaacaatattcaaaaaaaagtggtaaaaaaagggaaaaaatgaagaaaataacaaaattagttattaacttttaatgctattgattgcgtttaaagcaccggccctaacataaccgctttcatcttccaaaagtgcttcaagcggttcgatagcggcatcatcttttaagtttcctaaagcccatgcagctgcacctcttaccctccaatcttcatcatccaaaatttcgattaaaggatcgacagctatttggcccatacgacttaaagcagtagaagcttctcttctaactaatttattgttatctctcaaagttaaaattaaagcaccaattgatttaggattagagatggctcctaaaatttttgctgcatttaaacgaatatttttcttcctatgggacaatgcagacattaaagcatctacagattcttctcccatcatctccaattcaccagcagcagcttcaacaacaaattcgtcttggtcatttaaatcttcaattaattcttcaacagattttgacataaacatccctcactatatttaatataactgtaaacatataatagttatatctaactatataaatatatttcgaaaatatacgaacaaaattaaataagtgaaataatgtacagaattgcaataatacccggagatggaattggaaaggaagtaatggaatctggcgaatatttactggacaaacttgatttgaatttcagttttgaatatggggaagcaggttttgaatgttataacaaaaatggagttacattacctgaagaaaccattaaaatagctaaaaaatcagatgcaacattatttggagccagtacaagtacccccggccagccaagtccaattataaatcttagaaaagaacttgatgtttatgcaaatttaaggccgataaaatcctatagaggcgtcagatcaataagtgataatattgactttttaatagttcgtgaaaatactgagggactttacagccagattgaatatgaacaggacaataaagtaattgcccaaagagtcattacaagaagagccagtgaaaaaatagccaaagttgcttttgaacaatgtatcgccaaacaaaaacaaaaggtaacctgtgtacataaaagcaatgtcctaaaaaaaaccgacggagtctttaaagaaagtttttacaaaatagctgaaaattaccccaatattgaaagcaatgatttttatgttgatgcaacagcaatgtatcttattacacaaccgcaaaactttgatgtaattgtaaccagcaacctgtttggagatatactgtctgatgaaggtgccggtcttgtagggggacttggacttgccccttcaggaaatattggagatgatcatggattatttgaacctgttcacggatctgcaccagatattgcaggtaaaggtatagctaacccatgctccatgattttaacaatagctatgatgctggattacttaaaagaatatgaaataagtaataaaataaataaagctgttgaaaatgttgtaagtgcaggcaaaacactgactcctgatttaggaggaaacagcactacatcagaacttaccaaatctatcatagatgaaatacttgaaggtgactactaaatgcttaacataactacatttcttgacgcaaatgcttgcagattagataaaaatgttttatacaatccaaaaaccaatgaaaaatacaattcacatgaaatattggcaatgacttcagaaattgcccgtgacttaaaaaattgcggtattaaaaaaggagatagaattttaatatatttgaataactccactaagtatttgttctcattatttgcaatctggagacttggagcaatagctattccaacaaacagagtatttactccccacgaacttgaatatattattgatgactcacaggctaaattaatgattactgacgaagacgcaaaggatattgttgatttggataagtatattccaaaaaatattgaaaattataaaaatggggaaattttacctgcagaacctacagactgggatgacttatgccaattacagtacacttcaggaacaacaggtcagccaaaaggagctatgcttactcatggaaattatttcactgcaatccataatgaatgtgatgtactaaccatgaaacaggatgatgtttacatggggatatatcctatggctcatgtaggactatcctgggcaatagctgcacttagagccggagcctactatatcatggtggaacaatttaatttagaggaataccttgaattatgtcaaaaagaaaaagttacagtcctaacaggtatgcccccagtaatacattccctgacaagattggaaaatggtgctgaagaacaattaaaaactgtacgtgaaataataagcggcggaggaccactgcacaagaaaatctggaaacaattccatgaaaaatacggtatcccaataatcaacgcttacggattatctgaaacaatcgtaattggaaccggaactgttatcagacctgaagattacagaacagcagacagatttgaaagtgtcggacatccagtctgtttttcagaagttaaaattgttgatgaacatgactacaccaaagaacttgaaaaatatgaacatggagaaattgcactaagaggccctgcagtagctaaaggttattggagacgtgaagtagctacaaaagaatcatttttagatgacggatggtttttaacaggagatattggatatcttgatgaagataaccgtttgttcattacagaccgtaaaaaagacatgattgtaatgagcggatggaaaatttacccaacagaagtagaagaagtgttaattaaatatcctgaagtaaaagaaatagctattttcagtatccccgactgtcaccgcggagagttacctgtagctgcagtagtttgggaaaataaagaagacagcgaaggtctaattagctatgcccgtgaaaatctttcaagatacaaagtaccaagaaaaatattcagtttaaaagagcttccaagagttaatggctggaaactgcttagaagaaaattaagagaagaatataatcatttatagattatatttcatttttattttcaaaataagaactatttataaatcatagttcctataccattttttgtgaaaatttcaagtaaaagagaatgttttttacgtccgtcaatgatatggcaagatttaacaccgtcttcaattgctttgacacatgtttcaatttttggaatcattcctccggaaataactccttcttcaattaagtccggcacttcatctatttttatcctttggattaatgaatcagggtcattaggatctcttaaaactcccggaacatcagttaaaattattaacttttcagcatcaacagaactagctatttcaccagctgcagtatctgcatttaaatttaaacttgatccatcatcggcgatacctaccggagatataaccggaatataattgtttttcagaaacatttcaagtaaatctgtattgatgcaatcaatttcacccacaagacctaaatcaatttcctcttctccgccagattcgctggtaactttactgacaggttttttatgagcgaaaattaatctgctgtctttaccagataaacttatgccttttccatcatgataagaaatctgagaaacaatatctgtacttattttaccaactaaaaccatttcaataatttccatagtttcttcatcagtaactcttaatcctttaatgaatttaggctctttacctaacttgtccatagatctggatatttccggaccgccaccatgaacaataagtggttccatacccacatattttaaaagaacagtatccctaactgtagaagacattgcatcttcatctatcatagcatgtcctccgtacttaatcagaatctttttttcatggaattttttaatataaggtaaagcctcaactaaaatatttacgtccttcatttaatcactacaataattattttacttaatactttattaaatctttggaattattcatttcttaaaaaaaatatattataatgtcaacaaatatctgaattttatccttcaaaacatgtaaaaataaaaaagttttctactaagagaaaaaatttcatagctaaactggagttccgcagattggacagactgcgtctcctgcatcaatcatctcaccacaaatcggacagattacagtaaattcatcatcttctccacacattatttatcccacaccagtattgtttttccgaagcctgaaatgtaatctttgtcaaaagcttcctttaaatcatttaatgatttgatagttacaacttcactgattaacttatccaatgaatcaaataaattaggattgtttttaagcaattcaactacttttaagaagtctttacgttcacttctacttattccctggattgttaatcctttttctaaaattaaccttgtattgattggaataggatattcacttactccaaataagattattgacccttgaggattaattgtatttattatttggtcaatagctgcttgtgatgcatttgatccaacacattcaaaaccatggtcaatagccaagtcatctggaacctcatggaatttgtatgtcttatctgcaaatgaaaataagttcagattttcaccatgctttccaataactgtcacttcactttcagggtaaaactctttcagcagcagtgctgtaatatatccgaggtttccgtctccccaaacaccaaagcagtttttgtgtttaatggctattttttcaaatctgtctattccatggcagattactgaaattaattctataaatgcagaaatttttaaattaaaattatcaggcagtttaactagtctgtcaggatttagctgaattaaatcacttgtaaatccatcaaaaccactgcctctaaattttgatgacggcaggtaattagctgatatatattcatcttcttttgtcggagtgtttggtatcattacaactttatccccaacatcaaagctccctgtattgtcaaataccacttccccgaccccttcgtgaatcagagccataggtaatttttcttcaagaacatcacttgctcttttaccctggtaatatctttggtcagcctgacaaattgagagataacttggtcttacaattacattatctatgttaatttcctctatagcctcttcaaagaattttggagcaactaatctgtaaataatattaatcatttttatcatttagaattgtattagctaatttcaaatcataaggatatgtaattttaatatttgttacatctccatcaacaagagctacatctttaccttttaaaacaaatattttagcagcatctgtaagtatctctttttcaccatcagttaaatcattgattaaagaatttaatttatttatcttaaaggtttgtggagtttgaccctgataaaaataatccctaattggaatgtttttaattatctttccatctctactttccacaattgtgtctgtagcaggaattactgtatcacaggccccatatttttttgcagctttaatattatcctgaataatcctatgggttacaaacggacggacagaatcatgagttataattattgaatcatcatcaacactgtaattttcataaatatagtcaatactgttttttaaagtatcgtttctggtttttccgccttcaatcacaactatcttatcgttgtttagagtatactcttcgattaaatgttttgtgtgatttataaaattttgtggagttaaaactatcacttcatcaatctcatccataatcacaaatttttcaattgtgtggattaaaataggtcgatctcccagatttaaaaattgtttaggagtgtctgtatcccccattcttgatccaattccacctgccaaaacagctacaaaaatcatttttaactactctttttcaaatattattaaataatgagatttgccttcaggaatgtcttcacctatttcctcatttaaataagtcattttaagaccatgtgctgaaaataattcctgcaaatcatcaggagaacttctgatagctgttggaggtccgtttttaacatcctgttttttataatccataatagctattcttccaccatcggttttaattaccctagccaattcgtccactgcttcatccaatgttcttgtagctttaaaaccatggaaaacattaaccatcaaaacaacatccaatgtttcatcatccaaatcaatatgttcagcaatattggatactattgggattaggttatctgcattgttttcctgtttgtatttaagcatatcttcaatagaaggttcatacatatccaaagcataaacgcaaccgtcagtaatgtattcttctaatgctttaatagctacatgaccatctccacagccggcatccataaagttctcactgcctgtgagattcaattcatctaaaaattctttagaatcaaggaacttttcactagtcatgccttgaattctgtggccatttgcaggcatcatcattttctttttactcataataccacatcttatagtatatgagtaataatctttaaaaaatagtatatatttttttctaagtaaaaataagcttaaaatttaaaaaaaaagttatggaaaagaggattattttttccaggtttgtttaactcctctacctcttttactaccaggtttggtataacttctttttgctcttgttcttttattggttcctttaacttttgccataatcatatccccattaaatttaattaataaattaaaaccaaataatgtaactatcaatagttaaaatttgattcaatatcattttaatcgaaaatcaaaaatagaatttctataacataaaaatatttacttcttaaagtatttatatcttttctttaagtagtatattcagcattgattttcacataatcataacttaaatcacagccccaagctgtagcttcaccatcacctttattaagatcaacatttacaatgacctcttctccgagcatgattttctcagctcttaaaagattatcagttccttcaaaagcaagaatttcaccatcttttacaaggtcaacttcatcttgtttattagctatagctattgttactgtatctgcacttacatctgctccggaataaccgattgctgagactatccttccccaatttggatcaccaccaaatacggcagatttaaataaaggagaagttacaattgccttagctgccaatctggcttcatcaatatttttagctccataaatatttgcttcaataaccttagatgcaccttcaccatctttaaccatttttttagccaaatcaatacaaagatactcaagggcttcctggaaattcggatcaatttcaccgtcattgactatattgactccagacgccttatttgccatgagcaaacaggtatcatttgtactctcatcaccatcaacaacgatcatgttaaaacttttatttgcagcttttttaagagctttattaatatatttactttccattactccatcagttacaataaatgacagcatggttcccatatttggagcaatcattccgctgccttttgtaattcctgcaatttttactttttcaccattagttaatgtgacttccaatgcacactgttttggaattttatcagtagtcataatggcatttgcagctgccaatgaatcttccggtttgtttccaagactggaaaatactttagaagccacaccagttataacatcaagaggcattttacggccaataaccccagttgaagaaatagctatttctcctttaggaatattcagctctttagaaaccagttcaactaatgattcacaatcttcaattccctgattgcctgtaaaacaattagcatttccactattaacaaatactgctgaaacttttcctttttcaactacctttttagtatatattacaggagcagccactattttatttgatgtaaatactgctgaagcatcactattttcacttacaataactgcaacaccatattttccttctttagcacctgccactttaagattatcaataactgacaatccaccatcaagttctttaaatatcatattacttccttacaaaaaataaattaataatcatccgaataatccaagtttgattcacctttttcaaggtaatttgattcatccttctctgaatcgtaagcaagatcatcatttgtatcggttaagtttgtagtcatttcatgagtaacattctcaatgtgagttgtgttgttagccacatcagcaccatcatctgaaataaccatagatacaccaatgccagcacctacacaaaatgcaattaatgctataatcataaacacaacaagtgttccatcgtttttagacgtcactttaatccctttcttttaattattttttaataaactactattatttaaacattaagacaatactgcataaataagtgccaatactattccaacaaaaccaaacattcctaaaccaaatatggataaaacatacacaaatataaacacaaatgcaaatattccaatcaatttgcctttttgattttcaattaaatctataattgtccttgaaaattcagaaggaatattgtaagcatataacccgttagccaattcaaatacaaccagtgataatggagatgatgaatttaaactatctaccaattgagccctttcaccagcttcccttctacttctgccaattcctgctctgatttttgcaccattatctaaagcaaaccatgcagaatcaagccctgcacgaatagccaaatcttttgatgggaatctggctataaaatcatctcccccttcacgataaccttctaattctccttcacactcggtttcaatgaaatttttaattcctgtcatcaattcaacaagcttatttctaccatttttactgataaagcctgttgaatctattaaatcaatgaacaaataattttgaaattctttaggtttggactgcattagtttaaacggttcgtcaaacacaagtgcatattcaccaccaagtttggtaaatgcaacacctgggaaatttccaacattctgagtgtaattaattgacctctcaatagaagcagctccggtcatacctactgcagaaataattggaactccttcttccagccctattccgataatttcaatagccacccttattgcatcatttttacttaacattcttgcaacaagttctgtagagctcttttcaactatcaatcctttctcattttcaatgatttttacaagtatattaattaaattagatggatgagggagctcgacatagaagtaacggtcactacccataataatgttacttacaagtgcatattcttcaactttattttcggctgctttcagttcataaaaattatagttttccgggagattttctacaccaacatcccgcttaagattttctaaaatactttcagatgtaatttcggctttttcaagttcaaaaagaatagtttgagtataattaaatagctcaacatactctgtttcaacagaatttgttggaaaaaacttagttccaacactaattggattaagttttgtagatagcttaataagttctttagttaagctattaaccatccaaacttcctcctttttctagctcaatctcaaaatctccaggtttctccaaaagcatatctggtttaacagaaacaaatggaaatttccaagatccgagccttccggctatagtgctggcaatgtttcttgaatttttcttaatgaatacttcatcatgagtacttacgcgaaccaaaacattataaggagcatgttctgtaacttcatcagccagcattatatttaactcaaaagtgccaggtctggtaaataaatcattacgaacagctatcaatggttttttctcaagtcttaacctgtcagcaacagtaacagaaatattacctgcatttttaacagctaatttgtaatcctttggatggaccaatacgaaaataacataaggagcagccacttccacatcatcaaccatgtccacaatcttgttaaacataggtatttttgaaaagaccttttctaatttagaactggtgtcattatcattatctatacggataattgcctgtttagcaatgtttaatggtgaaatttccaaaccttcttttccggtataaacttcccatcttttgaagtttaattctttgataatctcatcagatatgtgctgcaaaatgtttttatcctttttaggtgatttaggtttcccaaatgtaactctgccattttctattacaaaaggaatcctcatagaattaatatttttaaattcagcagcatagtctctgaatttgtcattagataaaattttagctttttcattatgggctatattgagaataaaatgatcagcatcattacctgccggaacttcctctacattttcactttccaacagtttttcaaatttttctttatcatcaatgtcatgacgtagtgatgcatcagcaattattacaaattcatcaccactttcttctaaagatttaaccgcagctaaaatattggacatttgaggctgtgaattttcattttttgtactatatgcaacatttgaagcatcaacaacaactttcacattatcacctaaaatctatttaattaatattatattatttgtaaattgtatatttaaatttaattaagagttaactaaatgctatttctcggatattctccaaataaaaacctttctccatcaactttattaagaaatatcctaattgtatcttcagtaatttcatatacattatatgaatttttatcatctcctctaagtttattagaagataatgatcccgcattaacaaacagagtattattcattttccagatatttggaacatgcttgtgtcctgcaagtaccaaatcaacttcatggtcagttaatgttttaagaacatctcctgcatcagttaatacattacgttccctacctgtttttggaataggaattacatgatgatgaagagccacaatactaaataactcctcaataacacattggtctaactgatgttccatccaaagatgctgtggcctaccaacatttccactggatatgtctggagaactgctgtctaatcctataaccacaaattcatcatcttttgtaagtttccagctacattcccctattaactcttcaaaagtttcataacccaaattacgggcatcatggtttccaggtactgcaaataatggtgcatcaaacatctccaaatatttggtagcttggataaattcactataataaccattattagtcaaatcacctgttaatattatcatgtccggatttatggcatttatttcagctacagcctttataaaaacatcttcttcaaatcccaattcactaatatgtaaatcagaaatatgtacaataagaggcatattattatcctattgatttaattttaagatagcttctgcaagatcaccattagtatcttccaaagctgcttttgcttcatcttcagatacatttgcttgattagctaccatttcaatatcttcatcaggaataacaagttcttcatcaattgctacttcatgtgctttaccggttacttgataagtttcctgacccattacattcatcaaacttacttcagcatttggaatgactaattctttatcttctaaacggataatgacttctttgactcctttaagatctttcatatccattcccatctttttcatttgtctttccatttttttcatctgctttgcattcataccaggtatcataatactgtcctcattaatttaatattagtaattagttatatctttcaatattattaaaattaattatagaattcaaaattatacaaacataacctttatttataccaagtatataagataaactgtttaacgaacattaaatactgggggataaattatgaaagttctgtttgttaacccaccgcaaacggcctcaaaatataaatttatgggagtaatagcaccaccattaggtattgcatatatggctggagtactgcaagaaaacaatattgatgttgaaatacttgatgcatctgcagaagatatggattttaaagatgttgaaaaggaattacttaaaagaaaaccagatttagtggcattgactgcccttactccaacaataggaagagcacttgaaactgcacaggtagttaaagaaacccttcccgacgcaatagttgtaatggggggatatcatcctacatttaatttcatagaaacccttgaagatgaaaatgtagatatcgtaatcagaggtgaaggagaatacatcatgttaaatctggtgcaggctctggaaaatcaaagcagtctgcatgatgttaaaggaattgtatttgaagacaaaaactcaaaagaaattgtagtaaatcctgaagctccattgatacaagatctagacgaacttccttttccggcactaaacttattgccaatgaaaaaataccgtttattggacatggatacccatatgacaactatgattacaaccagaggatgtcctatgcagtgttcattttgctcatcagctgcaatgcacggaaaaaaaattagggaaagaagcgtagaaaacattgttgatgaaatagaatatctaaaaacaaattatgatattgacacaattgcatttatggatgacaccttcactttgaaaaaacggaaagtaatggctatttgtgatgagatattaaaaagaaatattgaaatcatgtggggctgcacatcacgtgtagacactctagatgaaaaacttctgaaaaaaatgaaagaagcaggctgcattacaatatttataggagtggaatcagcagaccaacaacaactggacaatatgtgcaaaaacactacaattgcaaaaattgaaaatgcatttaaaattgcacataagctaaaaataagaacaatagcttcagtagctttaggtatgcctggagataccaaagaaatcatgaacaaaacagttaaatttgtccataaacttaaaccgaattatgcaatatacagtttagcaaccccatatccaggaacaagattctataaagaagcttttgaaaaaaatcttataaaaataaaagattggtccaaatatacattaataactccaattttagaaacaatagactgttctttaaatgatatgagaaaaattcaagcaaaagcatttatgaaattttatttaaggccacattatataataagacaatttttacaagacggcccttaccttttaaaaacaatctttggagtaataaaaactgcactgtcaaaaactcctaaaaataccgattacaataaaagagaattaaaaaatatgtaatttttaaaaataagttttttggtgaacattaactaaaccaaattacatattttttatcaataccagtaataaaatagtttaaaataattttcaatggagatttaaatttaagaaatgtgtttaaattttctaacctaatggttaattgggaggtaatgttaattgtatttattgtcaattgggggaaaataattaaactattttttaccagcatttaaaataagaaataattatcaagactttgttaactacattaaacaccataaaattgaaattaatgtttgaattagttaaggggatttttcaatttttcgtcagaatgtcgtacaataattaatttttagtattggcactaataattagcagaaactttaataaccgcttaatataaccaacagccctgaaataattatcacttacggaacaatgtaatatatagtttacattgtgtaatatatcctttacatcttatgacatatatattttactattttgaaaaaatgaaaaaataaaaaaagagaatggatattaataatctctattccaatacacaatcccgtagactacgcataacaaagtggataaaatgattaatacataaacaccccaaatccaagggtcttcaattcctaaaaccatcattgtacctcacttcctttgttgccaatattttcaaatgccttatcaataacctcttgagcaggaggttttgtaagtaaactaacaaccaatgtaaatatagcagaaacaggaacagctattaacattacatcaatataaggccatggcatggccggcaataaagttgcacaaccaaatattgctttacacaatcctaaacctttagctgtttttgcaaatacaaagagtaaccagaataaactaacaaatgttccggaaacaatacctgcaatagcacctttagcagtgattcctttccaatacaatgctcccaagaacacaggtaaaaatgcagccgcacagatttcaaagaacagacttgttccaagagcaacaatacttcccggaagagaaaatgccaatactaaagctaaaataatagctataagaataccaagtcttgtaactgtaatttggtctgatttctgcttagctttatttcttaaagtaccatagatatctacaccaaatgcagttccctgagtatgaagctgggaactgattgtagacattgccgctgccaataatgatagcaggaaaatatatacaaaccattcaggcaatgccatcgtaataaatgttggaataactttgtcaacatttccgccaacaacatctacagctatttttcccaatttatcaaagaaatacacattggaaagtgaacctacaatataagctgtagtaggcattattgcaataaataatcctccaacaagaactgatctgtttaattccctgtcagatttaacagtcataaatcttacaatcagttgaggttgagccaatacaccaatacctacaccaataagagtagatgaaaccaaactccaccaaaacggtgaacccaactcagggaatgttgtccaacctgttccccctgtagctgtagcactagccggatataatcccaccatatctgttaatgctgtgtttgcatgagttacaccaccaagcaaccagtaaacaaatccaagtaaaaataccattgcacaaaccataattactccctgtagcgcatcagtatacattactcccttaatacctccaaagaatacatagaatgtaattataactgataaaataaataaggatattccgaaatcaatcattaaagaagattctaagaatcttgcagcaccaataagaactactgctgcataaagcggcatagcacaaaatataactaaacctgagaaataatgaataaatttactattaaaacgtttgcccaagaactcgggaaacgttagggaacctaaactgtgtcccattctacgggttcttttacctaaaaatacaaaagctatgaataccccaatgattatgtttaaaaatgccaaccatagaacactcataccatattcactagcaactccaccaaaaccgacaatagctgcagtcgaaataaaagttgctccataacttaaagccatgatcgcaggatgtgtatccttcccaccaatcatgaaatcctctgaggattctgttcctttccatgcataataacctaccaatactaaagcaaaaatgtagattataaatacaatcgctaaaatcataatgtccataatttaaactccgaatatattaaaaaaaattaatatatgattaaatttttaatatgaatagttatatataattttatattaaaaaattagaacaaagaaatataattaagtgatacaatggtatggaacaaacaagccgaatgtatgagtaaagaagaaaaagaaaaattacagctggaaagattacaacagactgttaaattagcttataacaatgtttcattttataaagaaaaatttgatgaagctggtatcaccccagaagacataaaaacattgaaagatattgaaaaaatcccttttacaacaaaagatgatttaagagcagcttatccatttggtttatttgctgttccctacgaagaaattgtagaaatccatgcatcctcaggaacaagcggaaaaccaacagttaccggatataccaaagaagatttggatatctggtcagagtgtattgcacgcggtcttggaatggtaggtgttgaaaaagaatatattcttcaaaatgcattcggatacgggttatttactggaggattcggtattcaccatggagcccaaaaatttggagcaataaccgtgccgatttctgcaggaaacaccaaaagacaacttgaaactatgaaagacttccaaagtgatgttataacatgtaccccttcatatgcaatgtatcttggagaaagtcttgaaaactccgatattaacttagaagacattaatctgaaaataggaattcatggagctgaaatgtggactgaagaaatgaggcataaaattgaagatacattaaacatcaaagcatacaatatctatggtttaactgaaattatgggtcctggagtagctcaggaatgtgttgaacaaaacggcatgcatattcaggatgatcatttctatccggaaattattaatccgaaaactggagaaactctaccagcaggtcaaaaaggagaacttgtattaactacacttaccaaaactggaataccaattttaagattcagaacaaaagatttaacctctttaattatagaacaatgtgcatgtggaagaaccagtgtaagaatgagcagaatcaccggcagaagcgatgacatgttaaaaatcagaggagttatggttttcccatcacaaatcgaaaaagctttacttaaaattaagggagcaagtccaaattacttaatcaaggtaacaagacctgataccttagatgaagttgaagttaaagtggaagctaccaaagaactattctctgatgaaatgaaagaaatggaaaaaactgaagcaatgattgtaaaatccattaaaagtgaaactggattaagggttaatgtaacattatgtgaacctgaatcattaccgagaagtgaaggaaaatctgtaagagttattgatgaaagaaattttgaatgaggtgaaaaatatggtagtaaaacaaatatctgtatttatagaaaacaaagaaggaagaatgaaaaaagctattaatacactagctcaagaaaacataaacatacgcgcactttcaatagctgatacaaccaaatatggaatcttaagattaattgtttcagacaatgaaaaagctattgaagcattggaaaaagacgggtttattgtaagggaagatgacgttattattgttgcagttccagatgaacctaacggattaaataccacattagctatatttgacgaaaaaggcatcaatttggattacctttatgcatttgtaagttcaaaaacagaaaaagctattgtagtaatgagattgaaacatatggatgaagcaattgctcttttaaaagatagtgatgcacacatcctagaaaaaaaagatatagaagatttatagaaaagactttctcttttcttaatcttcttcagtcaaaacaatttcaatacattcttctacaaaataataagaatcatccacttcttttaaagtttcagctttctcagtcaactcgtttgattccagtaaatgcatgaaatcgttgaaaaacaaattccactcgtcttgttcatcctcatcacaatagctagtatttaacctaatgtcagcaggattatcagaccagtccacaccatcataaaactcctgagcttcaatattgccatcttcatcataatcaatagctattgaaagttcgaactttttggttcctgcttctttagataatttgaattccggcattttgaaaacctccattaataatatatttaaaattcttttaacaatgatgcaatgtctgctttagaataacctaaacggacaaataaacttttgacaggttctgtttcaggaaccactccaagttctgaccatcttttaaaatcattgtgtaatatgctgtttattaaaagttgaatagtgattaaatcatcacttttaatagctacaaaagcatcttcatctttaaaaacattttcaggatcaattaaagtaaccctgcccgttttatccttttttaatatagcattatcaattttataaggcatatataacaccctctttttagtacttaattattaattaatttataattatttaaatatttaacctttaatccaattataaccactttcaatagcttttaaatttaattcatgaaatttcggtttcaaattatttttcatagctgcaataacagattctttggaaagtgggaatttgtcgtctgcagttacagcacctaataaaaccatgtttaaagccaatacatttccggcatccatagccaatttagttccatcaatcggaaggacatgtttaaaattttcttttaaaacatcagtaatgttacctacaccaggataaggtttatctgatgaagctggaacaataggatgagtattgaatactattttagtatcatcatttactttatccaaacctcttaccgtttctataggttcaaatgaaagcaacatatctgcaccatgttccggaataattgaactgttataatcacctatttttaactcagtagaaacagaacctcctctttgagacattccatgaatttcactcataactacatttaatccttggttcattgcagcttctccaataattacagaggttttaataattccttgacctccaacaccgcaaatataaatattataatgattattcatatttattcacctcttccagcttctaaggcaccatatttacaaacttggatacatacaccacatccatcacacatagactgatcaatagctatttttccaccatcttttgaaatagcaggacatgcaagttcacttacacatttattacatccattacaattggaatcaatataatttactggtggtttcctagttttacctttaattaaagtacatggagctttagctataatcacacaaacttcatcacgttctaaagcttctttatatgttttaactacctgatccaagtttaacggattaattacacgaacataattgcagccacaggctaaagccagtttacgtatggaaatttccggtgcatcatcacccattccatcaacaggaattccagggtttggctgacctccagtcatagctgtaatcctattatccaatacagttaaaataaaattgtttttattgtgaactgcatttatcaaaggtgatattccgctatggaaaaatgttgagtcaccaatgaaacttattactttctgatttgtagctattgaaaatccgcagccgtctcctacacttgatcccatagacaacaagtaatccgcagcattatatggtggatttattcctaaagtgtaacatccgatatctgatgcaaatacagcatctttaagaggaattcccaattcctccaatgctttatttactccataatacattgctctgtgagggcatcccgcacaaagtaccggagctctggaaggaatttcttcttgtaaattaagtaaattatcagaataatcatcggtattttcttcaatgaagtttaaatatttattgaaaccattagctacaatatctgaattaaattcatgatatactgggaaggttccatctaatttaccatgaacaacagtatttaaattatttttaccaatagctaccaatgtatccttttctataatcggatctacctcttctacaataaagacttcatcataatcctttacaaaatcagctaccttatcataagggaaaggatatgaaaatccaagttttaaaacatcaatgtccagattattatatctgattacatcataagcataattataagcactgcttgaagcaatgacaccatattttttattctggctgaaataggattcaacattgaaatctgactcgttggttattttattaatttcatccattttttccactaatgcaacatgcatatcctttgcaaatgccggaaccggaacaaactgtgcagggtttttcttgaaaaatccttttttccaatggctttcaccttctgaagaattatctaccacctcaccaaattcaacaacacccctcatatgagatacacgagtggttgttcttacaataactggcaatttaaattgttcagataaatcaaaagcatatttaaccatgtctttaacttcctgacaattagaaggttctaaaataggcacatttgctaaacgtccgtaattacgggtatcctgttcattttgagatgaaaaaagtgacgggtcatctgcagataaaataaccataccaccatttactccactgtaagcagttgtcataaatgaatcactggctacattcatacccacatgtttcatgaaagtaaatgaacgcagtccagatgccgcagcagtagctgcaacttccatagctactttttcatttgtagaaaactcaaaataaatgttagcttccttagccaatccggataaaacatttccaatttctgatgaaggagtacctggataagtagctgcaacagaaacaccagcttctataactccccttacagctgcctcattacctaacaaaaattgtttatcaccaggtttccctgttactaattcttttaagttcattatttatttcctcaaataatttaaaaatctaataaaatatataatataataggtttagatataatataaatattatacttattttatatttgattatgagtaaaggggtaaagtaatgattaaagtatatgtatcaaggtttgacagagaagtggacagtgaacctcatttggagtgttatgaaatagaacagacacctcaaatgaaagttttagatgccatcaatgccattaatgaaaaatatgatgccgacatcagcattagaagctcatgtagagcaggacagtgcggttcctgcggaatattatttaatggaaatggggctcttgcatgccaaaaagatataaaggacggtgcaataattgaacctcaaaatttcccagtaattaaagatttgattgttgataaaagccagatagaacaggaagtaaaagatttgcaactctctttaaatcctcaaagacatgatgataatttaaatgaaaatctaactccggaaaatattaaaaataccaaaaaagttagaagctgtattgaatgctattcctgttttgcaacctgtcctgttataaaattcattaaaacaaaatttggcggaccttacataatgagatatctttccaaatttgaatcagacccaagagatgaatttgacaggctcgatgaaagtttaaaagaaggattatacaaatgtaccagttgtggaaagtgtaaggctgtttgtcctaaagatataaacacctttggagatgcaattgaacgtttaagggaaattgcatgcaaagaaggtaaaggaccgcttccggaacatgttgcatttaaagaaaatatagaaaaaacaggaaggtcaatcaaagctgaagggccaagttttattgaagaagttaaaaatgacaacggttcaaaaatagcattatttaccggatgtatggtagataataaattacaccacattggagaagcattaattgatgtgcttgaagctaatggaataaccatagatattcctgaaggacaggtatgctgcggttcaccattaataagaacaggtcagacagacatggttcaggaacttgttgataaaaacaatgaagttttcagggattatgatactgtacttaccatttgtgcaggatgcggttccacccttaaaaatgaccatccaaaatatggatccaatctaaatgtaatggacatcagtgaatttttagtggataaattggatactgacaaaatgaaggaactgaacacaacagtaacctggcatgacccttgtcatttaggcagaggtcagggaattaaaggccaacctcgtgacattcttgaacagattcccggagttacctttaaagaaatgaaatatccgtgccaatgctgtggagcaggaggtggaataaaagcaggacatcctgaaattgctatgactcttgcaaaagaaaaagcaaaaatgattgaagacactggtgcagaatcagtgattacaatctgtccgttctgccaatacaacattcaagacggattggatgcaattgaccgtgaagacataaaagctatgaacataattgagctattacaactagcttatcagaaagattagataaataggggttgattaaaataggagatgcagctgtaagtgaagaaaaaatagttgaaaccaacttaaattcaccagaagtcaaagaaaaaactaaaagtgaaaaaaaatcaacctcttcgaaaaaatcaaaatccaaaaaacagtccagaggaataaaaatagctaaaggtcctgaagatgatggcgaaaaagaattaagcaattttaaaaacaacatttacattgtttttgtagaatgtgaaacacctggaaatatcggttttcttgcaagaactatggcgaattttggactgaagaatttggttcttatcaatccacctactttaacccctgaagcattttatcaggcaacacatggaaaatacattgtcgataatgctaaaatatatcatactcttgatgaattctatcagagccaaaggatagactttaaagtagcttcaactggtgtagccggaggaagttacaatctctcaagaatccctgtaaggcctgaaaatcttggaaaaaacatcaataccaacaataaaaccgctattttatttggaagggaaggaaatggacttacaaatgaagaaattgaagactgcgacatttgtgtttcaattccaactgatcccacataccctattttaaacatatctcatgcagcagccattattttctatgaattatttaaaaatatgcatgaatatcctgttgaaggcctggaagaaagtacagctattgaaaaagaatatgtgctgaaagatatgtatgacttgattgatggtttagatatccctgaacacaaaaagaaaaacggactcaaatcatttaaaaatattattaatagagcctacattacaggcagagaagcccatacattaaaaggaattttaagacgtttaaaaatgaaaatgggtaaacaatgagaaaaattagttttgcagacataaacatatttatagtaaactacatcttcaactggagattcagaatagctaaattaactaaacaatccaaaataataaggaaaatcattgacaagggattatttgaagatgatgacgttacagttattccaaatacaataaaaatcaataaaacaatagaagctgaaaaatctgagtttattccaacagatatcttgaaagaagttattgaaaaaattgacgatattgtaataatgaacagctgcctttgtagaacatccaacaattgtaaggattatcctcaggacataggctgtattttccttgggccaacatccagaaaaattccgcaaaacctttgccataaagcaagtaaaaaagaagcccaggaccatgttgataaagcagatgctgcaggattaagccatataatcggcaggaataaaattgactctatttggatgaatgtaaaaccaaaagaaggccttttaaccatatgtcactgctgtccatgctgttgcttgtggaaagtaatacctcaattagacgacaaaataagcgataaaatgcacaaattagatggtgtggaaatagctattgataactcaaaatgcatagactgcatgaaatgtttaaatgaaatatgcatgtctgaggctattagttttaaagacaatgccatccaaatcaatcaaaataaatgcagaggctgcggactctgtgttaatatttgtaaacaaaatgctattactttaaaatacaacgataaatcaattgattcaatagtcaacaaattacaaaatttagttgaactttaaaaaccgaatataaactattttttacaatgaaagttcattaaaaagacaaaaccaggttaaaatattgtcactttcaaaaacttgtgtgatttgaattttcactagtttttgagtcacgaatttttttcgttctattttttctttatttttaatttaaaagcagtaaaattaatatattaagtggagctaatatattaatatgtctagtatcaaaataaaagctccatatgaatttatggagtcaaaacaatttaaacttttcgattttgttcctgagttttctgaattccgtcaatttgatgatctttctcgatttggttgcgaaaatattgagaataatcttatcagattggaaaaaagaggtaaaatacattttgagaatagagttgcaatttgtccatcttgtaaatcacataatgctgttaaaaatggtacttatgaacgtaaacttatttttttaagaattggagaacaaatttgcactattcaaaaatataagtgcataaaatgcggtaaagtcttttatactgatttattatctcttgtttattctaattcaaatattacattgcctgttattgaatgtattgagaatttatatcaaatttatggagcagggctccataaaatacgatttgatttaaaacaacaacataacattgaaatctcacatcaaagcattgaaaacatcttattgaactctaattatcaatttaactatgataattggacttattctggatattacttatttgatagtctttgggttaaaattaatggtgaatggaactatattttagccttattcgacgttaaattgaatactatcgtttccgtcaaattggtcgaatcagaagattctaagaccatttatcaatttttaaacgaatctctaagaaatcagaaaaaaatatcaataggcacagacttaaaacacgaatatcgtgaagccatcgataaattaaaagtaaaacaccatttctgcaaatttcacgtgaaacaagcagtaaacaaaagatttaaagattactttgacaaaaatccattatctgaagacgaaaaagacatattaaattgtttaaaacaggacatttataaaatattggatgcaaaagacttaaatactgctaaagaacttagaaacgaattaataaacaaaaaatatacaaaaaacaagttcacaaacaaaattctttggaaattcatcattccttacttcaaaaaattaacgacacacctggaaaacacgaacatcccatcaacaaacaataaaatcgaaaatatcttccaaaaagtattcccaaaacacataaaaagaacaatgaaaatagaacaaggacttctagccagattcatgctaaaactaaattattggaatttaaacaatgaaaaagaaaaaaatcacacaagtttttgaaagagccaaaatattttaaaaaaatttttataattgtaattgaagaaatataattacataatgaaaatttatgaatattattaaaaatgaaataaaaaagattctttttattatgaacaaaaattaaattaatcgcttattcattcaaagaaaataaaataatctggaattaatgttaagtttaaacaattattttgtcaaaaaagagttttttgaagttaaaggagataaaatgagtgaaaatagtaatatgctattaggcgttaaagacaaacctcctgcagtaaattggattttacttgctatacagcatgtatgtgctatgtttggagctactattttagtaccaattgttgtaaatactactgttggatcagatgtcttatcaatacctgtagctcttgtcacctctggtataggtactctcatttacattgcatgtactagaggaagaagtcctgtttatctgggaagttcatttgcatttattgcaccaatggtagcaggatatgcaatagctggaaaagccagtgtttttacagctataatgtgtgtaggaatagtgtatgcaattatttcaactataattagagtagttggtaaagaatggattaataaaatattgcctcctgttgttgttgggcctatgattatgattattggtctgtcacttgcaccaacggcaatcgaagaaattggtttgaatgctagttcagttccaatcacaagtttaataatagcttttgttgcatttttaagtactgcaattttagcagtcagaggaaaaggaatattaagagtaatcccatttttaattggaattataataggttatattgtagcagcacttctcggagtagttgacttctccggagttgcaagtgcccacattattgaaattccaaaattctacataccatttgttgattataatcttaattttggagcaatactgacaattgtaccaattgcattagtaactatggttgaacatgttggagaccacaaagttttaagtgaaattatcggaagagacctgattcaggatccaggtcttgacagaactcttttaggtgacggtatagctacttttattgcagcacttcttggtggacctgcaaacacaacctacggagaaaatacatctgttgtaggtatgactagagttgcatctgtttatgtaattggacttgcagccattatagctattatctttgcattttcaggacatttaactgcactgttaactgcaatcccttcaccagttcttggaggtatttcaatccttctttatggatttatctgtgtaaacggtcttaaaatcttaatccacaaccatgttgattttacagacactaaaaatgtagttgttgcagctacaatgttagttttaggtttaggaggagctacactatccatcgcatacggaaatttatcattagctatttccggcatgtctttagcagcaatcattggaatcatccttaacttatgtattccggaggaaaaacatgaatgaaattgttctgaaccatccattaataacacataaattaggtattttaagggatatccatacaggaactaaagaatttcgtgaattaattacggaaatttccacacttctttgttacgaagcaactaaagatgcaaaattggaaaaaacaataatagaaactcctcttgaaaaaatggaaaccggcaaactaaatgaagacaattatgcaattgtgccaattttaagagcgggaatgggtatgcttgatggaattataaatgtaattccaaatgcaaaggtaggccacatcggtctttacagagatgaggaaacattccagcctattgaatactattttaaaatgccagaaaatgttagtcaaagagaagtactgattattgatcctatgcttgcaacaggaggaagtgcatctgcaactatttcaagacttaaagaagaaggagttaaaaaaatcaaacttttatgtgttgttgcagctcctgaaggaattaatttaattgaaaaagaccaccctgatgttcaaatttactgtgcaacagtagacagaactttaaatgaaagcgcatacattctaccaggtcttggagatgctggtgacagagtatacggtacaaaataatactatgaattattcatagtattccttttcttttttaaaatacagaatagaaagagtttaatttaatcatatgactccttcaaataccaaaaatataccataacctatgaaaattaatactaaataaataacagatccttttttataaccttgtacagttctaagatcaaatggaacaacattatccaaaatatctggagacgctatgaatatttgagttaaaaaagaaaataaaaaatacaatattgcccaaattaatggataagtaccataaatcaaactaattaaaatagtccttattgaaaattcaagacctgccattgcattaagctgacccagcatgaaataaaatggagggcaataatctaattgtttgggtgtgacaattatcttattttcataagcatcgatccttaaaaacatcaaaataaatgggataggcatggcaataagaaaagctgttgctacaattatattaccataatgcaaacccattacaaagaaaagtatagaaaataatggagcagctgttgtaattaaaacaatagctgctttataagacattccttcatttcttccaggaacaatgtagtatccatcatagcccaaaccatatttttcatcaatccattctcttttatatataaccatactaaataaaaaagaaaacacactatttgccaataaaatcataataagttcattgaagctccatttaaacaataccttcattaaaccaaataataaacaaccaatcaataaactaccaaaaaaatataaattgaatatcctttgagttcatcattaggtattttgtcccaacgacgaaatgcaaatctaaaaatatttttcaaaataacactcctcattcatttttatgaattatcattaataatttcatgtacaaaacttggaaaaacgtcccatttagcaacatccttaattttttctataaactgcacatcatataaatttttcaaaattaagtctttaactccaaattgaataaatttcttttcaaaggttacgcaaacactttgaaaaataggtttacacacataataaacatccacttttttaatagcatatctaataatattttcacctaatttaatatctccaccaacaaaaggtaaacaccaagccataaccgaatcaaatacaaaaaaagcataatcaacagatgacgcatcatcatcaaacaaaccatctgcataagccaatatacattcaccaatacctgctatagctatagctaaacatgctaattcaggagaactcaatattacacctgcaaaaagcaatatcgcacctatagaaattatttcactacctacaaatcctattgctgtggatataataaaatcttcccaatcaaaaccaatactattaatttcattagtgatattattacttgtttctttaatctcatttattccttgtataactccattagtaaaattacccacagaatctaaatatttactctccaaagaactcatatttaataaattataaccatattcctcgcatcttcagttatattatcatgataacaaggcatagcacaaatcaaactatcagaaagcatagcatctcgaacaataccagtagctttatctaaaattaaaaacattcctttttgatcgtttttaaaaatcaaatatttatcattagctaaaatatcccatgaattgttatttaaaaaatcaacaatcatagataatgtaactgttccaatttcagtattattccatataaaagttccaaccatctgttcaataatgctgtaactaaaagaacatgcaaacctgaaattccaaatattagaatcatttccttgaactttcatgcccataccatgatcagattcaccagtaatatatacacttctataattattacacatagagaaaactactggagaaactctattccaagttacattataataattagcaaatttatccgctaacttatcatgttcataaattacaagtaaagctgataaaaatgaaccatatgctgccttcatttcacctgcagacaataattcaccataatctaaccaatattttaatttagaattagatacattcgaagtaacaaaagcaaaactacgcagtccctcataaccaatattcaaattattttcatcaattaaattatcataataaattaaactaattctatgaatagtattatctaaaaactttaagttatatttttctttttcatccccaaacattatatttggtgcatcatcaacactaattaaataatcaaaacactgaagcagttatcaaacaaaataaaatacatcaaaataatacttaaaatatcaaatttatccaaaacttaaaaaataataacccacaaaaatatattatattaattttgtttgtgtgaaaaaatggctattttaagtgataaaaccataaaagaatatctcgaagaaggcaaaattgtaattgatcctttgaaggatgaacagcaaatccaaccttcatcagtagatatgcgattgggtgatgagtttaaagtctttaaggtaattagaaaaccttatattgacccgaaagacgaagaagatattgcagaatacatggaatccagtacagttcctgaaggtgaagcatttataatccacccaaatgaatttgcactagctacaacacaggaatatgttaaagtacctgatgatttagtagctagagttgaaggccgttccagtatgggaagacttggtgttacaatgcatgttacagcaggatatgttgatcctggctttgaaggtagaataaccttagaaatatccaatatcggagccatgcctgttgcactctatcctggccaaagagtatgccagctagtatttgaaactatgactactcctgcagagttaccttatggtcatccgaaaagaaatagcaaatatatgaagcagttaaaacctgaatctagcagagttaaactagattatgaattaaaaaaataatggaagttaatacttatgaatcatgacaaaatgacaaatatcagtgcaaaaagaggatttttatggccatcctttgaaatatattccggagtttccggatttacagattatggacctcttggagccagcttgaagaataatataatgcagaaatggagaaaacaatatgtttctggagaagggttttatgaaatagaaggccctactgtaatgcctaaagaagttttaaaagcatcaggacatgttgacaactttacagatccaatgaccaaatgtgaagaatgcggagaagtatttagagcagaccacattattgaagaagttattggtgaagatgtagaaagcctggaaaatgaagagcttgaccagatagttattgacaatgccatcaaatgtccggaatgtggcggaaaactttccaatatctggaattacaatttaatgtttaaaaccatgattggagccaaaggtgacaaagtaggttatatgagacctgaaacagctcagggaatttttatattattcaaacgtcttgaaagattctttagaggaaaacttccgtttggagttgttcaacttggaaaagcatatagaaatgaaatttcacctaggcagggagttattcgtttaagggaattcacacaagcagaagctgaaatatttttaaatcctaaagacaaaagcacccctaaatttagccagatagctgatgaagttttacgcttaaattcccaggatgttcaaataaataacagcgaacctttagagattactgcccgtgaagcacttgacaaaggaattgtagctaatgaaatgttagtttatcagttatacttagccagaaaatttttaaatgaaattggtattcctaatgatgttttaagattcagacaacacttacctggagaaatggctcattatgctcttgactgctgggatgttgaagttaaaaccgacaaatatggctgggttgaaataatcggaattgctgacaggggagattatgacttaacatcacacagcaaatacagtaatgatgatttaaatgtatttattgaatatgatgaacctaaaacagtgaaaaaaacagttgtaaaacctaatttgtccaaattcggaccaatatttaaaggagattcccctaaggtaaaacaggcaattgaagaagctgatgtagatgaaatcaaacaggcaattgaaaatgatggaaaatatgtagttagcctggataaggattatgagctaacttccgatttactgcttttcgaagatgttgaagaagaaatctccggtgaaaaaatagttcctcatgttattgagccttcatttggtattgaccgtattgtttattctgttttattacattcatttaaagaaacagacacaaaagattactttaaatttgcaccttctgttgctcctgttcaagtgggaatttatcctcttgtaaacaaagaaggtcctcgtgaaatagctattgaaataaccgacaaattgagagaatcaggatttaaagttgaatatgatgtaagtggaacaattggtaaaagatatgccagagcagatgaaattggtattcctcttgcaataactgttgattttgacagcttagaagataataaagtaactgtaagaaacagagacagtgaagctcaggaaagaatagctattgatgaaataaaagattatttggaagaatattataaatgagtaaaaaatactcatttattaatcttatttttaaagttttcaaataaattttcaccccatttaatgcattcctcttttttagaagttattattctgttttggtcaaaatttccgtcttccttaaaaaggccaagaatcattactttatcagttacaaccaataagaaagcattttcaatattaaaagcagttaaatccacattgtcattttccagatttaagaaatattcaaagttctctttaatgtttttgggaattattaattcaatatggctgccctcatcaattaaatcatttatatatttattaaaatccccatagaaaaagggaagaacacattttaaactggaagcttcatttaacgcatgttgaattatattatatgttctataaacatccttttcattagattcaactaaaatagctctaccaagcagatataattgagctactgatttttcaggaatcaaatctacaatatgagcatccagaatattaaaaaacttattaaatagatttattgtatcctttaattccaaaatattagacacatatagttcagttgtatttgagatatgatacaaatttccgcttctataaataaatcctcccagttccagtccaaacatgttactggatattgagctgtaacttaatcctgtagttctattaatgtctttcatgttcaatggctgttcatataaagttgccaaaattttcaaccttactaaagagtttgttatatatttaatttcttcagatattgtttcatagttttccatgcattcttgattttcattcacaggtatcaccaaaaaagtattactggcaaaggtatttttaatactaaaaaaatataaaaactctcaaagtgagcagatgtgtaaaataacacataagaaaaatataaaaataataactctgaggcattaatttttttaagatagacaaccataatactaatcacaaaacagacattttataagaaagtgattgaaatgattgacacacatatgcatggagattcaagaagtagtgaagattttggcgaaatgtatttatctggaatagatactgcaataacttgtgctttctacccgtacaagctaaataatgaaagcacccttttaaatcatttagagagaattctcaactatgacaccaaaagagctaaaaaatatgggcttgatttaaaagtcgctttaggaattcaccctgcaaacacaagtgtaaatcccgatttaatatatgaaaacctctacaaatggattgaaaacaaacagataatagctattggagaaataggtcttgaagatttaacagatagtgaaatagccatctttaaaaaacagctagatattggtgaagaaactaaaacaaaagttattgttcacacaccacgtaaaaataaaaaagaagttttaaaagtaattcaggacattgtaccgcaacatattgacccgaaactagtcgttattgaccatataaatcaaaatgtagctgaagatgtaattgacaaagactacacattaggattaacagtacagcctcaaaaaatggacaaagaagaagcaatagctatattggatgaatacggatttgacaaattcctcttaaatagtgacatcagcaataaaccctcagatcctttgtccgttccaaaaacagtacgtgagcttgaaaaattaggatacaaaaaaacagaaatagagaaagtagcatttaaaaatgctgaaaaattctttaaaatataagaattttcctactttctaactaaactgactccttttggagctataataattaaatttttatcattgcagcgggaaagtaaaagtgcttctgcaccataattacttctcatttgtttaattttttcaccggcaagtttgaaattagccggactttctttttctaaaaaagataaatctaaaataacaggattgctttcttcaagaacttggtctacaacataattaatatcatcaatagttttcggccttatcagcattatttcatagaaagactgttccggagaaatagacacatcatcataatagctatggctacttaaatctgaagcattattatttgacattctaaagtcactagaaggggtacttggtcttctataattattttgctgtttattatgtaaagatgtatcttcttcaaaacctaaacttctttttaaagcatcagtgaaacccatttaaattactctcctaaataatcaaatatcgcatctaataattttgaagcaccattgttataaacatcctctacaggcaggttatatttgtgttcaaagtattcagcatctaaatccaattcagcatttttaagattaattgaaattcctacaacttttgtaggttcaacagcttcaatagctctaatttcttcttcaatgcctctaggttccctatatggatgatttggtctgtgtccaataataactgcatcaggagcagcaccaattaaaatagcggcagataaacctcttggatgaggatttcccttttcggttaaactggactgaccttcaatgaaaataatatccggttttttagtttcttcaacatatttaattgcagacaacactgctgcaggaacgtccatagctgataaacttcctgctctgaaattaaattctgtaggttcctcaagacccatttcatcagtagagataactgctgaagttaagcctctttgagtagctgcaattcccaatttcttggaagtggttcttttaccgcattcctgagaagttcctccaacaaagattactggagctttaggttcatatgagattttcggtaaaacttcacatgacttttcaggagctattccagctattttttcaacaacatctaacctaggacctatttctttgataattaaattttttgaatcagcaaatttttttaaagaaatattatcttcaatagataatgacctaaatgaagttataacatttaaaccagcatcaatagcctgaacagcatatttaatagcagatccttcagcaccaataggcaacataataacaagggaatttgcagaagttccgcttaaacattcttccaaactaccagaaacagtttgaccgcaaaactgagttccctgtttattaacatcatcatctataaatccaactgcctcaataccttcaagattggagaatttttcaccgcctccaccacaaccaacaacgatgaatggattcaaatcttgaagttctttaacagaatttactgaatacaaaaatatcactcctataacttataatttataacaactgtgtaacaaaataatcttaattttttataaaaactttattaaaaaaaaggttttcaaaaaattataatctatttattaaatattagttttcttattattaaaagataatgtttttataaataaaatatgataattattatataactatcaaaaaagattaggagactaccaacatgagaaaaccttatgttatattaattggaagtgcctctggaattggtaaatcaacaatagctgcagaattagctaaacaattaaacataaaacatttaatagaaagtgattttatacgtgctgtagttaggggaattattgggaaggaatatgctcctgcacttcacaattcatcttatgaagcatataaaagcttaagaaacaagtcaaaatatgataactatgatgagttggtatcagcaggatttgacgaacatgcatcttatgttatccctgctttagaaaaagtaattcaaagggcaattacagattatgatgacatcataattgaaggagtgcatttggttccgggattaattgatattgaacaattctacgaagatgcgaatatttatttcttcatattatcatcagatgaagaagcacataaagaaagatttgttaaaagagcaattcaaatacacagaggtggaaaacagctagaattctttacagaaaacagaataatccacaaccacctgatatcacaggctgaaaaatttaatgcaacaatagtgaaaactgaaaatattaacaatacattatccaaactgcttaaaacaataaaacaaacttgtaaaaccgtgtgcttaacaaacagcgttgatgaattagaagaagtggttgacatcatcataaaacaaaataacagcagcataacaaaaattgtatacaaactaggaggatttaaagattccctagttaaaaccaccaatatttcagattccgatgaagcaaccaaatttattaaaagtataaatgaaaacaaagataaaaaagaagatttaaataaattatacgctctgtcaaaatacagaaaatttaccatctgtgcacctgatgatgacagtttaaataatataattgaagaattaacaaaaagaggatttgtttataatgaatgaaacagaaattaacgaaatgagtattaaatgtcctgcatgtaacactgaaaacacagccaaatccataatgaaagaaattgaaataccgcattttggaaaggttttagaaacaactatcatttgtgaatcctgcggatttaaacacagcgacattatagcacttgaacagaatgaccctgcaaaatatattttaaaaataaataaagataatttatccaccagaattgtcagatcacagtcagcaactgtgtccattccagaaattggtgttaaagtggaaccaggtccaaaatcagaaggatatgtaactaatgttgaaggtgtaatcacccgatttgaagatgcagtaaaacaggcacttcatttatttaatgacaatacttctcaaaaaaatgcacagctagttttaaatgatttgaaaagtatagtaaatggagaaaaaacagctactttaatcattgaagatccattcggtcaaagtaatgttgtaagtgatgatgttgaaatattagatattcctgaagaggaattaaaattattaaaaacaggtttcagtattattgaagataattaaaaaggaagaatttattcttcttcctctgtttcttcatcatcatgtgctaaaaagctgcttaaatcatcttcttcagcaacatcttttaattttaaagttctttgaacatccatagctaatgcattacagtctgctttaatagcttctaaatgtaataaaattctttctttttcttgattaatccttgtaatgttggtgtatgggtaagtagattccttaagcatttcatactcaatagtagtataaggataatcgtttaattgtttacatacgtttttaagaacttcacctaagaatttgttcatttctacttttactctttccctaatcattttgtcgtcatcaagattttctttcattaaacgaacaacttctgctttagcgaaaggtaatttttcttcatcttcttctataaattcttcggttgtttcttcaatcatttcttcatcagacataatttcacatcataatgtttaatattgagtaaaaatagtaatttttgataaaaaattatcaatacatcaatatctaaagatatatttgttaaaagtcctatttaaaagtattgataatttaagaattatgaattatctttttaatacttttattaaaaaacattaaaataattgatgcaaaaatcaataattcctatagtttaaaatttttaaaaaatccttttaaaaaaataaaaaatagtagccgaatagctactttaaattatcttttctttgaaattttaataggtaaaaatccgattgatatcattgaaactaaaagcagcagcacaatcggcaaacctgtttttggcaattcaatacttgttaaagactgcgaatgtgtcaaattttctaattttgaaaccatagacttttgaagtgaatttttagccaatactaaaagataagtatcatttacaggatcttctattttttctgttgtgttttcacttacaaaaacacttgttccgtcctgattattggatttgtcataatcaaaagtatcagatgaaacagcaactttattttcaaatttaccccaggcgtttgcagcagcattaatagtcagcctgactttttcaccattcactaatgaatcaatagttaaaacattgtttgtattattgaaattgcctttggtgctttcaaatgaaattacttttaaattagggtttaataattcacttaccttaatattttcagcactgtcaggaccgttatttgtaatttcaattacatattcaattaaatcattgatgttaacttcctgttttgatactgatttttcaatagacaaatctgcagccggtttaacatgaactgattttttaaaatggttgttagttaaattactgtctttttcattgcctttgacattaacaacatttgtaatgtctcctgtttttacaattttagatacaatattcaattgcagcttttcaccggcatttaaattaccgacatcccatatgccatttaccggattataaaaacctttagacagataagatgaaatatattcaacagactttggaagcaaatcattaactataactccagtagccatattcggcccattatttgaaacgattattgtccatttaatcaaatcattataattgggatttgaattgttgattaatttaataactgacaaatcagctattttaactgcattaaccgattcattatcatgattatttgattcattccaatcatattgtgtggaattgacactgacaaagtttagaatttttccgattttattaactttacaataaatatttaaagtttcatcagtttcaggtgctaatgagtcaatcgtccatatacccgatttaacatcataatttccttttgttgagctagactttacaaatatcagcccgtcatccaataaatcattaacctgaacatttgtagctatgtcaggaccgttatttgaaacaacaactgaccatttaattatttcaccaaaatccggagaagtattgtttacatactttttaacaaaaagatcagcactttgagcaacctcaatacttttatttacaatattattagtcaaattacaatcatattcatttcctgcaatatcagcaatattgacaagttttcctgttttattaactaaacagattattgttaattcttttgtttgattattaatcaatttgccaacattccatcttccattaaatgatttatcaatactgattaatccttcaggcaaaatatcacaaacaacaacgcctgttgcagtatcaggaccattattagtaactcttaaagtccattcaaccaatgaattaaatttaggattagtatcattgactaatttttcaatagctaagtcagcacatacctcaacatcaatggactgattatcatagttattggttaaattccaatcatattcctttccagacacagaagcgtcatttgctatttttcctgttttattaaccaaagtcacaatatctatagaaacggatttgcccctttccaaagttccaatattccacaatcctgattttacatcataatttccggtgcttgaaagataaatcaaatctttagaaagcaaatcacaaacaacaacaccagtagcttcatccggcccattattagtaactctcaaagtccatttaactaaagagttaaatttaggattggtatcattaaccaatatttcaacagccaaatctgctgatggattaacattaatgcctgctgaatcattattgttttttaaatcccagtcatattcatttccggatacactggcttcatttataaaagttccggtcttattaactaaagtttttatattaattattttggattcacccatgttaagagaatcaatatttaaaatacctgtttttttgttatagttttcatcatcacagcttaaaataattaaaccatcaggaattaagtcttttaatctgattccagtaccaacattaggaccattatttgtaatttttaatgtccatattattatatcaccataattggcattaatcaagttggaacttttatttagttgaagatctgctttaggaaaaacactaaaataagtaacatttgcaatatatttgtagtaagtgtcctcgaaatgagttgcactaatcctatatctgcccggttttaaattttttaagatatttgaaacctgccctttaaaatcagattttaaagttttattaaatgctacagacccgtcttcatgagttacagttaataaaatatccatattgtattctctgctatcctgatataattttccattatctacagctcccaaaataggagtttcaccatttactttaattttatcttgttttgcattattataaattgcatttgaaacaaacaaatcatcatatttagctatattatttccaccaaatagagtagctgaaacttcacaatcttcaccataataaatgcttttagcataaataggcaatgcataaacccatgcctgattttctgccattgcattatctgaaataatacagttcaaaccggatttgtcatagtaaatagcacttccatttctcgccacattgttattgaatatgtttttattaatggtagctgaagaactgtttatataaatagctccacctaacccgtcatctaattttttaacatcgggaattgcctcattagccataaatgaagaatcttcaatgactgttttatttccattaatataaatcgcaccaccgtttacatgggctgtgtttttattgaactcagtaccaccaatagcgactgttttagctacaatatttattgcccctccatttactgttgcggtatttttattgaatacggaattttggatttcaatatttttaccttttaattgcacagcacctccataaggagcattattctgctcaaagttacaattgattacttttaaatccatgtccatgtccatataacctgtacttaatgctcccccataaagttttgcagagttgtttatgaatacacagtcctcaataatgcctgatgcatgataagttaaggctcctccctgatctgcagaattattaataaatttacaattttgataggttattccggctctaacacatccagcaccaccatgagaattatttaaatcatgcgcaatagcttcattacccataaaattacaatttacaacatatgaacaaagattatattcatcacgaccaatctgaattgcaccaccatatgatttatggttagtggccggtttgactttattagacacaaaattacagccaataacctgagtattatttccataaacaccaatagctccggcagctacctgtgcaaagttatttgtaaaattacagttttttataattaaattttctccttcttcaggatatctgccactatcattaaaaattgaaaggacataaattgctcctcctgaatggttagcataattattttcaaaaactgaattttcaacaactacatttttaccaagaataatcattgcacctccgtgaacatccatcccatttacaaattttaaattacttatctgacaatttgaacctgttttttgaattgaaaaaatacaggaaatattttttccgtctaaaacagtatccaaaccacctgcaattctgatatttttatttacataaataacagaatcattgttttgggcactataatacccatttaaatgaattgttccaccatcacctacattatcaattgctttttgaatatcactgaatttacccccatttaaagttatttcactacttcctacaacgtcattttgagaattttccaaattatctttgcatacacttacttccggaacttccgaagtttcatttaaatcagcactaaaagctgtacctgaagctgctaaaaataaaatcattaaaagcacagaaataagaaaatgcttctgtttgtttttaaacattataaatctcctattttgaggacatttttaaccaccatcaattaacctgaatcagctattaattagcaattaaactttttattttagcatagaacttgaaaataacactttttaaatataaaatttgaaaataaaccgaaaattaatatttaactattagtttagttaactaaaaccaaatattttaaaaacaaatacccagccataatttacaaatttatttcaatctgatattacaaatgttatttttcaaaataactgcaatatagaatttaaaataaaagataactgttttaaatcctcaaaaatcttattaaacttcaaattatttaaattttttctaataaagaaataaaaattaataaaatcaaaaaataatccatttaaacaataattcaatattgtgccatgaaaaaattattatagcataaaaattgaaataaaaatatgaaaaaacaaattgcaattatcatactggctattttattattagccagtgtaattcaggatatatctgcagccactactgtttttctaacgtcagacaacataatgggcacaaatgatgatgcagatatgcttaattccataaaaacctatattgaagaaatcagcaatggaaaaatcaacgtaattgtagacagccaatctccaggacctggagaaggaacaagagctattgaagctgattcaaatgttagtgtagtgtttgctgctgtagatccaggcaatttcttagttttaagcaaatattcaacagccaccacagacaaacagataatctttgtaaatactggagattatgatttagatactgctgaatccttaagaagagcatgggacgataactactcaaaaacaatttttgcaggaatcaataaccccggaacatttcttaatgatggtggaattagctatatccagccattgaaagaatatcatgatgcaggttctgacggcattataaatcaaaataatgatgatgtaaacaaatatattgcccaagaaattgttaataatataaataactacaacaacaccaaacattatgacaataatttagtaataactcataaattagctccttcaaatatggctcatggcagtcaaagccttttagaaagcaacgacaatgaaatgaatggaacttacaactcttattcagctccacaactgttatacttaaccagctcttatttaaatggaaacggattagaaaatcccggagattataaagctccagattctccattgaaatactccattttaactaaagattcctattcaatttatgattatataaaaatgggtggaattgttaaaaattatatggatgaaaacggacaggctccaaattacataaattacgagggtgcatatattagttattacgatttacagtacaattttgctaaaataactgcaaatcatactgacggatcacatatggattttgatagagaatatcattttgataaagttaatgacagtattttattaactatattgccaattgtattgattattttagttattatgtttatttatatgatttttaaaagactattgcacagataaggttaaattaaccttttttatttttttattttaaaatcaataatgttgtaagcatcaattattgttattgcaattgttgtcacaccaactgttttatatactataataaatatatattaaaactgtaaattttcaaaaataaaatttataaaaatgatttttatgaaatgtgacgtaaacttgtttaaaaacgacgatattaaatttattacatttatttccataatacacagacaatatatgatatatttaaataattatcttaaaaaagaaggaataaccgcatcacatgcacctatacttagctatttattatacaaagacatatcctatcaagaagaaattggaaatcattttaaaatagataaaggaagtatagctagatcaatacaaaaactacaagaaaaacaatttattaacaaggaaatagatgaaaataacagaagaaaataccaattgtctttaactgaaaaaggcagaacagttgctttaaaaatcatggatttaaataatgaatgggaaaaccaaatatattcaacctgtaatactgatgaaaagcagatagttgaactaatgaggaaaataaccatatcatcaataaacattcaaaaaaacacacaaaaggaggaaaaaaatggctgatatgaccaaaggaaaacatgcaaatattgaattaataactggagaccctaaaaaagctattaataaattagcttggcctatgatgctatcaatgcttcttataatgctttataatttagcagatagtgtatgggtatcaggacttggagcagatgctctagcagcactaggttttataacaccactatttatgattattatcggacttggaaacggaataggtgccggtgcaaactcattaatcgcaagagcatttggggctaaaaaagacgaattagcaaataatgctgcactgcactctgttgtattaactgtaatcataggaattgtaataccaatcatattacttccgttaatacctgaaatagttgtaattatgggtggagccagcgttacagaattatgtatggattacagtaaagttacatttggattattgattgtatttttattctcatcagtactttcatcaatattaaggtcagaaggagatgtaaacagagctacaatcgcaatagctattactgcagtattaaatataatcatagatccgatttttatatattatttaaatatggggatagctggggctgcatgggcaaccgtaatctctgcaggaatttcatgtattgtaatggcttactggatatgggttaaaaaagacacctacatgaatttaagctttgatcaattcaaaaaaagcaaaggaatcgtaattgaaattatgaaagtagctataccttccactgcagagcaattaattatgtccggacttacaatggcaataaatgcaatgcttgttatagtttcaacaacaactgcagtagcagtatatactgcaagtatgagaattgtatcaatggcaatgattccattaatgggaatagctactgcacttttaacagtagcaggagcggcatacggtgcccgtaactatgaaaaattaaaaaccagtttcacatacagtatcaaatttggattagttatttcattgattttaggagctctaacatttatctttgcaccacaaatcgcattgctgttctcatattctgcagcaacagcatatcttacacctcaaattgcatttgcacttagaatattctgtttcttcttaatattcgtaccgttcggtattgcaggatcatttgtattccaaggagttggaaaaggaacatcttcattactaataactatcataaggtcattatttgctgaagtagtccttgcatacttgtttggaatagtgttaggttacggagaaatgggtatttttgcaggagtaattattggaagctttatcggttccatgtttggttacagctgggcaagattattcattaaaaaacttaaaattaaatttggtcatgccgactaaatttaattctttttcttattttttattttaataaaaataaaatatagctatttttaaagcaaaaacccacaaacttatatgaaaactaaaaatcaatttttctttttacagcaaataataatttaaaatttaaataatatcatccaaataaataatagttaaggtgaatatatgaagatagttgtagcaattggaggatcaattttattaaaagaatatgactgtaaaaaattccaggaatatagtgaaatattaaaatcattagctagcgaacatgaaatattcgttgttgtaggtggaggaaaacctgctagagaatatattggagttgttcgtgaacttggagctggtgaagctcagtgcgatgatattggaattgaagttacaagaattaatgctaaattgttattatctgcacttggagatgctgcttatcagaaagtacctcataacttccaggaagctttggaatattcagctaccggaaaaataattgtaatgggtggaacagaacctgcacacagtacagatgcagtttccgctattttagcagaatacatccatgcagataaacttattaacctaacctctgttgacggaatgtatgataaagatccgaacaagtacgaagatgctaagttaattaaagaaattacagctagtgaaatgatagaattcatcagcggaaaagacaccaaagccggaacctatgaattctttgatatgactgcaattcaaatgattaaaagatcatctcttgaaactgtaatagctaacggttatgattctgaaaacttaattaaagctattaatggtgaggaagtaggaaccaaagttatcagcaaataaataggtgattaagtggaaaatcttattgatattggccttaatttaatgcatccttcttttagaaaaaatagagaaagtataattgaagatgccattgatgaaggtgtttccaaatttataattacaggaaccaatgtcaaagcaagtcagatagcttgtgaatatgcatccaattatccgggaactttatattcaacttccggtgttcatcctcatgatgcaaaaacatgtgatgacaatactcttttggaactggaaaaaatagctgaaaatgattgtgttatagctattggagaatgcggtcttgattataaccgtgatttttctccaagagatgttcaaagaaaatggtttgaaaaacaggtcgaattagctgaaaatttagatatgcctttatttttacatgaaagagaggctcacaaagatttatatgatattttaaaaaagcatgaagatgtttgtgaaaaatcagtagttcactgttttacaggaaccaagcaggaagctcaaaattatattgatttgggatgctgcattggtgttaccggatggatttgtgatatggaaagaggcagtgacctgcaggatgcagtaagtataattccaaccaacaaattaatgatagaaacagatgctccatttttaatacctaaaaactttgataaaaaacctaaaagtaataaaaatgaacccaaatatttacctcatatcctaaaaacaattgctcattataaaaacgattatgatgtagaaaaacttgcaaaagaagttacaaaaactactaaagacttttttaaaatataaaaatatggtgataatatggctgtagaaccacataaacattgtccaatttgcggaacccctatacctttaaatgaacttgtatgctctccagactgtcaaaaagtttgggatcaaagacttaatcaacaaaagaaaagcagatatatgttaactggagttatcattcttttcttagctatttgggcagtaatgactttcatgaaataagtgatgaaaatgatattgacatctgcaaacacactggaaaataaggaaattgttgaatataaaggtttagtaaccggagaatccttaatcggtgctaacatttataaagatttattttccggtgttcgggatgttgtaggcggaagaacctcaagatatgaagaagaaatccaaaaagcacgtgatattgcactgaacagtatggaagaaaaagcagaatatttaggtgcaaatgctattatcggattgaaaatttcttacgataacttaggcggtactatgggaaatacaattcttgtaacagcttacggtactgctataaaatacgaataatatgaatcttaaagaaagaatagaaaatgtggaaaacttaaaagaagctattatctgcatttcttttggaacatttgttggtattttaacttattatatttttttatacttccatattgatatttatggatggaattttggacttatttttgctccattagctgcaggatatgctgaaaccatattggctaaacgaataattggcgaagatattggagccatcagcgcatttattttatttcttgtaactgtagtttacggttttattatagccaatcctacacttggagtaaatgtaatcactttcggatcaataattgtaattttacaggcagctcttcccacacttattaactatttctttttagttgttataattggaataatctcctatttctttgggacatttaaaaaaattacagattatacctattccaaattatctgacatgtattataaaataacaggaaagcaaaaacccataagaactattgatgcggaagttgttgaaaatgaactggaaagcaataaacaaataaatgatttggattttatattcataaccagctcacatccaatcaataaaaaaatagaaatcatagaccactttcatgcaacagtatttttggaaagagataaaaaactaatccacattgaccctgaaaaatatgaaaaagacactttaaaaatgcttaaaaaagctaaagacagtgtcctaatccaaatagctaatgaaattaaagctcatggaggaaatggaatcctggatttaaaaatagaatatgggttaatcggtttaggtggagacagttttcaaattactgcaatgggaatgggagttaaatttaaagattaaggaactactcccagcattttaagtgaaatatacaaaaccaccaaaccaaatatctgttttaatcttttttcaggaaccttatgagctatttttgcaccataataagctaaaggtactgaaaacattgcgataactgcaaaattaactaaacttacataacccaatgaatacggaaacggattaactccccagccagatattatatatgatacggtccctccaatagctgttaggctaataaatactgatgaaattccgatagcttcaatcattgaaaatccgaatattacagttaaaattagaattataaatactcctccaccaacacctaaaagacctgaggaaattccaaccaatacccctacaacagctatgtttattaaattaaatttggctctagcttttgaagtctttttatcggcagacatcaagttacgaatagctataaacaacaataaacatccaaatatgatttttaatatttgtgtcggcagcattgatgcaatcagaccgcccaatatgcccccaacaataccgaataaccccagtcttattcctggttttaaaatattgtccataacttttaaatgcctggatgcaccgcttgttgctgtcggaataataatggccagactggttccaagagatatcatcatggcaagtgacgggtcaactccaagatactccaacaggaaatactggaatggaacaattaaaaatccccctccaacacctaaaagacctgatgcaaatcctgcaacaacaccaattaaaattaaaccaatgaaatattctaatgtaaatatcataaaaacacatattcagtaaatcttttaaatcattaaaaacttaaattaattttaatgaaaaggaataatattatattggccggattcatatttatattatttgcaggtgtactttttataacagacatcttcaatccaataataaggccaataactcgagtatttctaatgggttcttctaaaggaaaagatattttattttttggactttttggactgtttttaattttaagtcaaacatttaccctgaaaaataaagatattgactctgacaaatacttaaaaatagctatctgtgtaggatgtcttttgctaatttcaggaattattgccgaaatcctgtttagacagtctttaggaattccattaaatgtgacttttatgagtgaaagttcacaggctgcaagtaccagtattttacatacccatctgctgaaatccatttttggagaagctgtaacctccctgatcggaccgtttatcagtagcggaatcaatacaggagttggattatacacctatgttccgaatattgctaaaacagcaatcatattattccctattttatttatattggaaatattggccaatcaaaaacgtttagctccaacagcaatccttttaagtttcttttcaacctgtttacttattggagcattagatggaggaatgttttccacaccttccatgttaggtatttgcggactttttttagtttacagaaaccattattatttcgattattatatcggaggagttgttttaaaaaataagaaaatattaaatgattccaaaaaagaatatccctactacaaggatgcagggttaagtgaagtgaaattccatctccacagactactgccctacattatagctattctttttataactttaagaatttcaatagctatttttggagcaaatgatgaatattacacacttgaagtcgtaaatcctgcagacaatattgaactaaatgattttccagtagaaagtattcatcatagtgaaaacaaaacagtttatacacttgattccaattataatgaattgaatttaatcaaggatttgaaaatacctctaaacaataaatgtgactactacacgatttcatggaacatttactcatatatttaataaaaacttataagttttaaaaattaatattaacatatgattttaagcattattatacctacatataatgaagaagaataccttcccttacttctagaaagtattaaacagcaggatttcagagactatgaaataattgttgctgatgctaactctaaagacaatactgtaaaaatagctgaagaatacggatgtattgttgttgaaggcggaatgcctgcagtaggtagaaataatggtgcgaaagtagctaaaggtgagtatttactatttttagactctgatttaaaacttaccgaagattatcttgcaaaagttatctatgaatttaaaatggaaagattgggtattgcaattacacaaatgaaacccctatccaaaaaaacagaagataaaatcttacatgatttggccaatttgtttatgataagcgttgaaaaaataaagccacacggtgccggatgttatggtataataactaaaagggaattgcatgaatgctgcggcggatttgatgaagaattaactttcggtgaagatacagaatatattgaaagattggccaaaaaagaaagatttaaagtattgagaaatgctaaaattggagtttccacaagaaggcttgaagaggaaggacttgcaacactagctaagcaatacggtaaaagtactgtaaatgactttttaggcattagaacagaagcttcagatttaaattatggttttgatcatggaaaagaacatataagcaaacataaattagataaaattgctctggaatctgaaaaattggaccatttgaaaaacagctatgatgaatccaaacaaaaaataaacactgcaaaagtctatcttaaaaaatccaaaaaaacaaaaatcagagataaaaaagtaattttttattgtatctgtggagagggaatgggtcatgctatccgaagcagcgtaataatcgaccgtataaaagacaaatatgacgtttacattttcagcagcgaccgtgcttacaaatatttaaatgaaaaatttgacaatgtctataaaatcggcggattcaacacagtttatataaataacaaagtcagcaatacaaaaacattaatgaatgccattaaacgtaatcctctaaacattaaagaaggatatgaagaactatataaaaaagcaagaaaattatctcctgacgttattgttactgattttgaaatctatgcaacaatggtttccaaacttctcagcattccattaataagtctggacaatatccacatgattacccaaactgcaattgactatcctccaaagcatcagggagaaatgctaaaagcaaaaggtgtaataaagtcatatgtaataaaaccgaaaatacatattttaaccagcttcttttatccgaaaatcaagcctaaaaaaagggcggtgctctatcctccagtgattcgtgaagatatcttaaagctggaacctacaattgaagatcacattattgtctatcagaccagtaaagaaagtgtgaaattagtcgagcaattgaaatcattaaatgaaaaatttattgtttacggatttaataaggacaaaacagacgaaaatctgacttacaaattatttaatgaagatgagttctacaatgatttagccagtgccaaggcagtaatctgtaatggtggatttacctttatatcagaagccatatcccttaaaaaaccaatatacagcgttccagctattggaaactttgaacaaacattaaacggattttatgttcagaaattaggttatggagaatatcatgaaaagatgagtcctcaagaagtggaaaaattcttaaaaaggctctccaaatatcagaaaaaactagctaaagttaaaaaaacaaataacgatggaattgtcaatgaattaatatatcgtattgaaaaatatagtaaaaaaagttaaaatagggtggtttataaagttacacccatttcaagttgttctgttaattctttatacctgtttcttatagttacttcagtaacacctgcaatatctgctacatctctttgggtttttctctcacccaacaatacagatgcaatatataatgcagctgcagctacaccagttggtcctctaccagaagtcaaacctttttccattgctttttcaataatttcaatagctctggattgtgcttcaccagacaaacctaattcactagcaaatctaggcacataatcgaccggagaagttggaggtaatttaatgtttaattcccttgtaaggaatctgtaagtcctacctacttcttttttagtaactcttgaaacttcagctatttcatctaaagtacggggaacattacaacgtctgcaagcagcatataaagaagcagcaactactccttcaatactccttccacgaataagtttgttgtccactgcacttctgtatactacagatgcagcttccctcacacttcttggaagacctaatcttgaagaatctctgtccagctcacttaatgcaaatgccaagttacgttctgtagcaccagaaatcctaatttttctttgccatttccttaatctataccattgtgctctgtttcttgcaggaatatcacgaccataaatgtccttattcctccagtcaatcatagtacttaaacctttatcgtgaatggtgtaagtgattggagctccaaccctagtacgtttatctctttgttcgtggtcaaatgccctccattcaggacccatatccactagattttcatcaataactaatccacagtgagcacaaactacttctgccctttcataatcaccaattaattctgtggaaccacattccggacatacggtttgtttatctttatcataaacatcaccttgcataatttctttttctgttcttttatgtccgacctttttagggatttcgtttactttttgtttcgtgttttcaccctcctcttcctaggtttcttagattttggtcttgatacaaatagtttttcaccatagtttctcttgattttatctaaattagcagatttaaataatttaattgaaacatacggacttttagtaggtccaaaaacatagctaaccttgcctattttagttttatcgctattaaaaacaataccaccaggactaggtgttttagatgatctagctattaattttccagaatttgcaatatgcaaactatttcctaaaactttcataaaaaatcaatcataaaataatctgtatcaactattaatatgcatgtgataatatataaatgtatcgatatatttatatatcaataaaatttgctatttaaatgttttactatttaattgtcctaaacactattttaacccagcagcctgagacaaagttttaccaccattaatagcatcaatgatacctaattcctttactttaatagctaatgtttgagtcatgacctgtttaaacaaagactgaggaataataacaacgccggtttcatcaccatagaaaaagtcacctggttgaatagtcatatccccaacagaaatatccacattgatttctcccaatcctaaagcacttcctgcatttggagcataatcacaagcaaaaataggataatccatataatacagagcatccaaatctctgacagacccataaattacagtagctttaacaccattagctttagcacaggttgaagctaattcaccccatacagacatgtcagaattattggttttaataaataatatatctccatcattagcttcatcaatagctaatgcggaagttccccaatcatcactgttggttttgcaggtagtaattctaccccaaacccttaatctgttaataggtttcaattctttgataacacctgatcttcttgaaattccgttatatgcatcggaaatttggcaggtggaaacaccttcaagtaaagacttcaagttaatataatttttatagttttttttattgaaaaccaaatcttcaatggatatttcacttaaatctatatcttccacatcaattttcttatttaagtcttttttattgtgtaataaatcactaggtgttactgacattaaatcacttctcttaattaatatatagatatatgtaagaaccgcttaaaaaagatttttcaaaaattttgacataactaactaattatatatattagtattttcaaaatacttaatgaagtataaaaaaatactcacaattatacttaaagagtttatttacattcattattacaatttaattattattcaatttaaaaacaaaacaggagcaattaatattactaactaaatataatcttaaaaaataaagaaaaatagctaatatgttctatataggctataaatgaaattagtaatatgctcagtagattttaactctttttagtgtataaaagatatcttaactaaaagatattagatatgtttatcaagattatttcttaaaatacccaatttttagaaagataagaaaataagccaataaaaataaaaaggaggcttaacaatgggaaaaggagaagaattaactacaacaaaatacttaattcatgcacaaattaatgcaaatggtattgtagaaaaaccagatgtagtcggtgcagtatttggacaaacagaaggattattaagtaatgatttagatttaagagaacttcaaagaactggaagaatcggcaggattcaggtaatgatccattccaatggtggaagagctaaaggagaaattgtaattccatccagcttagacagagttgaaaccgccattcttgcagcatcacttgaaacaattaaccgtgttggaccctgtgaagcagaaattcacacagttaaagttgaagatgtaagagcagttaaaagagaacaggttgtaaaccgtgcaaaggaaatctacaaaaacatgattgaaagtgccagccctgcaagtatgagaatgattgaagaagtaagagaagcaatgcgtgttcatgaaatttcagaatatggtgaagacagattgccagcaggtccaagcatacacacttccgatgcaattattgtggtagaaggtcgtagcgatgtattgaacttacttaaatacggcatcaaaaatactgtggctgttgaaggagtcagtgttccacaatccataggaaacctaagtaaaaaaagaacaacaactgcatttgtagatggagaccgtggtggagaacttattttaaaagaactcctgcaaatcggagatgttgactatattacacgtgctcctaaaggtaaagaagttgaagaccttgaaaaagatgaagtattggttgccctaagggacaaagttcctacagcacaatttttagctaatcacaatatattaagtgaatctgacagcaaaaactcccataaaaaacataacggcaaacacaacaacaaacattcaaataacaaacatcaacaacacgaaactaaagtcaaagaagaagtgcaaattgaagaaattcctattgaagatgacgaaacaaaattaatgaaagacatgttaaaagaatttgaaggcagcggctgtggagctatactggacgaagctttaaacatgactcaggaagtggaagttgaaaacatttatgaagaaattaaaaatatagaaacaagtgcagacacagttatttttgatggaatcataagtcagagacttgttgatgttgcttcattaaaaggaattaaaagattagttgcatttagatccatgaacatagttaaaaaaccggataacttaaaaataataaccatggattaataaggtgtcctaatggaaacatatgattttaaaaatgagattatagacaaaaacgggaataaaataaatattctcgacgtttataattttaataaaataaaagaaagttacataacttctttaaagaacaacaactattcacaaaacaccatcaaaacctattcatcaataatacataaatttactacttatctaaaaaatcaaatagctatttataatgaaaaagagttcataaaatacttcaatagctatatactctatttaaaacaagtgaaaaatgttagtcaaaattacatttacctggttacggtagttgtcaagaagtttcttgagtttaacaatattcatttcttagattcaattacaacaccaaaaagaattaaatcaccacctaattttttaacacaaaaagaagtaaaacaacttctggacagcattacatgggatgaaaattcagatagtgattttcgcatcattaccaaactacgggacaaactgatagtgaccctattatattcatcaggactgcgtgtttctgaacttataaacttaagtgtagacaatgtaaattttgaaggaaaacagttatccattgtaggcaaaaacaacagcagagttattttacttgatgaatcaaccaaacagttaatacaaaaatatttggaaaaaagaacacagaaaagcaattatctggtagttaacaaaagcggaaatccattaactccacgatatgttcagctaatgataaaaaaatacggaaatgaaagcggcatcgaaaagaaaataacacctcacattttacgccattcctatgcaacacatctatttgaacagggagtgaatatcaagataattcagcaactgcttggacacagcaatttgtccacaacccaaatttacagtcaggacgccaataattaactcttttttgcaatgtgcttgtacaaaaaattaaatagtaaaaatgataaacatattaaagtatgatgatttaaaaatcaaggaggaatactatgaatatgaataattattatactgctagaaaaaacatattccaaggaatacgcgaatctagcactgtcgctaaaatattaatgtcatttttaatggcttgttttacaggtttaatggctcaaattatcattccactcccatggactcctgtgccaataactgcacaaacatttgcagtgttatgctccgggttaatactcggtaaaagatacggctgtttaagtcaaattttatatgttgctcttggtgcaacttgcgtaccatggtttgctagtatgagtggtggaatagatgttcttcttggatccaattgcggatactttataggatttattcttgcatcctactttatcggtactataactgacaaatatgcagatgcacgtaacttcactaaaatggcagcagttattggagtagctaactttgcaataatttacattccaggacttgtcggattagctttatgggcttacatgagccaaggtgcaatgctttcaatctctgaattattaattatgggattcattccatttattgttggagatattgtaaaaatattaggtgcagcatctgtttctaaagtatttttaccaaaagaataaataaggttttttaaccttttctttttttatttactgatattatgaaaattaaattaagaggacatcacttgttatgtcttcagggatttcagggttatggatacaacgacagttttgttaaaaatatgacatatataaataacctgagaaaatctgaaaatacaactattaccattacaaataaagctgatgatatctgcagatgctgtccaaatttaaaaaatgacctttgcggaaatgaaaaacagaacgcagaaatcataaagatggataatgaaatcctatccaaaatagataatagtaaagaatatgatgcattaaagctatttaatgaaactaaacatatttttaacagcaaaaatagtgtcaaagatatatgtgaagactgctgttggcatgaaaaatgtctattttataaaaatttaaaataaaccgatatatttatatactacttatcaaataaatatagaatgttgtactactggtacaaacaaaatatagtcccgtagggtagtggtaatccttctaggctttggacccggagacggcggttcgactccgctcgggactatttttaaaaaaaactttttttgcttgatattttatggaaaaattacttcttattggaataaatactcgaagtatgattgaaagcggactaaaactaaattatactatttattcaactagctatttttcaacatccgatgttccgtcaattgaaaaccagaaaataatattggatgaaagtattaatcctgactgcggtgtttttgaagataaattcagcagcaaaaatattttaaatgtttccaaagactatcttgatgaggtagattatattattccgatttcaggaatttcaccaaatgattttgaaaaaaaacatcaaaaaaagattctgggaaataaagacatcagcaaagttgaagacaaataccgattttataaagaaatccgaaacgaatttttaactcctgaaactttttatgtgaatgatgtagatgaagctgttgaaattcaaaaaaataatcctgaagttcaatatattgcaaaaccacttaaaggatcaggaggatataacacaaacttattaaataatcaatcacaacttcaattaaactgtgatgaaaaactgattgttcaggaatatattgaaggtataaatttaagttcttcagtattgggcagtgaaaatgaagctgaaaacattgtaaattcaagactgctaacccagcatgactttgaaaaaaacagccagttcaaatatgttggaaatatccttcccctaaccgaaaaatcaatattggcacctgtaaaaaatactgatgcaataaacagagaaatggcagatacttctgaaaaactaatcggaaaatttgaattaatcggatcaaatggtgtagattttattttaaataaaaacggattatatgtaattgaaataaatcccagaattcagggaacatttgaatgtgtccagcaagctttaggaatcaatatgcttgaagcacatatcaaagcctgccaaaatgaaataatatctattgacaaagcgaaatattacagctataaaaaaataatatactcccccaaaacagtaaagtatgaaaaaatagatttaaacaacctttatgatatgcctcatctcggatcaattacacaaaaagatgagccgttacttacaataatagataaagataaagattttgataagttatatgaaaaagtagaatcatctagccaaactgtaaataagctagttaataactcctaataagtataaaataaatataattgtacctatagttatcataaacgttactattatcatagatctagttaaccagataaataatttcgccttattgtcagggtcctttaaaaattggtctatagggttacgttgcataaatacacctctttctagaattttccagtaattaaaaatttttacaataactactaaaaataactttttttaaataaataaagcctaacaaagtttaaaatttaaaataaataataaaaatagatagaaaatgaagaagttaagtaaaacttaagcttctacttcagcagcttcttcttcaatagctgcttctttagcctcattatctttcttctcgatagtggacctgatcattttcaatctaacaaagttttccctttccatttcctggagtctcatatcaatatatttttcagtgttttcgaatcttggaatcataatatgctctaacgcatttaccctacgtttagtagcctcaatttcttcagcaagtaagaaaatagttttttccacttcaccaagttcaattaagaatttaatagattcttcaaatttcttagcagcttcatctaattgtatagtggtgtcagaaaagctgtaacctctgtcaataatggatctttcttccattttaacattggttacaggaactgatacacccataacacttctagatttaatatctacatcgatagattctttaactgataaagatgctttcctaacagctaagtcacccatagctatttgagcttcaagtaaagcttcattagcttcttttaagcttctttcagcagcttcacgaacacctttgacacgatccaaaatatcaaaaaactctttgattaaagcatcccttttctctttgagtaaaccatgcccttttacagcgagtttagttctatttttaagagataataattccatccttgttggatttattccatctataatatcttgtgccatttaatcacccgttatatgaatgagcttattcttttggaaggtattgttcaataaattcttctttaacacgtttaagttcagatttaggtaagattttaagtaagtcccaaccaagatctaaggtttcaatgatagacctatcttcgtctttactttgagtaatgaatttaccttcgaattcttcagcaaattctaagaatttttgatccctttcggtaagagcttcttcccctacaacagcaactaagtctcttaattcacgaccacctgcatatgcagagtaaagttggtcagatacaccactgtgatcatcacgagttttgtctccgccgataccaccactcatcaaacgagaaagtgatggaagtacatctacaggaggataaatacctttcctgttgagttctctgcttaatacaatttgtccttcagtaatataaccagttaaatctggaattgggtgagtaatatcgtcttgaggcataactaagataggcatttgagtaatagaaccttctttaccatcaatacgtcctgctctttcatatatgttagctaaatcagtatacatgtatccaggatatcctcttcttccaggtacttcatccctagctgcggaaatttcccttaatgcttcacagtagttggtcatatcagttaaaattaccaatacttgcatacctaaagtaaatgcgaaatattctgcagtagttaaagccattttaggagttaagattctttcaatagctgggtcatcagctaagttcatgaatacagttactttttcaagagctccggtacgttcgaaatctctcataaagaagttagcttcttcgtgagtaatacccatagcagcgaatattactgcaaactctgcatcgtccccaagcactttagcttgtcttgcgatttgagctgctaattcgttgtgaggtaaaccagaacctgagaaaataggaagtttttgacctcttactaaagtgttcataccgtcaatggtagagataccagtttgaataaattcttcagggaattcacgagaagctgggttcattggacttccattaatatctaattcttcatcaggaattatttctggtccgccgtcaataggtttaccgataccattgaacatacgacccatcatatctctagatacaccaattttagcagtttgaccggtgaatctagctttagtatttttagtgtttaagtcagttgttccttcgaacacttgaataactgcaacatcgtcagttacttcaagaacttgtccacttcttttttcaccattaggtgtttcgatatctacaatttcgttgtaacctacgccttctacaccttcaacaaccattaaaggaccggagacttcggagattgtagtatattctcttgttttaatatttgtgttcatatttaagcctcactgcattgtttagtaatagctgcttgaatttcttcacatttagctgcaaattcgtcttgtggaatgtatttcattttaccaatttcttctttaacaggtaatgctactatgttttgaataggaactcccctgccaacagctgcaagagcttctttatggaataataaaatagtttttaacatattgtattgtttgacaggtggacaatatgtatcaatgtcatcaaatgcattttgttgtaagaaatcttctcttaacatacgagtagtttctaaagtagcttggtcagcttcaggtaatgcatcaggaccaactaattgtacaatttcttgaagttctgattctttttgtaataaaatcatagcttgatcacgagtttctctccaatcagcagctacattttcagcccaccagccttcaatactgtctacatataaagaataactttgtaaccagtcaattgaagggaagtgacgtttatctgcaagagatgcatctaaagcccaaaatactttacagatacgtaaagtgttctgagtaacaggttcagataagtccccaccaggaggtgatacagcaccaacaacagtaatggaagctacatcagaagtagtaccaatagtgtttactcttcctgctctttcatagaattgagcaagtctggatgctaagtatgcagggtaaccttcttccccaggcatttcttcaagtcttccggaaatctccctcatagcttcagcccatcttgaggttgaatcagccataagtgctacatcgtaaccttggtcacggtaatattcagcaatagtaatacctgtgtatacacatgcttcacgagctgctaccggcatgtttgaagtgtttgcaataagaacagttctgtccattaatgggtttccagttttagggtcatcaaggtatgggaattcagtaagtacttcagtcatttcgttaccacgttctccacatccaatataaataacaatatctgcgtctgcccatttagctaattgctgttgggtaacagttttacctgatccgaaaggacctggaatagctgctgctccacctttagctactgaaaagaaagtatcttgtgctctttgaccagttacaagaggtacatcagggtccaatttatccacatatggacgtcctttccttacaggccatttttgaagcatttggattttttcgtcacctttatcagttgcaacttcagcaatgtcttctaatactgtgtattcaccttcagaagcaatgcttgttaattcaccttcaatcattggaggaactaatattttttgtaaaactgcagaagtttcttgtacttcaccaagaacatctccacctttaactttgtctccaactttagctactggtttgaatgtccattttttctctttactgatagattctgcatctactcccctagcaatgaaatcaccagattcttctctgatgagttctaaaggcctttgaataccatcaaaaatggaacccattacaccaggaccaagttctacagacaatggacctccagtactttcaactacttcacctggttgaataccagctgtttcttcatatacttgaatggtagcggtgtcaccttcaagctcaataatttccccaatgagcttttgttcacctactctaaccatttcatacatctgagctcctctcataccatccgcgataataacaggcccagcaattttaataatttttccttcgataatcatttaaccatctctaccccaataactcttttgatgagatctgccatttgatcagatgatccttcagaggacccgtctttatcaggtatctcaattatcattggtaatacactagaaccaattttcctattaatatgatttctaatttcgttagctaatacttgagtaataattataattgaaatttcttcatctaaaattttatcaaaagctgcgacagcttcttcagcagaattagctacttctgctcttttaactccaccaagtctaaaacctgatacaacatcaatatctccaataattgctacagaactcatattaacatctccataattttagagttagggaatccagcttctctttttgctcttgcaataatttttaaatttttaatttcagtttctttttgacttacataaccaataattggaccaattcctaatggttttttcatagataaagattttgcactttttgacaagtaagcatctaaagctttttcaaatactgcaatggaagcattttcattatatttagccatagcatcagttaatacatcagagtatttagtgccttctaaaccggatattacatttgtaacatcaggagattccattaaatctttaagtttccattcacgtaattggtaaccgtcttctaatatataaggagcaatatcatcataagacaaattgtctttttttgcccttataatcaatttaagattagctatatctacttgagttccaacatatgagaataaaatttgtttattttcatcagcaggaacattggaagaacgtaataaactttctaaataatatttatctaaagcagattctaatgcaagaaccataccactattttcgtattttggaagagcatcttctaatacagcagcatattctgtgccgtccaaacttgtaactacatcagttactccgtcagcatcaattaaagaacgtaaatcttcatataaaactccacgtggaattaataaatcttcagtttcttcttcagtaaggccaacttctttagcagttaaaagacttttaatgttattaatatcagtttttttagacattacaacaaaagaacttctaatttcctttggagcaattcttgctacaaattcataagtatcagcacattgaatatctaatgctttatcaacaggatattcttctaatacgtcagcataatcaggaacacctttaagataattttcaaattcgtgaacattgtttgtttcaacaatttcagataattgtttttcatcaaataatcttccttttcttgcacgtacgcttgcactaggagtaagatatggataaatatccaaaattggtctagatgtaatgattacgactattgcacctataacgataacagcaattacacataaaactaagaaagtttcatttgtaagacctgctgaactaataagtgttgcaatttcatcagccataatttatcctcctaatttttaaataaaacattagcaacttcactacgtaataatcctttaaatctatctagtctagattcgatagtgttatttacttcaatgtcaccatttctagttttgagtatagctccaccaatagcatcaataggttcacctaatactaaggttgtgcttacaccagttttagttgcaaggtctgcagataattttttcaaatgaccttcaactttcgcaacatcagattctttaacttgaacgattaaatctccaccaccaagttcttcagtagcttcttcaatcatttttattaaggattctgaatattctgcatcatcactagaagctttagcttttaaatcttcagtagctttagcaaaagctgcttcaatgacttcttctttagctcctaattctgctctacgagcattcatcttagcttcggaaataatttgctgatatttcatatcagattgttttttaccattatctaaaattttattcttttctgcttcagcagttttttcagcatcactattaatagttgctatttctgcttgtgcatcttgaataattttatcagctttctcctgggcttcagacttaatgctttcaacaattttatttgtgcctgagctcatacagattgcctccttaacctaatattccaccgaataccataagtaagattgcaatcaagaatccataaatagcctgagtctctggcaatgcagagaaaataatacctctagcaaacatgtcattatcttcaacaatagcacctacagatgaggatgctgcgataccttgtcccataccggaacctaaacctgcgaaaccaatagctgcacctacaccgatagctacaacacctgcttcagtagataaaccttctccttgacctaataatccagagaatactaataataagattgcaatcaagaatccataaatagcctgagtctctggcaatgcagagaaaataatacctctagcaaacatgtcattatcttctgcaactgcacctacagatccagctgctgccataccttgccctaaaccggaacctaatccagcgaaaccaattgctactccagcaccaatagctgctaaagcagtacctaaagcaatatccaccatatttaattcacctttgaataataattaattttgatatatttaaataaaaaattttaatttttaagttttgtaaaagttctgtttgctttgaaagcttggaacttgtttttaccttccatatagaactgtgaaaagaactccacgtaatgaagacgtaaagagttaataaatgcacctaaaatttggaacaagaagtttgcaatatgtccgaatataaatatgaaaattgcaagaacaataccaataactggaatcatatcattacataagttagttaagatatttacagtcatagcaatacctcctgtagctaaacataatgctaaaagacgagcataagacaagacatctcccataaatccgaaaacatccataactccataagctccattagcatatattaacatagcaagacatgcaattattaaaactgctccaattccgtatccgatcatacctattgcaggcatcataaatcctaatactaaaaatataataccggcttctaaaacaaaccagcaaagctgagatccaatagcttcttttatttctccatatctgaaattattgatagctccaataacaaaaccaatattagtataaattataccaatagctattgctattattaaaatagtatctggatgtacaaaagcttcaacagcaggcacaacagtaggcaacttataattcaacattctttgtgtgaaatctcctaacaaaccattagttagaagacccaatataattgcccaaataccacacgctgtaagaatataaccgaatgatttcattgtatcattgagtttacccataccccttactaaaacaacacctatgatagctacaatagcaccataaaatgcatcagttaaacagtacccgaataagaacgggaacacaactgctacaaagaatgttggatctatagcattatatcttactggagaatacatatccacaagaacctcataaggttttacataacctttattagtttgtaaaataggtacatcttcatcatcagtaccttcaacatcaattaattcaaaggtacaatgtccatcagaacttttttctactaattgctcaactttatcagtatctttaacaggtacccatgcttctaacatataggtatcttttgtttgaacaaaagcagcaagtatttcattcttttctttttcattttctaattcttctttaagagataaaatatcgtcatcccatctttcagcaatagctcttaaatcacttttagctgaattacgttcagattctattgttaccaatctagaatcagcacttgagataatttgctgtggagttccctcaacattggaaacttcaactctctcaaagtcaaatttacgaagtgttgaataaacatcttcgccgaattcttttaaagtcactacgataatatttgcagtttctttatcatcattagggactataaaaacatctaattcatcagtcaatttacttaagttactttcaatttctgaagcagactcagcattaatcctaccaacagttatggaagtgtacttagaatcttttaaaagagccaagtccatgtctaaattatataaacgcttagctaaacttttattagaagtcaatacacttgtttcagagtcgagtgcggaaaatttaccttcaataacttttgtttcactttcaacttgagccaaaaggtcttctgctttatttattaaagcttcagtatctaaatccccaacttctttttgaataggcatttctggactaataaaagactttattgtgtctttgatcccatggccttcggataaagaatttcctaatagttcagaaatagcacttgttttcattaaaagtgaagataacttaccagtgaaagcagatgcttttgaaggagttactaactccgctaattcaggatcttgctgaatactatcagaaatctcgttgatttgtactaatccttgttcgtggagtgcactaacagtaggggatatgtactcatcaagagtaacgattctaattttacgcattctagctgtcttgaacattaatctcacactataaaacatttttgacaataatagaagcagcatcatctacatttgccatagctttttcttttaaggaagctacattagcttctccatctttagcaatagattgtgcttcttttttagctttgtcttctgcatcaaaaacagtatttttagcttcttcttctgctgctttttttgcctcatttataatattttcagcatttatttttgattcatttatcatgtccacagatttggactctgaatcaagaataagttgttcagcatcagattcagctttttttatcattgcgatagcttctgatatctctgccataattaatcaccatggtatattaatctttattgggaagcatatatatcttttacgatttatatttaacatgccctaattcactgatttaaggaaaaataaaagaataatcgaaaaattaagacaataaacaacataaagacattgaaaattacaatttgttcagaaaattttaaataaatatagcatatattgagcaatgtttaattttaaaagtaaaattttatacagtcagataacggtgccatgaacatgtgaaatgttaaaaaaaagaggagttacctataaaaatattttaaaatactcataggtaatttttgcagatatgccaatacagctattacaacaatagcaagaccaataatacccaacaaatagttatacggagtagcaagtaaagtataaccgcttattccaataataattccttcaaaaaagaaaactgccttagcccattgcggtttagcaacaataacaatataagcaattccaattaaaactaaaataattgcactagctatactgtcattagttattgtctgagtaaataaaggacgaactcctaaaaatattaccagaacagctaacagaattcccaataatttaatatttttaactttaatcatgattatttcttttaaactttataatatttatattataataaaatataatagtagataaaggtgatgaaaatggacagaagcgtatggactattaacaacaaacattttacattgatcctagatgcaaaaacagaaagcggaaaagttagtgacagaaaattcagtccaggagaagacatctggactaatgaaatacctcagcttaaatttgaagatgaaaatacccaaaaggaatatgataatttcatatcagatttgctgatgttattgtcagaacctaatgttgatcatgtctttattgatgctaaaataggtgaagaatcagaatatgatacttcagccacttatgaaccagtaataataagaaaaatagaagattatgaagtagaaaaaattataagttaatcttaaaacatggcattagctttttccaatacttcatcaatagtattaaattccaaagcatctccagattcggctttggtttcggttgttattaaaacattcggacttgtccaaagtaaagaatatgccagatatgcaacattaactataagcataggcataaacaggaataatccaatgaataaaaagaacatatgtgctgcataatttccataccttttctttttcattaaaatataatgattttcctgctgagtaattttaaatttctcttgagccaattcctcagaaatattattcatttccttggaattatctgcttttaatataaacaatttcattataatctaaatatattcaacaaattcatcaatttcttttcttggagtgtctcttggttctgcatttccatatcccaaaggagtaaacaatacaggaacttcattatcatttaaatttaaaaattctctggccttatcagctttaaatgctgcaatgtaacaggttccaagtccaacattagtagctgccaaaataatatggtccattacaatagttgcatcaatatcagctatgttctttccgtcccaaggtcttgtccatgcttcatcaacattagctacaacacataatacataaggagcttccacaaaccatttagccccataaatttcagacaaagattctttattttttttagtgtcaattacaaacactttaaaaggctggttattcactcctgtcggagctattgtagctgctttcaatacatattcaagtttttcatcttcaacttccttgtccaaatatcctcttacactataccttttattaattacatcatcaaaatccatattatctaccttccaggaccgtcataaacaatgtcgtcaatgtcacaaaaacgtctaaattcatcttcatcaatagtttcttcatgaatatgagcaataatgcccggaacacggccaataataaatacccccaatcctaattttgggtcaaaacctaaatcagacaaaattgctgcatttgccccgtcaacatttaaacgaatgtttttcttttgataaagcaaatcttcaatggccaatgccaatttagtatgggggccaacacatccttcttttataacaagttccattaatttatctgctcttggatcagcattatgatatctgtgtccaaaaccaggaattttagtatttttagagacaatatattcattgtataaatcaatagccaaactagctatctgtttattgtcaatatctgcatctccggttaacattaaagagtcaatcttggactggtataattccatggttttttcaatagctcctgcatgtttatgtccaaatgacaatagcgcaccagctacagcagcatttaacggagaacctgaagaggcaacaagtcttgctgtttgtgtacttggaggagtggctccgtgatcacaaaaagaaactaaaacatgattaaataattttccctcttttattgaaggcaatctccctttcagaagaagaaaaaccatatcactatatctaattttttcaattaaatctctttgattgtatcccctagtaacaattttatcaggttccactttagaaatagctgttcttagtgaatgctcgttaattttaaaattattttccgacattgttttaatttcctcaatttaataattaaaatataattataatccattataaatgtaatgttgcaactctcggttctacaaaacaggaaggtctgactgaaacaattctaacaccgcttgccctttgattacctacattaacaaatgaacctaaaactgtggtttttccaccaaaacccaatggtccgatatttgtttcgtttaatttctgagttacataattttccaaatcgctttgggaatctaaatttccataaacaattgattttaacagtaatgatgatgcctcataatgtgtacggccaataccaacagcaggaacagaaggagtgcatcccaacattttaagtgattcgcttaaccagccgatagctgtaccaattacattttcaattgatcttttatgatataccctatatgtctttgcccttatttcaggacctcctccttccagtataaaatggatgtttaaagtgtccggagaaatatttcttttatatgttgaatcctcactgaaagaatctattaaaaaggatgctgctttcatctgcccaggacggttatacaatccttttgattgttcaattcgctcaacatcattacctttaacagccatagggcgggcaggcaaattatttaatcctctttcaattccctcattaatctgagctattaactcccctgtgatttctcttttttcacctatttcaatgattacatgaggaattcctgtatcatcacataaagggaatttggtcttactggctactttataattttctaaaatttgatttaaagcccacaaagcattttcattatcttcaacagaaatggctttttttaatgcattgaatttatcttcagagagatttgtactggctttaattattgcatttgaaacatcttctatgatatccatataatcactcaggaatagataaatcattagatcctttaggagaagatattgcatcactataatattggtcaatcattcttttgaccagtttaacctgtttaatacgagcaatagcttctttttcagaagtatcccaattatgagactgtgctactgaacctcctgtttttaaatatactggagaagctactttaataatcttcggaacttcataatgtctgataaatccgccagttgatttcggattttcagtatgcaaatctaaaggcatatacactgctttacgaatagctgcaatcataggaatttgcaaatctctaactggattgaaagaattaagaccgttttcttcaagtaattttgcagatgctggatttccatgtccagtatgtgcagacattttgaaatgaagtgatttcggaagttcacctgcttttctcatctggtttaaagtccaaagtaaaccctcatcatataataatattccacgaactcccaaatcggcagctcttttaacgtcttcaattgcataaactaaattgtcatatcctcttaagcgatatcctatcctgcttccttccttagtatggacagttgcactggtatcataggtagctcttggacctacagataaaaaaagttcacattcatattttttagccaggtcaaccatttctgtaatttcttcatcagtaagcagcattattcctttggtttgagtaatacgatgaatagttatttcatttttagaagcttccttaagtaaggtatccattatttttggagattgtattcctggaacctcaaaacgatactgtcctccatcattaaaacgtttaaatgattcaaaatcgccataagctcttttaattccaagctgttccaagaattcttcagtttttttcatagtatctactcatttaatgtttccataagttgttttatagaataatcttcaatattatcaacaacaagcaatttatttaaatcaaaatcaggattcaaacttttgaatttgtcaattaaatcttttaattgatatggattttcaaaatcaccttttggcaataatgtaatattttggaaaattccccctctgaaagattcatccaacttaataataacatttgatggtcttttatttggatatagctcatccaatccactatcagaaacaatgattattttactggccagattcttaatactgttaactttatcaactgttgaatagctatcaagcaggccaaattcaattaactgatttaaatcatccaaatcaatttcaccacaaacaagcataatggccactgcataaggcaaactctgttttaattcttcgacatttttcggattataattatcatgtttagcagctacatcatatgttttgataatcacatttccaatatgctcatactcttcacctatacttgcctttagttttaaaacagtatctattgaagagtgcaaatgtctgcaaaacggatattttttaaagtaaatgtccctgaccctaactttacccatattttttagagcaacatctaaagaaaaatcactatctgacaaaaccattgtttttaaaaaaccttcatccccatcaaaaattgttccggcaccagtgaatccgtttaaagccaaaaatgcagatattaatccattataaacagcttttccaacatgaagaactttgcccatactcccattatggtcagactctaaaagacctgcagcctgagttccacacaaacctaaagcatttaatgtttggttttcatcaagattaagcaatttagaagcaacagcacctgcaacaaatgttccgacagttcctgttgtatgaaatccattgtttctatgttgaggattgacaatttggcccagcattattccgacttcataacctgcaataaccgcttctaaaaaagatttgccgtccaaatcataagcttcactaatagccaaggcagttgggaaaataactgcacccaaatgaatttgtgcgcctctatgaccatcatccaattccaaaacatgagctgaaataccatttaaaaaacctgcattcagcagatttgttttaaaattgggcataccaataacagaagattccagctcaaactccatatttccaaaaaatagttcactaatcgtattgaaagctattctagaagattcttcatttactcccctatatgtgactccaaaaaaatcaataaatgctgcttttaccacattaagggtttcttttgatgcctgttcataacgatagtttgaaataaatttggaaatattttgtaaaaacataaaacaccttaataattaaattgtaaaaatagtcttaaatagttaacttaaatggtgttaaaaattaacaccaaggtgtaccgcttagaactaaaactatgtgtgcaattaatgcagatccaaggtaagttccagtaatgatacaaatagttactatcatacctctccaacccatagccttgaactgatcccagtttttaccaataccaataccaacatatgccaaaaacacggttacaatagacaataactctacttgtcccacatatttaactacaaatggagaagtcggtaccataggtatggaaactgcaataccaataagacttatgtaaataattgaagagacattaaatggcaaatatctctcaagcaataaaccggccaaagttataatagataaaatcaacattccaataagggaatcagatatcggatgtttataacctatccaatttccgacaactgtgataactgaaaatataaccaataataaaatccaattaattataccatgtgttgaaactgtttctgaaccgtcaattacatcaaccattatttttcctcctctaaatgagaaacagaagtttctcttccaattttaggttcaagccaagcatataatttttgagctaatggaatagctaaaaatatacagaaataaattccaacacagaaggaaattaaattactgaatcctgcaaatgcctgaatatttgtactcatacttgccgggaaagcatttaacaatggagctaatgcggctgcattcatacttgcactgcctacccctgttgccattgcaaatgcatatggatgaagtggtaaaactgatacacataaacatgacagaaaactgatgtataacgttccaataacagttccaataataaatactgttaaaactcccctagtttctgcagaatcaaatccaaatttatcaataacaactgccacattggtttcacgaccaatagaattagtcataccaatagtttcttttttaaatcctaaaagcaatgccacaggaagtgctaaaaatacagttcccaaattaccaaactcctgtaaaactaaagcaggaccaacatcaagtaaaatatggaatgactgaccactagctactgctaattttgcaagcaacggtcctataaataacagcattgcactttctgcaattttagattgttttttagtaatccatttaactggttttaataagaacaaagccaaaccaataaccattgcatataacaacggcataattacaacacaaatgtcttttgtaagattgaattcaacaggtcctataaattcggaaataataaccaaaaaaagcacagtaatatgtaatctataatctttccatggtgctttctttaaaatagttttatcagtcttatcacgatatatgtgctcagttcccttaactttttcgtttttatcgctaatctgtgcccaccccaacctaattttataaatattatattaaaatacctattacttaatacataattcgacctattatataaattaatactattccaagctcaaaaattcctttaataggaacaaaaacccttaaaaattaaaataaaattcacaaaataagaacgattaaataaagaatcagagctgataaaaataaaaaataaaaatatatggtggttaatttctataaatccatcctacaaataggttttgacaaatgacgcctagcagaaactggtgtttcataaaactgaccattttttaattttctgaaaattttaataggaacttttttattatcattaattttatttccgcattttttacatttaaatcccttattttttccagcagaagtcattctttttccacattcacaaatagggtttttatattcaacatcatttaatttaacaacttgaaacttttcaatattaaatgtattttgttctccaattcccccgaagagtttaacaatatcccccggtcttaaatcagatacaagttttctaaaattttttgttggttcatatgctccgcattcaatctcaccagaatcatcaaaaatgtaaaaaaacatatggccaccatcaataattgttggtttgttttttacagttcccacaacttcatagcatccaaactgtttcatactagctatatcatccgttttttgaatgtgcatatcagtgtgttgattagtcttgaaaatgcaataattttccacaggttcttcaaccagaactatttttttagctctctcaagagcctcaacagtgtttgatctgataccatacaaaacaggacatggagttttaggttctatagctatataatcttcactataatcaacattttcaaaagtttcaggataagtttccctatccatcaaataaacggaatcataatcaatgtgtcttttagtaccataattttcaggcaccctatacgccaacagttcataagtgaaatcctccaaaggcagcccaatagctgcaatagatccaataattccccttcctttcttaaacttatgaagttcacagccgatagaatttccaaattcttcagcttccttaattgtgataaatgaataaatagccttaaatgaatattcaaccatttcatcagttatttcaccaccataaaatacaacaccaggatttgtattatcacagtcaaacatagctaatttttccacttcatccaaaactattttcttagctaaatcagatttatcatcatttaatattttaaaagcaacaccgccgtttccccgtgttttgaatcttgcaaatggatttaatctaattaaacgaggacaaccaacaatttcaatacctacttcctttaatttatcaataatatggcaggccaaataagtagtacacataccgtctggagagtcagtatcatcaatcccaatatgcaaatatttaattaaaatcacctattattaatattataaaaaactataatataaacatatatttacatagagggattaaattatgttaaatcgaagtaaaatgttacaagaaatagataatttattaacctctgaaggttataaaacatctaacatttacgatcaaggatcatttgaccttgtagcacgtaaaaacttattaattttacttttaaaaacttttttaaatatagacagtattaatgaagccaatgctcatgaaatgaaacaattagctaatatattccttgcttccccgattataattggtgaaaaatcaagaaacggcattctggaagaaggagtaatctatgaaagatatgatattcctgctataagttttgaaaccttaaaaaatatgatactttacaaggaatatcctgaaatccttgcagacagaggaggatactttgttaaagttgacggtaatgttataaagcaatacagagaagaatattcattatcattgaaagatttggctgatttggctcatgtatcaagagcaacaatgtacaaatatgaaaatgaaattgtcagagccaatacagaaacagctatgattctcgaagaaatactaaatacaaaagtaacattggatattgatttattaaaaccgaccataagcgaagatattgaatacagtaatgttgaaggagcagatgatttatccaaacttggttacggtattttatctacaaataaaagtccttttgatgctgtagcaaaaatgaaaagctcaaaagacaaatcatcattattaactaatgttgagaaaaacagaagtgaaaaaactttaaaaagaatggctatcccattaaaagatttgtcaatgattacatcttcggaacctgtttttataataaataatgacaaaataaaagattcgcttggaaccattcctgtgattaaatcctgggaattgaaagaatttgaaaatccttctgaattattgaaaattattagagaaagaaaagacaacatgtgataatatggtagaaaacttaaaaattgaaggaataaaagattatcctattaaatggatttgtaactttagagggcaaaaagctattggaatttgcggatattctcaaaaaatagctatgtttgcagcagattcaagagtctcaaagattcttgaagatattgtaatcggaacaaaagaagaacttgaaggctacggctgcgaagaaaaagacagatgctgcaactttgaatgtgaattttgtgaaattaatccaagacaatacctgcaaattactggcaaaaaaccttcaaataaaaacattaaagaattagagcaaggtttggaaagtttaaaccttgaaatcaaacaaaaaaatctagtcccatttgacaactatgaaatagtagattttaaggaagattaaatatttttcaatattgtaacatcttccacaacttcttttttactagctacaccaaaagtcaccaaatcaacataatccaaagtatttaaaaaatcaaatgcttcagcaggctttaaaatccctgctgccaaaatacgagtcgctattatttttttatccaatttttcaattttaactttgaattcctgtctttcttttggtaaaaatgaaggaatatccatcatataagccagtttatttataggaatcatataataatcaaacaaatccaaaacaggattatccataagcaaatcagtagttttatttggaaaagcagttattaatccggaggcagcagatgtatcattaatctgagacaaaatatttgaagtcagattccagtcataaccgtcaacaataaactcgtcaacaagcattaaaggacaatcataattatcaaataattcaatatcatcttcccaatccacctctttagctacatcataattgggattcatataatcaacatcagactttccgacagtagctacaaccttcatgtcacagccctcatctaaagccatatcaaatcctttaattaatgcatcatcattaactaagttaatagacctaactccatgattataagactcaatgataatatcagctattgcatcaggatttctatgcaaatccaaatcatacaatctagatctatggccaaaataaggttcagctataaaaggagcattacctaaaatcattctgggaactgatttgtttttaaattcaaaatcatcttgaaaaatgaaatcacaaccagattattcttctttttcaactacaacagcagttccataagcaagaatctcctgcataacattagaaatatcattagaatcaaaacgtactgcaacaatagcatttccacctaattgtttggcatgttcaattaatctttccaatgcttcatctcttgaatcttccatcatggaaacatattctttaatttcaccaccaactaaagagcgtaaaccggcagatacctgacctcctacacctctacttctaacagtcaaaccatagacaaaaccttttgtttcaataattttaaaacctggtatttcatttgcagttgctattggaaattcatttacagataccataataaaaacctcataaatatatgcaaaataattaaaattttaaatattaagaaatataaaattttaatcagtatttattttattaatttataaatttaataaatttttctaataaataaaaacaaataaaaatggtgaaataatgaaagtacttattgcagatgcaattaatgaaaaaggtattgaaaatttaaaggaggctgcagaagtcgttgtagacactacaatcactcctgaagaattagcaaatacaattcatgaatatgaaggtattatcgtaagaagtagaacaaaacttactaaagaagttattgacaaagcagacaatcttaaaataatcgcaagagcaggtgttggagtagacaatattgatttaaatgctgctaccgaaaaaggtattatggtagttaactctccagaatcaacctccattactgtagcagaacacactatgggattattactcagtcttgctcgtaaatcagcaattgcagacaaatctgtaaaagaaggtaaatgggaaaagaaaaaattcatgggtgttgaactcagaaacaaaaccctcggtgtaatcggaatgggtagaatcggttcacaggttgtaaacagatgtaaagcatttgaaatggatgctgtagcatacgacccatacttgcctgaagaagtagctgctcaaatgggagtggaattaactgatttggaaactgtccttaaaaaagctgatttcattacaattcacgtacctcttactccagaaacaaaacatttaatctctacaaaagagttcgaaataatgaaagacacagcatttattgcaaactgtgcacgtggtggaatcatagatgaagatgcattatatgaagcattgtccaatgataaaattggaggagcggctttagatgtatatgaagaagaacctccagctaaagactgcaaattattcgaacttgacaatattgtattaactccacatattgcagcttcaactaaagaagcacaaagagatgctgcaatcattgtagctgatgaaattatcgatttaatcaacggaggaacacctcaaaatgtattaaacctcccacgtatcgacagaaacacctatcaggaagtaactccttacttagaattatgtgaaaaattaggtagtttcatctcacaagcagtaaacggaaaaattaaagaaattgaagttatttactccggagaattatccaaaatcgacaatcttgaaatgttaaccagaactgtacttcagggagcagtaaatccatttttaagctcaccagttactgcagtaaatgcttccattgtagctaaaaacagaggaatcattgtaactgaaggcaaaactgaaaattcaaaaggatatgattccttaattaaagtaactgcaaaaagtgaagatgatgaattctctgcagaaggaactaccttacacgaccctaaaatcttaaaagtaaatgactactgggtagatgtaaaacctgaaggccatatgttcatagctaaatatgaagatgtgcctggaagcatcggtaaaattggcaccgcattaggtgaatacggaataaacatcggaattatgcaagtgggaagagatgaaaaaggcggaagagctattatgatcttaactcttgataaagaaattccaaaagaagtaataaaaggaatccaagacttagacaatgtctatgacgctattggattagaattataataaaaaacaattatttcaccatattgttttttatttttttattctttaaattatcacttaaaaaacaccacaatgaaaaaataaagatatctaaaaattttcaatttataaaataaacttcatcatttaaactataaaatcaattcttaactatcatatgagttaaatccttcctggaaaatctcatcaacttctcaagctcatcaggaatattttaagaaactcttttaggagaactataattaaaattagaaaactcacaataagaaaaatatttatcattactgaaatctaaatgcttaccccacttttcacagcagtttaattatatatgattttggaattgcattcattttaacttcttattgtatagctttacctaataatattccaatataagtaaccagttagaattttagaatgattatagttactaaccaaacttttattatagatgtgtgatagattataaaatatgtcaggaaaatctaaaattaatgtttttaacaaaatgacaaaaactgctttggatgaagaaataagtacttatgtggcatatcatagatactatcagcggttaattgcagttaaaatagttagtgaaggaaatacaattgcagatgcggcaaatatattgggaaaatcttatcaaacagttcatagatggataaaaacttgtgaatctgaaggattagaaggtttaaaaccatcatttggtggtggaaggccatcaaaattaacttatgatcaattgattgaattagataaaatcattgaaaaaacaccaaatatgtcaatgaaagatgtacatcttcttgttaatgaaaaattcaatgtagattatagtttaaagcaaataggaaaaattgtgagaaaattaggatacaattacagcaaagcatatcctaaattttcaaaatcacctgaagatgcagaagaacaattaaaaaaaacttagaagaacataatatatcatctaacgatattatagtcttgtttgatgaagcatcctttcaaaatgaaccatatactcaaaaatcattatataaaagaggaacaaaacacactcaaactgtaaatcctttacaaattcaaaatcaatgccacaggatcattatcaataaatggaaaatcaaccaccacaatcacaaattcttcaacagcaccagaaatagcaatagcactcctaaaattaagatgtattaatacaaaaaataaaaatgccgtaaaattattaaataaaataattgaagaagttaaattaactgatgaagaaatagatgaaattttaatggaaaacaatgaaaataacaaagtttttcacagaaaaaataataaaaacaattgaaaaatataaagacgatacaacctcaacaattgccagaatcattggaaaacactgcaatcgagaatcacacaataatgtaaaaaaaagaagagaaataaaaagaaaaataaccttaaatctattagaaaaagaagacctgataacaaaaatgcaaaacgaacaaagaatatgtttaatcttagataattacagcattcataagtctgcattcatcaaaaaaatagcactacctcccaatattacattaatataccttccaccgtactctccacatctaaatccaatagaacaaatatggagacaaatgaaacgagaaattaaacatcattacctagaatcaagagaatttttacaagaattaacaataaaaacctacaaaaaatcgatttataaaacaaaagttcatgacaaatggctcgaaacatttataacaaaagtttggcaactaactatatttagtaaaataatggcaaattcacatagacataacttgaaaatgaaaaaataacttctaccaacatcatcaaaaaacaaaaaaaaactagcaagaattattatttaatattaaaacaatcataactgaatgtttatttaattttgtaaataaatttagaaaaacaccaccttattttcatgatgcttttataacttcgaaataatacttttcaaagatgagtaatatgtgtttaaatagtataaaaaagaaataaaaataatgtatatttcttaatataaatatactattaaaattcaactctaaaggagatattgaaaaagatgtttaaagataagtttcttatttttataatattaataattgcactactatcaattagtgtagctagtgctgaagatgtatcatcaaatgctactgacacacaagaaagtgttatattaacacatgatgatttaagtacaaaaacaactacttccacatatgatgaaaacacatctttagagtatgataattcacaaagtgaaaatatacttgaaacatacaaagaggatgtaaatttttctaatgaaaacacactaggtgacgtggaatctagtgatgatactgctttttttaataatgatttaatttcttcaaacgaacctactactcaaaataatataatacataatgaaaaactggttagcaaatcattcactcaattgaaagaggaaatagaattagctagtgatactttaacacttgattccaattataaaatgactgcaaatgaagaaaatagttttaaaaatggaatttccatctttaaaaacattaatattgatggaaatggatttactattgatgcaaataacttaaaaatgattttcaaaataggtaacagattcagtgttagtttatctattactataagtaattgtaatcttgttaattgtgcattttataattatggttctgattctagtttaactgtaaataattgtaattttattaatagtttggattatgcaatttataatgctggttctgattctagtttaagtataagtaattgtaatcttgttaacagcaaaattagtaattctgattctagtttgactgtaaataattgtaattttattaatggttcaattgaaagttctgattctagtttaatcgtacgtaattgtaattttgttaacagccgaatttataatggaggttatgattctagtttaatcgtacgtaattgtagttttattaacaacactgcatacaatggaggttgtgcaatttataattctggttctggtttgactgtaaataattgtagttttattaacaacaccgcaacaaatgattggggaagtgcaatttataattctggttctggtttgactgtaaataattgtagttttattaacaacaccgcaaacaatggagctggtgcaatttataatactgaatctggtttgactgtaagtaattgtagttttattaacaacaccgcaaacaatggagctggtgcaatttataattctggttctggtttgactgtaagtaattgtagttttattaacaacactgcaaacaatggaggtgcaattcatagttcttgttctaattctacaatagtgaactgcaattttattaacaacattgcaaacaatggagctggtgcaattcatagttcttgttctaattccactataagtagctgcaattttattaacaacactgcaaatcatgctggtgcaatttataatgcgggttctgattctacaatgatgaactgtaattttattaacaatattgcaaacaatggaggtgcaattcatagttcttgttctaattctacaatagtgaactgtaattttattaacaacactgcaaacaatggaggtgcaattcataattttggttctattactgtaagtaattctaaatttaaagataataatgcaagtaaaggtgttgctatttataatgatgtttattctcaaattagtataggtactattaacttaaataacaatacgtattctggaattaataacggtaaaacatatatttacaatataggcactattctcacacccgtaacaattactgttttagaaaacaaaactgtcaattgcagatataacaatgaaataacattatttgccactattactactagttttgatggagctagtgttgctggcggaacattaaacttcattataggtagaagcactatatcaactgtagcaacaagcaatgataatggaacttataattatacttacaaggtacctttcagaaatatttctgaaatcattagtgcatcttacaataatgccagtaatgcatatgtttatagtggtattttagattctagaaatgttactagtgtgaatataatagttaataatgttgtaatgatttacaaggatgggtcacgcttatatgcaactttactggatgctaaaggcaaccccctaattaatactgcactttcatttacaattaatggtgcaacatacaataaaactacagacttaaaaggtattgcttcaatagctcttaacttagaacatggaatatacaatgcagttatttcttatgctggaaacaaaatgtataaaccatctagtgtaaacagcactgtaactattaaatcatcaattactggtcaaaacattgttaaaatgtatcaaaacgatacaagattctatgctaaattcattgacagtactggaaaagcactaactaacaccgaagttaaatttaacattcatggtgttttctacaccaaaaaaactgataaagatggtgtagctgatatgggtattatgttaagacctggaacttacattttaactgcttacaacccagtaactggtgaagaaaaaggatttaacataactataaggtcattaattgtgcaaaacgatttaaccaaatactactcaaatgcttccaaattccaagcaactatctacaacaaagatggatctttagcagtgggtaaaaatataacattcaatatcaacggtgtattctatactaaaacaactgattcaaatggtgttgcaagcttaggaattgctttgagacccgaaaactatactattacaacaatgtatgatggattagacattggaaacaaagtcaaggtcataccaactttagtaactaaagatttaaacatgaaacacttagacggtagcaacttcaccgctttaactttagacggtcaaggaaaaccattggctaaccaaaatatatcatttaatgtaaatggtgtattctatcacaaagttaccaataaagatggtatagcaagcttaggaatcagactaatgagtggagaatacattataacttcttattggaataacttccaaacaggtaacacaataaaaatcaacccttaaagagaattcctaattctcttaactttttttaatagaaaatacaaaaatcagcaccctaaaagaaaaaataagtaactctcaaatttttcacaaaaatcaagagctatataaaataaaaattaaagattatttctaaatatctccagcatccatgcgatgaaatgaaaataattccagataatgaaaattcaagccccccataataatagttaaaggaaaaaagattataaactaccattatttgttttttaatgaaaaatacacttaaaattcaacattaactacagaattaagattttaaaaataaataaaaaattagagaattattcatcttttggaagcttataaatacgtttaatatttccgttttcatctaattcaatttgaatattatctccatcacaaagaggaggcaattctatattggaaattattgtaggattactgttttgagttttcatctcgtattccctgtaatcctgatctatatcttcgtcttccaagtcaaaatcatcttcatcatcaaaaaatcccggttttaactcttcaccatcttttaaaacatcgtcttcatcaaaaaattcgctaatgtctccgtcaatttcatcagcatattcccctacagtataatccataggttctccatacttgtcatatgccataaatgtttccaagctatagggcaaacagacaatcatgtgaaataaaccatttttagaaaatgtttttaaatctgcaccggaaggatgtgcacttggtcccggatgggaatgaactgatccccagtattttaaagtaggcggcagcatctcagtatggacaacagctccaacatcacaggtttcaccaggtaaaaaaatcagactagtaatataaagtattttatctttgattttaccgtcaaaaaaagctaaaaattcattaggatacgcttttttagcataataaattacagattcaaggacttccctatcaactctaacttccttgaattcatcactatctgtattaaataattttgaaataaaacccataatatcacaattaaattatatttatatccttaaaaaagttttcgctgaaaattggaatttcaaaatcctcaaataaaaagctacggtaagatacctgatttttattttcctttttattgtaacctacgatttctttattttgtttataaatagctattccccgttttttccaattatcaacattgtttaaatttatcccttcattaaataagagttcatggatatctgaagacttcaatccttttattttttcattagctgttttatcactatattttgattttaaaatatgaattccataagcatttatgcagtttctccaggcctcgtcctgtctccatttaaaatatttaggaatatccttatcatttatcggaataattctgctgtcaaatgcaaccggcttggcaatttccttatttaaattgtatgtaaatgaactggctgcaaaactggctactactgaatttattttttcaattctgccattaaatggaatattatccaaaagaatgcttatttcatctgaaaatgtgtaaataaatactggagcaaactcattgaataaatctttagacactttaaccatcaatcctgcaaaatcttcatcatagggtttttcaaggtttaaatttttagctaatgaatggaaacttctcccatccagtcttaagataattcttgagtttacaggaactttcaaatccccgtaaacttcatattccttcattgcctacaatcctacagtaatggattcattgaaacttttaagcaatttaattgcggaaagtgcagccagcatactggttttcggatttgcactgcatgggaaatttttagtagttgttttaaactctccaaaatctccttttgcagtaatttcatggacatttctgtctacattcggatctacaataatttttacattaatgtcctgattacaggccaaacttatagttgcagctacgttaatattaagtggaaactcttttactgcttctgatgccttaccttcaaataaaacttcctcttcatcaatatctttacctaaagatttaggagatttacgagtaaccaggttaacttcttccaaattaaaatcagctacagctttaataccgtccagtcctacaactgctcctgaaggaaggtgtattcttgtacctttctttttacaaatatcatttactttactgtagaattccttatccataaacgcaccaatactcataataatcatatctataccatgagacaatacatttggagcatgttctttaacagaatccggagaagcacattccaaaaccaaatccactttgtccaacatgtcatttaaatctaaaacagctacaccattagcaaaagatgccaagttttctgctctttcaacatcattatcataaaaatattcaatatctatattattatcttccggaacaatagtactagctataatattagcaatagcaccacagcctataattcccactttcataaaatcacaacaaaaaaaataatttaattaaaaatacaagaataaataaaaaaaataaataaaaaaagatgaaaaattaaccttagaatttttcaaattctgtttgtgctttaggctcactttgttttggaatttgagattgttgattaggagaaatggcttcagacactggtggttcatgtcttacttttttcatatctcttggattaatcaacattatatcgccaatagcttgaactttatcaaaatcaatagttaataaatcatttttaaaagatcttacatcatgttcttcttctggagcaacctgaaaacttcttttcataaggtctctgaaacctacttgttttttttcaggttcaatagcccttacttgcaatttagaaattgtacctaatctaatattaagaattacatcagccactcttccgacatagtgtcctgttactgtataaatatctaattcttttaaacttgaaacttccaccatttgatacaccacaatatgtaatctaattcgtgttatacttaaagtaaattaataactttaacttattttaaatttatttacttgttaatataaatagtttatgatgtaacaaatttttaagcaaaataaggcctaaaacaaggaaaaatataagaatatattaaaataaatattttaaagagaatacaaaggagactataaattgtgggacacaagtaaagattatagaattttagtagcaaaccatgcaagagaacaatatttgaatattatccaaactgcatcatttagaggaaactggaataaaaaattagctattgaaacagcaaaaaacatgaacagtgatttccaatcattgagttactcttatcttgaaggagatgatttagttaactctccagatgttgcagcaataattgaaaaaggagaaaaaattgttgaatgtttaggtggagacggatggaacaaatcttttataagcaatgctcctaaagaggataaggaaaaaacaattgaaaatgtagctaaagtaagattctttatagactctgttttaggccttaaagaccgtttagccctaggtcccatcaatgatccgattattggaattgatataaaagttggagaaataatgagtgttacaaaacatccaaatgcagattccttaatgatatgtaatgttaatttaggaaaaagggccataactgtagttacaaatgatttaaatgtaaaagaaggaaacagtgttggcgtgtcattacttccgccacagtcatttatggaaacaaccagtgaaggaatgtttcttggaatggacggaaatatcttaaaagaagttgaaggaaatctcggagaaatgccaaaaggaattcctatggattcccttaatgaaacacgtaatctggtagaagcctttctaaaataggctaccttaaatttaatcctattaatttttccttagtcatttcttctactgcatattttactccttcttttcctgttccactatttttaaatcctccgaaaggcatgttatcagttctgaatgtagattgtttatttacaaaaaccgtacctgcctcaatttcatttgcacaccttaatccatctctaaagttttcagtaaatactcctgcctgaagaccatattctgtatcattagctactttaatagcttcatcagttgattttacttttataatcggtgcaactggaccgaatgtttcatttacaacaacatccatatccggagtgacattatccagtactgtagcttcgtaaaatgcaccgtctctttttccaccagtcagtattttggcacctgccttaactgcattattaactgtttcttcaaccatgcgagcagcatcttcatcaataagtgttcccaatactgtgtttttatccataggatcacccattttgatttttttagtttccctaaccaatttttgcgtaaactcatcagctattgactcatcaacaataatccttttaacgcccatacatacctgtccggcatttaaataagcaccattcattactccgttaactgccctgtcaatatccgcatcctttagaacaacaagaggatcattacctcccaattccaaagtaacttttttcattcccgctcttgaagctataagcagtccggtagctacacttccagtaaatgaaattttatctactttaggagatgttaccagtgcatcacctacttctgaaccatatcctgttacagtattgataacgccatctggaaactcctcatttacaagttctgcaaatttcataactgtcaatggtgcatttattggaggttttataattacagtatttttacatgcaatagcaggagctattttatgaattgataaatttaggggataattaaatggagttatagctgctacaacacctaatggaaccctttgagtaaatgcaaaaaaacctttaccgtttatcccaccatccagcggaactgtttcaccataaattcttttagcttcttctgctgaaagttttaatgtttcaattgaacggttaacttcaacaacagactcattaataggtttacctacctcttttgtaagcaattcagccaattcatctttgttatcttttaatttttcgtaaactgcatataatttatttgaaattttaaatgcagacatttcctgaatagaatctttagcattaactgcagcatcaatagccaaatccacattatttaaatgggaaacaggaactgtatctataacttccccattgtatggatttttaacttccgccaaatcatcagctgaaatatgtttaccatttattaacatatccattttatcaccttatttaattatattaaaaaaacatatatttaaagtaattaactgaacaaatattaatattatggaaactgctagatttgaaacatttgctgatgcaataattgcaatagctatgactgtacttgttctaaaactgccccaaccagaaagtgcaacaattgctgctttttgggcgttgaaaacttattatcttgcttatttcatcagttttttaacattgttcaacatatggtacagcaaccacaacctattccagattgtagaaaatattgacaatactgcagtaatactgaatggaatcctgatttttgaaataacattgatcccctattttacattatggttaacacaggatgcatattcaatagctagtgaaaccagctttggattactgtttattggaataaatattgcatgtaacttatcagttagggctgttcataaaagcgacccctataatgacaaattaataaaagcagattatgacaatctatatgcattaatcccattaactgtaattctgattggttttgtattaacttacagtgtttttattccaggaatttatatcagctgtttaattgcagttataatgtggatagctatagccagaatacatagaaaaggtgttgaaaaatggaaagtgaaagatttgaagcattaattgatgcaattcttgcaatcataataacaataattgttttagaaattccaacacctgcaaacggcagctggcaagctttaggagaactgcatctggaatttattgtttatttaatcagtttcatagtttgttttaactactggaactatcacaacaacttattcagcatcgtaaactatattgattataaagtcatctggtcaagtggactttcaatatttatattgtccctgcttccttatctgacaagttttgtagctaataacttccattcattctttgctcagtcaatatatggactggatttcctattagttaatttaatttacatctatacttcagaaagtctaaaaaatgcagataaaggaaatattgctctgcaagtagcactagataagaattatgaatttatagcaacaatagttaccatcataatcggatatgtaattggttatttcttctatcctccagcaataattgcttcctgtttagttgcaataattatcatatggtccatgccatacataactaagtaaaatattttgataaagaatctaacttattattaaagttagaaacttcttcacctttaatttcaccagacaggccagtgatataattcctgtaaaacattaaagtcaataaaacaaccactataatcccgccaatcaataaaataaattctgctgaagtctgacctttattatccaacatattatcacctaacttaaaaacatagcacctgcaaaattggaaatcagataaaatatcccataagaaaccagagccaacggtacagaaaacttgattccctttttaacattcccatacattattatgcttactatcaaaccaaccaaaaccgaatgaattaccagataaatctgtcctgcaaatggcgctgccaaaattaactgtgtctgcttcccaaagctttgcataaactgggagtaaacactaaccatccctaaagcaaaaggactggctattactgcagaaattattaaaaacataactgccatcataacagaagattttctttcgcgttttagagccagcatatcccttaaattatttgaaacatcaaaaatgacattggcaatacttgatccgcttttacggcttcccaatattattgtaaaaatcctctcaagttcttttgactttaatctttgagccatagccatccatgcatcatcaaagtttcgcccaactttaatctcagcaattgcccgtcttgtttcatcatataaaggcccttcaccatatttggacatatcttccattgcattttcaaaacttaaaccaacttttaacatagctgaaagctgtcttaaaaagtcaggagctgatttttcaatttctgctgcccttttttcctgttttataaaaacataagtggcaacaaaaggaattattaacaaaggtaaaaataaagacaaatcagaaattttaaaaaatacaataaatattccaattacaatatctgcaaataaaataaaaaatattaaaatagctaaaaatttagatgcaactatcccaatgtctccgcttagcaaaaattcctggactttggataattgctcttcagaaagtttattttctaaaaataaagataatgaataaataattttagattccatagattaaaatacaactttaaaatatataaaatctcagttgtaaattaaatcaatttttgaaaacttattcaataattaaaggtaaatcaccaattattcttcctttatttttttcaatagctattgtatcttcaagtctgacaccaaaattatcttccagataaattcctggttcaactgtaataaccatgcccttctcaattactgttttgtccttagttgaaaatgtaggtatttcatgaatatccaaacctacactatggcctgttgagtgaatgtaattatcaccataaccatattcacttataatatcacgagccaccttatcaatttcacagcatttaagacctggtttaattgcttttatagccttatcatgagcttctgctacaatatcacaaatttcattttgtttttctgtatacacaatagttcttgtattatctgaacagtacccatgatattttgctccccagtcaatcaatattggtttttccaactgtttatcctgaggtgttgcatgaggcagacttgaatttgaaccgcttgttacaatagtatcaaaagaactgccattcgcaccatattttctcattaagttgtccaattccagagcaacaatattttcaggatttgtattgtttaaaatatccaaatcaacaaatgctttttgagcaatctgtgttgctttttggattttatctatttcatcagctgttttaatttgtctttgagcatcaataaatgtttcagattttatattgaaagaatctttgaatttttcatatgtactgtaaaccaaactcggttcaatagccaaattggaaattccttcctttttaagctctccaagcatgtctgaaaatgaagtaaattctttaacttcaattgttgatgttttattagctatctccatatccatttttgatgcataaataattggatcttcttttataacacaaaaagcaaaactagtaggtctgtaatttgaaatatagtgaatatttgtaaattgtgcaagcaaataaccctgatactcctttttttccatgtcttttaaaatattgttaatatgaaattcatttatttccatttttacacctttcatcaataaacattatatttttctggttttaatatctttcaaaatattggaacaacagtcatatataatttttattttaaaattattaaatagcatttaatctaaacacaggataaaaatacttaatgaaaaagaagactgtttttatttcaaatgcttcagttaataagattagcaaaactgcggcaatatttgacttgagcaggcaataactaataataacaaatgacaggtccagttttacaggagttcctttaccctaggtgattctatgttaaaattatttaatttatttaatattgatgagaaatattttgcagataaaaaaaccgtgaaaaaaagatttataaaattattcggaggatttttattaatagcaattctaatatcaccatttacatggattggatttttatttttcttgttattattatttgcattaggaggaatattcttaatagaatattatagtgatgaattagatgaaaaatatcacttatacaattttaacaattttagaagatattcttatcaaatatttgcgtttactattttaggattttcaaccacatctttatctgtgcttatgatgtgtttgtgtgctgaagtaaatattataaaatccattttaatagcaataatatttgcactgccctttttaggaatcggccttaaatttaaaacatttaacgattccagcctagaagaaaatggagaaattgtttatgatgcaggctacgaacctaactactattggccagtactgactatctgctgctatttaggatacacacaatgcctctacgaaacatccccaataaacataataggactactaatatccacaacagcatgcttcatatggctaatatacccaaacaaaatcaacaaatacctgccatttgaaaacaggacaaaaaaaggagaagcaatatatttagcaatagcattaatcatattcttcatattactccaccaatttactacaatcccatttacagaaattacaggaattactaattaaaaaaaataactagtaatcaacaaatcatgttaaaaataggaaaatattcaaaataataacaatcaaataacaactatttattataactcgttgaaaatttagataaaaattatatatatttatttaaaattattatatatagtacattatttgaaaaaactgagaaaataaataccggaatattaattgatgcacaagcaggatttaacacaatacagacctgcataatgaatgaaaaatgagttaaactgtttcaacagttatcgcagtgagttttggtctaatgggtcttggtttaaactgtctatcaacagatactctccgacatccaatatggagtaattttaataaagcagtgaaaaaaactactgccaattatttatttgaaattgcagaagttccagtttattaagaagggtgttaatatgaataaatttaataaaatgttagatgacaatatgttttttagaaaatcatttcttaaaaaagcagcattttggatgtatgcattattttttatggcaatgctcttaatttttaaatggcattggttaaccgcatacttcatgataatatatatttcattaaccattggtccagtgttatttttctattatcaaagagaaatttacaaaaaacatgattggaaacagtatataacattctatccaatagaacgctttatgactttatgttttactccatcaacattaggagtgtttttaattgcatatttatgttgtttcaataaaataaatgcatttgttttagcaattatctttgttttacctatgctgggaatcggcttaagaccaaattgtttcaatgacaaaagcagaaataacaactcattaggttataggccatttatctatcttggattaagtatgttactatgttatattggttttccacaagtaattttcgaacacaatgttattaatcaaacaatattatgtgcaataacctgtttgggatttttagctttaattttcccagataaaggaagtaatttattaagatttaataataaaaccgaaaaaggattcttattatatattatactaatatttattgtatttttcattgtgttccattttacaaattcaggattttacttaaaaatttatttaaacacatggtgaattaatatgaacaaaaattttaaaaattacattacaataggagtgccatttgtaatttttgtagtgcatagctttttaaacacttatctatggattattttttcaatgattggattaataataacttatgcttattacaagcaatcaaaagaaaacaaatacttaaaatatgctatgagattatacatgctaaattttgtttttataatcctcagattactaatcaggtatttaatgacttaaaataacgatagaggaataaataatgacaaacctatttagtttattcaaattagatcccaatagaaagtattttccaaaaaaagaagatattaaaaaaagagcaatcaaaagttatggaataatcctattcttagcaatagctacatctagcatcacatggttaggatttttctgttttcttttttttgtatttggaacatgtggagtatggattgtggagtattatggtgacgaattagatgaaaaatatggattgtacaacttcgctaatttcagaggattttctctccaaattttctcattcatgcttctaggagcatcaaccacctctttatctgtgcttatgatatgtttgtgtgctggagtaaatattataaaatcaattttattagcaataatatttgcactgccttttttaggaatagggcttaaatttaaaacatttaacgattccagtttagaagaaaatggagaaattgtttatgaagctggctacgaacctaactactattggccagtactgactatctgctgctatttaggatacacacaatgcctctacgaaacatccataataaacatggcaggattactaatatccacaacagcatgcttcatatggctaacattccctgacaaaatcaacaaatgtctgccatttgaaaacagaagcaaaaaaggagaagcaatatatttagcaatagcattaatcatattcttcatattactttaccaatttactacaatcccatttacagaacttacaggaattactaattaaaaaaggagaattaaaaaatgaatgcaaaacaaacaatagctatcattatcccaatagctattttcattattaaaaaatatatcagtctttatataactattccagttttaatagccggatgtatcataacatattatttatacgcaaaatctgatgaagataaatacttaagaggtgctctttcactgtacgggttaaatttcttctttatcatacttggtattgtgctatattatatactataaaaagcaatttactgaaaaaatttttatatataaaattagatatgtaaaaaccatgtttaaatttacaagcaatgaagtgagggacttaataatttcatttttcgttatctcactttctttttcaatattgtatacaggtagagatttctctgcaatgtactttatattacctattgtaatggtaggtgtaggtttaggatttattctccatgaacttggacataaattcagtgcaatgcattttggttactggtctgaatatcagctctggccagttggtttgattattgctttagccagttccttttgcggaattgtatttgcagctccaggagcagtttatacttatgcaaatttcttagatgacagaaccaatggtataatatctatagctggaccggtagttaatatagtacttgctattatattcctattaatagctgctgcagtttatccaatggcatttttcagtcaaacaatgcaaatcatattccttgtctgttcacttggatttactattaacagctatttagctacatttaacttgattcctatttggaatttagacggcagtaaagtacttagatggaatggattaatctggattgttacaattgctatttcaggaattatgacttatctttctatgacagtaggtgttgaaggcataataaagattttaataggataatggacaatggaaaatcaagaaataacattttttaaagggacacacagggtaatacctccttcaaaaacaatcgaaaacaatgaaagcaaaacaaaaatagccggaataactcgtataactgaaataacccatttggacagaattggaattcctgttttttcagctatcagacctactgctcaggatggtggaataagcatatatggaggtaaaggaattaccccagaccatgctaaagcttcagctatgatggagggttttgaaagatactctgctgaaaagcaggaaagtgatgaaacttttattgcaactttaaatgaaatagacggaaattatattgatcctatttctctaaatttaccgaaagatttcagcaaagatttgcttgacacaatgaatttggaatggagcatgtcaagagatctgatttctggagaagattactatattccatctaatgctatataccacccttatgttcctgaaaataatgttcagggtttatttaaaggaaataccaatggattagcttccggaaatattttagaagaagctattttacacgggattttcgaagttattgaaagagatgcatggagtatttttgaacttacccataaaaattcaaaacaaatcgaccttgaaagtattgacagtgacagtattaatcaaattcttaataaatacaaagaaaatggaattaacattaagctaatggatttaactgcagatgtgggcgttcctacaatagcttcatctgcagacgatactgttttaaaagatgctggattattgtctttaggtattggaactcatctcaatcccgaaatagctgttttacgtgcccttactgaagtagctcaaagcagagcaacacaaattcagggtgctcgtgaagatactgtaagagctgattttgcacgtaaagctggttatgagcgtatgaaaagaatcaatagccaatattttgaagacgaagaaaataaaatatcttttagtgatattgaagataaaagcaccaattccataaatcaggacattgaaattgttaaagatgaattagcaaaaaacggattagataaaatattatatgctgatttaacacgtcctgaacttggagtaagcgtagttcgtgttgtgattcctacaatggaactctattccctagacaatacccgtgcaggagaccgctgtttaaaattttagattcatatggttaaaataataatttatacgggtttatcactttcatttgatgaagcaaaagaaatattggataatcacgacgatgttgaagttatttataaaaaacccatcaaacgtggagatcttggattggccattaaagaacatcctgacattattggaataattgacggtgtttttcatcagaattctgcagttgcccatagagaaatcctaaaagcaattgatgaaggaataactgttgttggatcatccagtatgggtgccctaagagcttcagaactggatactttaggtatgaaaggaatcggttatgtttatgaacagtatgcaactggaaaagtaacttctgatgatgatgttgcagttatgcttgacagtgaaactttagagcagttatccgagcctttaatcaatatggagtatacatttacaaaagccgtaaaagaaaatatcattactgaagatgaaaagaatgaattgctttccattgccaaatccacattctatccaaaaagaaattatgcacaaacattaaacagttcaaaattagatgatgatacaaagaatcgattagttacctttattcgtttttgcgaggatattaaaaaagaggatgcaaaatctttaataaggtatataacacgtgtgatagaatgaatctagatgaaaaagttgaaaaagtaaaaaacacacttaaaaatcgtaaagttgcaatagctttttccggaggtgcagacagtacattacttgcatatcttgcatctgaagttagtgatgacccaatagctataactattgataatcacatatttcctacaggttttatcaaacactgtaaaaaaacagctaaagaatttggaatcagacatcagattattgatttgaatttctacgaacatgaaaatttactggccaataaatcagacagatgttttgtatgcagagatttaatgtatgggaatattaaaaagtatgctgaaaaaaacggttatgaatctgttttagacggaaataatataagcgatttggttttagatagaccaggaatactaattacatataaaaacaatattgaaagtccttttattcatgccaaattaacttctaaagagattcatgaatacttaaacagacacagtattccattttcaagatcaactacctgtcttggaacccgactgcctaccaacaccagaatgaccagagaaaatattaaacagatcagtgacagtgaagattacatctataaaaaaacagagtgtgaaatcgtcaaagttcgaaataataatgggcttgccctatgtgaagttgacaatttaaataaaatatcaaatgaaaatacattaaaagaaataaacgctaaattaaaatcaataggttttaaaaaagtagctttaaatttatcaaaaattgatgatgatgaaagcattgctgttgactattcagagggtagtttcgaataccagctcccatatacaataaatattgaaaatacaaaaaatcagctaaaagataaagtaatttcaagcgattctaaaaaaatagctgtcaaaaatcagataatctatgaaaacggattaattaaaggtaataacttccagtcagaagaagaatgtttaaataagtttatggaattattgccagatataagaagaaatgtataaaacttatttgtttttcatttcttcatatttttttaaaacaatatcaggcgtttctatatttttatcaaaactttcagcgaatgtgtaatttttttcttcaggattatcagtgtttctaaagccctgaagaactaattgttttccgtcaattttaaagccaacaccatcagcttcaacttcaatcaaattaatttctatttcagatgcatcttcaagttttgcatctgccttaacttcatattttaaatttaagtttttatgaggcattagctcattaatggttctttttataacagattcaaaaagttctaaaaattttacaacaggagggaaatcattggcccagtaataagcaagtactgaattcaagacaatttcatgttcaacataatcatctttaagtcttgctctaacaccaacagaattcccatccataacttttattaccaaaactggattaagagccatatacaccacacttaatccactaaagctttaattaaatcactagctcttacaagccctattaactctccttccacaccaataactggaatttgttcaatatttaatgttttcatttttttagcacagtcagatgctttagttttagaattaactacttcaactttatgtgtaccaacatcttcaacaagcttgtcagtgaattttaaacaatttttctcaatatataaaacagaagtactgtcccaggaccatttatctccttcggttcctactgtagaactgtgttcactacgttctgagataatttctgattcttcaataaaatcagtttcagttaaaatacccactaatttagcagaatcatttaaagctaaaacagatttaagaccgaactgtttcatagtttcaaatgcaacatttagaggagttttataccatgttgttggaactgtagtaatcatgaaattttcaacaggatcatcactttcaagtttaattaatgcattggataccaaatcaaaggaagtgataatacctaccaaatcaccattatcatcaacaacaggaactctcctaacattattatcaatcatttttttagctacatccttaacatcgtcatcaggacttgcagtaaccaaatcagtactcattaaaatagctatttgttcttcatcaggattgacaattaaatctgaacgagttattaatcccactagctgtttagtgtcacctttaacaacaggaagaaccgctttatcttctttcctcattaagtctaaaactttttcacggtttccaggaactgaaacactaacaacatttttagacatagctctttttactaacatgataaacaccttaaaatagtttattaaaaatataaaaaaagggaatgttgaaaaattagtgaataaccaacaccgcacatttagcagcgttaactactttttcagcaacactacccattataaatctgtcaaatccggatttaccagaactaccaataacaatcaaatcaatgtcttcttctttagctacttccaagatagttttagctggtgaaccttccctaataattccatggaattttatacctgaagtttcatccatttcttcaaattcttttatattatcttcagaacgttgcttgagtaattggtttaattgatatacctcatcatccaatggaagcccgttaacaaaattattttcagtaacactaagcgcataaatatcagcaccagtagttttagctaaaaataatgcatgtttttcagctttttgagcaaattctgacccatcagttgggactaatatttttttgtacatgtttccatctcccaagtaatttgactttatgttttatttatatcaaacatttttaatatgaatatctctgttcataatatataatatatctttcgttccacaacgatttataatatttaaataaggattttttgaatattttttagaaataaataagtttgcttcctgattaacatcaataacctgcttttcaatatatcggttaatctcaaaattacagatattggttgttgcagttttcaataaatctttaggattcaagtaatttttgtaataaacagacattatctttaagctgaattccaattccctaaacaaattaggtgaattcaacattaaattgtcgctgcccagcaggggtttgattcctttagaaaacatctcatttaaaggagccacaccaacatttaaagtggcattagctcttggacaaacaacaacatttgaatttttaatcaattccaaatcattatttctcggatttgtacagtgaaccagctgattaaaatcagcatccactcccctttgaatttcagttttattgaaatcccttaaggaatcgtcctgaagatgcattgattcagctacatgaattgaagatattttacctgctttcctacattcagaagttattaaactagctacttcatcactaatctcaccaaatccgcttaatgcaataccgtcagccaattttaaaagtttgcgaatagctattttaacttttctcaaatcaggattttgcccatagaaactatcgtcacggccaagaataacaggagttacaggtaaatttttagaagcctttcttaaaagctcaacacctttaattccgccttcccgataatcaataaaatgagttgtccctgattcgaacatatcccacattgactttttcatagcatcaattatttcgccgtcttcagcattagccagtgctttatgtttaacgccatttggaggtttgaccatttcccccaatgataatccgtaaccttcatccttaattatggaatctccaatatgagtgtggccatttaagaaagttgggcagacaattgaatctgtggcatctataattttaccttcacagacatctttagccatttctataattttgccatcatcaatgacaatgttttcacgaactggagttaaatcctctccctttaatacaatcccatctttaattgttaacattaaaaaaaagttttctaatttgttttatatatagattacctattgaatggaaagttttataaaaatataagaaaatatattattctggtgaagggctatattttaattaatataaatacaacctcaattaacttcaaaaaagaaattagaacactttttatacctcccaaaatatggcctttacgcctttctttaagcataataggaatgattactattaactcacaagaaataagatatctttacagaaatattgtaaaatccggaaatgtgtatcggataaaatataataataaagactatggtgagtttaaaaagttatctgatgctttatatgaaagagacgctcttttttactgtaattttgattatgatttgcttgttgaatcagatttagaaaataaatacgaaaatatgaaattacctccttttcctgaaaaaagacccaaaggccgaatcaaaggaagcaaaataaataaagaggaaagagaaggtaaaattcattttgaccataaaaaacgggaattttttgtacagaaaggagaaactatttttggatactataaaagtatgactgaagcttattactataaaaaaaagctgatggataataactgggatatgaatgctctaaaaacaatgattagcttaagaatagacattgataaaaaattagacttaaataaggaatatcctgttaaattaaattattgtcctaaatgtaggcgtaaattaaaaaataaagaaaaagaatgtccatattgtggaatagacattaaagattatttatataataattaaccttattctccatcaatatgttcatttaaagattttactgtaatttcattattttgaacagcttcaatagcatttaaagcagctctagctccagacaaggtagtaacataaggtataccaagttcaatagctaaacgtctgattatatatccgtcctgagcagactgtttaccttctgaagtgttgataatcagatcaatttccttgtttaaaattgcatccctgatgtttggagatccttgagatacttttttaattttttcaatgtcaacaccctttgccgcatcagcagttccgctagttgctgcaagttcaaaacctaaattagctgctttttcagcaattggacggattttctttttatcctgttcttttacgctgataaagattttaccttcttttggtaaatccatacctgcagcaagctgggatttgtaaaatgccattccaaagttttcatctacaccaatactttcaccagtggatttcatttcaggtccaagtactgtatcggattccggaagttttaagaatgggaaaacagattcttttacagcaacatgatctatttttatttctttagttaaattaaagtcttttaatttagctccagtcataatccatgtagctactttagctaatggcactccaatagctttacttacaaatggaactgtcctacttgcacgaggattagcttcaataatgtaaaccatttcctcatcaagtttaactgcatactgaatattcattaaacctttaacatccaattccaaagctaatttagtactgtattcacgaatagtgttgagaatgtgttcaggaatagtttgcggtggaattacacaagcagaatctccggagtgaacacccgcttcctcaatatgttccataattcctgctataaatacttcctcaccgtcacacaatacatccacatccaattcaatagcatcttcaaggaacttgtctactaaaatcggatgttcaggtgagacttttacagcttctttcatatatttttcaagctcattattgtcataaacaatttccatagcccttccaccaataacatatgacggacgtactaaaacagggaaagtaattctctctgcaatttcacgagcttcttcaaaggaattagctgttccatatggtgcctgatgaatatgcaatttatttaataattttgcaaataattccctgtcttcaacaccatcaatactttcatatggagttcccaatattttaactccagcattagctaatggtactgccaaattaattgaagtttgaccaccaaattgaacaataactccatcaggtttttcctgatcaataatacccatcacatcttcaaaagtgataggttcaaagaacagtttatcagaaatatcataatcagtacttacagtttccggattgttgttgattaaaatagtttcaattccctcatcttttagagcaagtgaggaatgtacacaacagtaatcaaactcaataccctgacctattctgataggacccgcacctaaaataacgattttctttttattggatgatttgagctcgttacctgaatcatatgtactgtaataatatggtgttttagcttcaaattctgcagcacaggtatcaaccattttataggactgttttatattgaatctgttaagtaagtttctaatgtattcttcagtctgattagatagggcggctaatcttttgtttgaacatcccatctgtttagcttttctcaggaagtcagcatcgtttaatttttcttctgtaacttcattttcaaaattaacaatgtttctgattttgtataggaaaaatttgtcaatattggttaatttctgaatcttatccaaatccattccgtctttaatggctgaatataactggaataatcgctcatcagtcggattggccaaatcatcttcagtgtattcaacatattcaaatccgtcatgacccatatcaagtgatctgatagctttttgaattgcttcttcaaatgttctaccgattgccattacttcaccggtagctttcatttgaactcctatttcacggttgattcctctgaatttatcaaatggccatcttgggatttttacaactacataatcaatagccggttcaaaggaagcaggtgtttctttagtaatatcatttttaatttcatctaaagtcattcccaaagctattttagaagaaattttagctataggataacctgttgctttagatgcaagtgcactacttctacttacccttggatttacttcaattaccttgtattctccggtttccggattaactgcaaattgaatattacatcctccctgaatacctaaagctctgataattttaatggaagcatctcttaatgcctgtgaatccctatcatttaaattttgagcaggagctacaacaacactttcaccagtgtggattcccatagggtctatgttttccatgttacatacaatgatacaagtgtcttctttatccctcattacttcatattcgaattctttccaacctaaaacagattcgtcaataagaacctggttaatgaaactcatatccaatccatgagtagctatttcaattaattcttcttcattgtaagctactccaccaccggttcctccaagtgtaaatgcaggtcttacaattactggataaccaatgtcttttactgcttctatagcttcttcaacactttctacagcatgacattttggaataggttcgttaagtttatccatgaaatgaccgaacaaatcacggtcttccacatctttaattgtctgaatatcagaacctaaaactttaattccgtcaagtaaacctaaatctccaagtcctgtagctatatttaatcctgtttgtccacccatagtcggtaaaattgcatcgacattttcttttttaataatttctgagacaatttcaggagttaatggttcggtataaacagtatctgccatatccatatcagtttgaatagtagcaggattactgttaacaaggacagtttcaattccctcttctcttagtgatttacatgcttgtgaaccagaataatcaaattctgctgcttgaccaatttgaataggtccagaaccgattattaatacttttttaatatccttatcaataggcattttgtaatcctcattaatttttattataaaatggtaatcttaatattcatccatcatttgactaaatttatcaaaaacatatcttgtatcatttggaccaggtcctgcttcaggatggtactgaatacagtgaacaggcaattccttatgtgaaaaaccttcaggagttccatcattaagatttacttgagttaaaactaagtcagtctcattaatagactctttatcaatagtaaatccgtgattttgagaagtgatatatactttacctgtcttcaaatcttttaccggctgatttgcccctctgtgtccaaatttcattttgtaagatctggctccaaaagatttagctactaactgctgacccatacaaattccaaaaataggtaatctttcagataatttttgaactgtgctgatagtttcatgtaccctatcaggatttcctggtcctgaagtaatcatcaaaccgtcaggagagtaattcaaaatagttttataatcagtatcatatgggaacaaaacaactcctattccacgttccaaaaagttgtttataatatttttcttaacaccgcagtcaattaaagctacttttttgttggcatcctcattgaaaactttaatttctttagtagatacctgcggcacaacgtcaatatcaataatgctttgttgagcacgtgcaagttctattaattcactgtcaggaatgtcttcagttgaaatagctgctttcattgaaccttcttcacgaattttaagagttaaatcacgtgtgtcgattccactaattccaggagtttcaaattcatttaaaaaatcatctaaagttttttgtgatgaaaaattagaaacttctctgcaaacttcccttacaacaaaaccttcagcttgaattttatctgactgataccattcttcacttaccccataatttccctctaaaggataagtagacattaatatttctcctttaaaagaaggatcagttaaagattcagtataaccaaccataccagttgaaaaaacaagttcccctaccttagtagtttcataaccgaaaccatcaccttttaaaactgtaccatcttccaaagctaatttagccatttttaccattaaatcaccattgtaaaaaaaataataatcatctatctttaataattatgatttttatatattattaaatttatcattttttagcccaaaatactgcaaaaacataatatttataaggaattccaacacggtcaaaacctgcattttttaaacattccaactgaaaatccacagagctgggtttatcataagttctcctaattttagcctctccataagctttctcactaatttcaccagtatgttcatcaagttttgatttaaaataatcttcaacacctttattaggatttaaaacctgatctgcattgacaaagtttccaccatcatttaataaatcataatacttttcaattaaaactttcttttccgttccagtcaaatgatgaatggaaagagaagatatgattatatcaaactttgtgttgaattcatgagttatataatcgtcacatataaatgaaatattatcatttccttcaaatcttttttcggcctcttttagcattttctcagccaggtcaataaggacaatttctgcatttggatatttttcaagcaaaaattgagataaaataccagttccagcacctaaatctaaaactttcggattatctcctttaaaatcaatacaatcaatagctattccataaaaatcatcaaaacatggtattaaagctcttctttcactatcatattctttagctttttggttgaacttatttacaacagacattctttaatcctctagtattcttaaagaaaagtttaaacttctgcttgaatgagtcagagcaccaagagaaattatatcaattcccaatttagcataatccacaatattttcagcagtgattcctccagaaacttcaattaaagaattgtcacgaatatttaatttgattaactcttctaaaacttcttcaacttctttaggagacatgttatccaacattacaatatctgctttattttcaacacaatcaaccgcatcttttagggattcaacttctatttcaatttttttagaaaagctaacattttctttagcttttaaaagtgtttccaaaggagttccaacactggctatgtgattatccttaatcaacaccatatcatcaagggagaatctgtgtgtatctacaccgcctatttttaatgcctgtttatcgaattttccaatagctggcagtgttttacgtgttcctgcaattattacatcataatcatttaccaaattaacataatagtcagcggcactggctacaccactcattctcatgagcagatttagtgcagaacgttcaagcaacaatattgtccttgcatcaccttttaaacacattaacaaatcatttttagctattttagttccatcttttaagttaaaaattacttggacatttttagactcaaacatttccttaatgatatcaatacctgccaaaataccttcatctttagaaataatatgagcagttacagttttatcttcatcaactactgcttcagatgtaatatctccaaaaccttcatcttcttcaagcatgtattcaattattctatccaaaaaatcaccaaaattttaaattatatgttgatatatatttttattataattaatataagtgattaaatggaaattacatttttaggaacatcttcagcagttcattcatatacaagaaaccacccggggataattttaaaagcctttggtgaagttatgttgtttgattgcggagaatccacccaaagacagctgatatatgcaaagataagtccgatgaaaatatccaagattttcattagccattatcatggagatcatatattgggccttccaggacttctgcaatccctgaatttcagaggaagagaaaaaccattaacaatatatgggccaaaaggtcttaaaaaagttgaaaatgcaatatattcattaggttattgcaaatttgattttccgattgaatttatagaaatcagcagcggaacaatacttgaaactgatgaatatatccttaaatcccaggaagttatgcataatgtaaccaaccttgcatattcaatagaagaaaagaaaaaaccaagatttttgagaaataaagctattgaacttggtgttcccgtaggccctctttttggaaaattgcacaatggtgaagaagttgaagtaaacggaaaaatcataaagcccgaacaagttcttggagatgcccgaaaaggaataaaaatcacatactccggagataccagaccatgtgaagaaatgattgaatttgcaaaaaacagtactttgctaatccatgagtcaacatacacgcttgaagatgatgataaagctagagaaaatttccattcaacatcacaggatgctgctacaatagccaaatgttccaacactaaacgattagtattaactcacatcagtaccagatatactgacacagaggatttattaaaggaagctaaaaaagtttttgaaaatgttgaagttgcagacgatttaatgacaatagaaattttaagtgcataatatgaatattatagatatgttagaagaccctatttcaaaaataatcattattttattaattataattactacaagcattattgtaagacttgtagcttatttaatgaataaaatgaagagatttaaaaaagacattactttgatttatcttatcagagacattataaattatataatttatttcatagcattaatgtccatattgcaaatatttgatataaatctggcaggaacattattaagtttaggaattgtaggtattgctgtgagttttgcagctaaagatctcatatccaatttcttttcaggaatcttgttaataatgggcagaagtgtcaaagtcggagatactcttgaaatcaaagaaatgaaaggaactgtagaaacaataagcctcaggtcaacaactatcagagatgacaatggagtgttaagtaatattccaaattccatactaaccaacaatacttatttacaatataacaaaaaagaaagacacagagtaaatctgattgttggaatagatttaaatatagacattgaagaatttaaaatacatattttagattttataaacggacaggaaggtattttaaaaaatccaaaagctcaagttttttcaaaaggcattaattttgaagaaagcacactgaaaatatccttttggataaaagactttaataaaaaagaaaaatataagttaattattactaatgaaattagaaagtatgttaacaacaggtgaaataatgagtgggtctttacaagatgaaattaaacaattgaaagatgaaaaaaatgcaataattcttgcacataattatcagcctaaagaaattcaagaaatagctgatttccttggagattcattagaattatgtatgaaagctgccgaaatagaagataaagacttagttattttctgtggagtagactttatggctgaaacagcttatatcttaaatccggataaaaaaatcgtaattccagatttggaggcagaatgtcctatggcacatatgttaccggaagacgaattattaaaagcaaaagaagaacatcctgatgcaggagtaattctttatgtaaacagtattgctgaagccaaacaacacgcagacacattatgtacttcagctaatgcactaaaagttactgaaagtttacctcaagatgaaatactctttggaccggataacaatttaggcaacaatgtagctaaacaaacttccaaagaaattatacctgttccaaaaggcggacactgttatgttcataaactattccatattgaagatgttgaattaaaaagaaaacagcacccagatgcggaaataatttgccatccagaatgtaatatggatgttcaggaagcatgtgacaaagtcctttcaactggcggaatgttaaaatatattgctcaaagcgacaaaagggaatttgtaattggtactgaaattgatatgattaccagacttgaaagtgaaattccaggtaaaaaattatatcctttacttgaaggagctatctgcagcactatgaaattacatactttagaaaaagtaagaaatgcacttaaaaacgaagaacctcaagtaactgttccaaaagaaatagctgaaaaatccttaaaagctacccaacacatgttaaaagtatcaaaatagctggaataactctagctacttgaaaactttttttaatccatatcttctaaaaaactagataaaaatattgccatttcaatttcttctcttgaaataaaatcttcaactttgattttggattctctgctttgaaatgggaaaaactcttttttaaattttgtttttaatatcaaattatcatttgtgatttgtgtttcgtcatcaagattattatttaaaaattccaattgattttgggataatccacttatgttatagctaataaatcccccatcagcattttctccataatctacaatcctaacatccataccatcacctgaaatttttcataaattcggacaattcttcttcaattgtttcaagttctcgaaatccgatatgacccaaattagaatcataaataatcaattcagaatcttcaattaaattatgcattggaattgcatctaaatttggagggaaatactggtcctgatttattccaattattaaaactttagatcttattttattcaaatccttttcaatatcataatccagagttgcgtcattacaatatttaacatcaaaaatgctgtcaagcaatccttcatctccaaattcatcaaattccacatccaattgactattcggaattttatgaagagcttcctttgaaattccgaaactgtaaaccgcctgagtagccagtcttagggttctaactaatgaagaagtattttttccagaatcataatccccgtcagttgaaataatctcatcaactaattttgataaaatataattgcgtcccgctactttataaccgcttgctccggaaataatgaaatccgcatagtcaggatatagaactgcacatgtcaaagctacaaaaccccccatggagttcccaataatccccctaacatgagttattccgaatttgtcttttaagaacttattttgaaaattaaccatatcttcaatactatactttggaaatgaattatttaaattagttgttgatgggctacatgaacctggagcacctaattcagaaagcgaaataataaagaattcatttttatcaaaaggacctccagtataagataaaggacataatttgctaactgaagcataatttcccaaagaaccatgacagtatacaatagcattattaatacaaccgttatcatcatattttggagttccaaaggtcatatactctacagaaacattatttaatacatctccactttggaatttgaaagaatccataatatattcttcacgctttgaaataaaataatcatctaaatccatgataataatttccataataaaatatttaaactaaactacagtaatcttattttaatgaaatataaaatactagagaacccaaattgtgaagatgcttacggtttaatagaagaagcattaagaaaaagagctacaattacaatatatgcctgctgtaaagtcaattatgagggaagagcattaagtgaattgaattggggagaacgtataatcctaataaaaccagacggttcatttttaatacatcaggaaaaaaaagtagagcctgtaaattggcaacctccaaaatccaaaacaagaggatatatccaggacaataacttaattttagaaagccacagaagaacacctaaagaattattaactgttgaaattagaaaagtccaatacataacttatgcaaacattgaagactttgaagaacttgaacaggcaggttatgaaaaagatatgggagacatgattatggaaaaaccccatatgattgaagaaggcttcaagccaacagcaagagaatacagtgttgaacacggttttatagacattttaggaaaagattgtgataacaacctgatgattttggaattaaaagcacgtaaagcaggagtaagtgctgtaaaacaactgaaaagatatcttactgattttgaagatgatgacaatgattatttaaaagaatgtcttgtccaaaaaaagaaaatcagaggtttgcttgtagcaccatcacttggagaagatgctaaagaattaatagaaaaagaaggcattgagtttgtagcggtaaatcctccaaaagaattaaaaagagataaaaaagtaacattggatgctttttaacttaaagacttttcaattctttttaattcatcaacataatattttttagtatgcaaattagcaggaattgaattggttacatgacactctttttccaatttgaaaataagataatcttcagtatctaaagaaacagaaccatcatcacttaataattctaaattatccaattcttcaagaatactttcatattctttttgttctaaagcaataacatcatccaaatccattttttgtattttaggatttagctgtaaagcaatagctacaaatccgttaacagttttattatcaatgtcaaattcagattttctaatttcctccatacttagtttaacatgatgtaatgtagcattagtaacaggaatttctctagacaatccaatttgatttatttcataatgatttttccaagtaccaactttataaattgcataatttatgttatcaaagtttataatttcaggttttgccatactatcacacttacatattatttatatccactgattaaaaaacatttagttttaaatattataaataataaaagttaaatttaatggaggttaggctgtgaaaaaatgtcccgaatgtggaaatcctagttacgatggtgcacctgcatgtgggaactgtggatataaatttccaaaaatgaaaccctcagctcctaaaaaggaaatatttgataaagctcctgaaaaaaagaaaaaacaatttagcgacgaagaaagtacaattgaaatcattaaagaaaacaaaattctcattggagcaattatacttattacaataatcgtcatctgcggaattgtcatcacaggaccaaacaataataaccaaactgcacaaagtggagatatggttaaattttctgaagcaggattttctttcagctatccaagcagttggaatgaagtaaatggaactgacagcgaccatgaaggttccgtcttctttaaaaacgaaaatggcactattatccaatattataatgtatctaatgattccacatcattaaaagatataactcaagatagaattagttatgctcaggaaaatggaaattatatagatacagttcagacaataacattagatggtagaaacgcttcagacgtaattttagaacaatcaaatggaaattacaccagatatgtatcattattcagcaatggagaattatatgtatttaaaataagtggcgattcattaaattccattaattctagtgatattaatactgtacttcaaaccgcagatattgcataagtatgaattatttcatacttttttctattttttaaagtgtttaatatgaaaattaaaattgcactatgtcagattaatgtagttgacaataaagaaaaaaacattgaaaatgccacatctatgattttaaaagcagttaaacagaatgctgattttattgttcttcccgaaatgtttaattgcccatattccaatgaaaagttcatagaatactgtgaagaagaaacacatagcccaacattatccaaaatagccaaattagctaatgaaaataatacatatattttagcaggatccattcctgaaaaggaaggctcaaaaatctttaacaccagctatttatttgataaaaacggtgaaataatagccaaacatcaaaaaatgcacctatttgatattgatgttaaaggaaaaatttattttaaggaatcagacacattaagttccggaaataaagttacaatagccaaaacagactttggaaaagtaggtatcggaatctgttatgatattcgttttcctgaactggctaaactaatggcagaagccggagctcaaattctgttttatcccggagcatttaacatgacaacaggtcctgcccattgggaacttacattcagatccagagctttggataatcaggtttattgtgttggtgttgcacctgcactaaataaagatgcaagctatcacagttacggccattcaattattgcaaatccatggggtgaagtgattgtccagctggatgaacaggaaaacatggaaatagcagaaatagatttagaggaaataaaaaaagtaagaacagaacttcctcttttaaaaaacaaaagaagtgatttatataagattaacttaatttagctaatcttttttcaaaccaatcttcttttcccggttttttcttagataaaacttcaatagccttatttaaaattctgatttcattttccaaatcattgttctttctataaagaatacataatcttttataaggagcatcttttggctgttcttcagttacatactgttcatattctttaatagctttttgaacattggttttttccatttccttaattgtactcattggttttacttttgataaagttttaccagatgcttttgcttttttagccttatctgcttttttaagagccttgttacatgattttttaaagtctttatctttttccttacgtcttgcatctttaattaaatcaatggattcgtcagaagctaaatcccccaatgcataaatagtagctaaacggacaccccagtcttcatcttcaagtcctttagctattgtatataattcatcatgtgcctgaagctcccctaaagcccttattgctgtttttcttactccaaaatcatcatcctctacagcacctgcaaaataaggaataactttttcatccttagtttctttaagagcaaatgttaaaaaacgtttatttttaccttctgatgcctcaaatttttcaattaatttatccctggcaacttcccccatgttacctaaaatttcagctgctttaaatcttatttgagcattatcatcagtagttgcttcaattaatggatcaatagcttcaatgtcagttacaccaatcaaagcattgaccgcttcctttcttacacttacatcatcatctgagagattatcaatagcttcctttaaaattaaatcagacattttatatctcctaaaagtttaaaacttatattaataataaattagttttagtaaatatataatctttaagataaaagttgagataaaaatgataactgagcaaacaaaaagctattcaaaaaaacaaatatacaaaaccctacatccatgggttagacaatggttcgatgaaactttcgaagattttactccagctcagaaaaagtcaattgtagacattcacaaaggaaacaatattttggtttcatcacctacaggatcaggaaaaacattaactgcttttttatcaatacttagtgaactaacaactctttcccagaaaggtgaacttgaagataaagtttattgcatttatatttcaccactgaaagctttggataatgatattgaaaaaaatctggaggaacctcttaaaggcattgaaaaaattgcaggaaaggatttgggaatcagaaaggccgtccgaacaggtgacactacccaatatcaaagacagaaaatgcttaaaaagcccccacacatcctaattaccacccctgaaactttatccattttactggtagcaccaaagtttagggaaaaattaagcaatgtgaaatatgttataattgatgaaatacattcacttgctgaaaataaacgtggtgtacatctaagtttatcacttgagcgtttacaacatttaattggacaatatacaagaattggactttcagctactgtcagccctcttgaagaagtcgccaaattccttgtaggttatgaatacggagttgagcgggattgtaaaatcatcaatataaattaccttaaagacctggatataaaagttctatgtcctgttagtgacattatgctggcagatagtgaggatacccgacttggaacatataacttattggatgacctgattcaggaaaataaaaccacccttgtctttacaaatacaagaagtggaactgaacgttttgtctacaatcttaaaaaaatgtttccaaaaaactataatgatgaaaatataatggcccatcactcttcactttcaaaagaggttcgtctagcaactgaaaacaaattaaaagaaggaaaacttaaagtcgtagtttcatcaacatcactggaattgggaatagatataggatatattgatttggttgttcttattaactctccaaaatccgtttcaagagctcttcaaagaatcggaagaagcggacacaaattaaatgaaaaatccaccggaagaattattgtaacaaatcgtgatgatctggttgaatgttctgttttgttaaaagatgccaaagaaggtaaaattgataaaataaacattcctcaaaattgtttagatgttctggcccagcacatttatggaatgagtattgaaaatccctgggacatcgattacgcatatgatgtaatcagaaaaagctattgctacaaaaatttaaccagagatgattatgaagatgttttaagctatatggctggagaatatgaagagcttgaagagagatatgtttatgctaaaatctggatagattataaggaaaacaccttcggcaaacgtggaaaactagccagaatgttatattcaacaaatatcggaacaattcccgacagctcaggagttttagttaaatgtgacggtgaaactgtcggaaaaatagaagaggactttatggaaagactgaaaaaaggagacacttttgttttaggcggacagacataccgtttcaattatggaaaaggaatgacaataaatgtttcaccggctaatggccctccaacaattccttcctggttttcacagcaattaccattatcttttgacttggctatggatattcaaagattcagagcacatatggatgccaaattcagatacggcaaaagcaaacaggaaattatggagttcatatacgattacttatatgtagatgactttgcagccaattcaatttatgaatactttgtagaacagtacacatatgcaaaaatacctagcaatcagaggttattgattgaatactataagggatttggtgacaggcgttttgtaatattccacagcttatttgggagaaaggtaaatgatgcactttcaagagcagtagcttacattgttgcaagacagtacaatacaaatgttacaatatccatctcagacaacggattttacttaagtgcagaaggaacccttggagggctggaagcatttaaacagctaactccagaaaactttaaaaatatcctaacacaatcattaaataaaaccgaaacattagccagcagattcagacattgtgccggcagatcactaatgacccttagacactataaaggagaggcaaaatctgttggtcgccaacaggtgagaggaaaaatattgcttaaatttgttcaggaaatggataatgacttttcaatcctaaaagaagctagaagagaagcattggaagattatatggatgtcaataatgctcttaaagttattgaactaatagctaacgggcaaatggaaattaaaacgataaatacaattatcccaaccccatttgcatttaatttagtttcacaagggtatttggatgtattaaaccagaatgataaagcggaatttacaaaaagaatgcacaaagctgttttagagcagataaaagaaaaattaaaagaaagtgatttataaaaagtggtaatatgaaaacattattagtatattattccagaacacaaataaccgaaaaaatagctaaaaccattcaaaaagacctggattgtgatattgaagaaatcacagttggagacaaatatgacggaactataggatacataaaaggaggatttgatgcaagtgcaaacagagtctgtgaaattaacaaggtaactaaaaatcccaaagattacgatttagttataattggaactcctgtctgggcagctacaatggcaacaccaatatacagctatttaaaagaatatggcaatcaaatcaaaaatctggccagtttttgtacatgcggaggcagcggatatgaaaaaaccttaaagaaaatagctaaaataaccggcaaaactccaatagctacaatgtatctgacaaaaaatgaaattgaaaatcctgaagaaaacataaataactttgaaaacaaaattaataacaggtgataaaaatgactaaatggggaccagtatttcttggttttatccttgcagtaattgtaaaatcattctttgcacattatgaatttataggattactccttgttggatttatagtaggatatttatgccgtgacggagcaataagcggaatgtggaatgcagcagttgccggtgcattcggaaccatagtatctgcaatattatttgttataattgctacctttggaggagctctatttggaatcttcggaggtttagttggatttacagtatccggaattacaacagtctttatagttttaggatatttaatatactatgcaatagtcatgggtattgctggcggtgttggaggattaatttcttctaaaaaataaggggaaaaatatatggattttaaaaattttattgattggaaatcatttataatgggagccgcatttgcttcatttatctgtgttgttgcatcacagtaccaattagattggttatatgcatttgcagctattggtttactttatgttggttataaagctaaaaatatgaaatggggagctattttaggtgcaatagcagcaactccattatttgtacttgcagcatatggtgttttcggacctctttcagacagttcttttgatccgcaagtaagtatgtttgttacacttattgctgttctcatggttggagcattagttggttttgttggagcatacacttacagaaataggcaaagagcaattgctgcaaaggaaaaacaagcaaaaacaggtaaaaataaaaaaggaaaaaaataattttaagttattattttttccaattcttcttttttaattgcatttttaatttcaagggcaattcttctacccatactcataggttttccataagttaaatagctgtaaggtgaacctcccataaaagtattagttccaccatcggttctagcacttatttcaaaacagattacttctaaattatcatttactaaagtttgcatacagaacgggccgtttaatccaggagcaacaagttttttagcactttccactaatttatccgccatttcaaatacttgaggaagtaaagattctctgataactgcaggatgattacctgtaaccacataagatgggcttaaatcaatatctaactggtctttagcaggcattcttacaaaaccgtcaatactggattcatatcttgtatccatacctaacaattcaacttcatcttccaaagcggaatagaaataatgtatacagtaattacatccggaaacatattcttcaatatgtgcattagctacatctgagtcttccagccatccgcgagctttcatggcatctatttttttattgaattcttcaggagatgatgctacaaaataacctcttcctccccttgcaccagggaatttaaccataaccggacggtcaatttctgaaggattatcatatttgtaaggtattcttacttcaccttcaacaagaagtgctctttctttgtctctttcagcttcccatcttaaaatatccctattaccaaacataggaacattaaatttatcttcaacattgtcaagacctgcatatgctacaaatgaaccgtgaggtataacaatagcattcatgtctcttagcttttgctgaacatcctcattgacaatgtctttaaatttgtcaacgattatatattcatctgcaacatcaaaacgttgatatggtacttctcttcctttttcacaaacaatagctgttctaaaaccttcttcttttgcaccttgtagaatatgcaaggaagtgtggcttccaagagtagctatggttatattgtctttgtcgtaattgtctaatatctcaaaaatatcttcaagtttaacttctcccattttaatatctcctcaaagaattgatgtataataatatatatttaagatattataaccctttttgtttttaaaaaaaagattgaacagaacagttaatttttaaaaaaacaattaacaaaaattcaatcaaatgttaaaaacaaatattaaaaaggataactgataaaataataaattagaaatttttaaatcatgagatgaactttatgctaatcggattaatatcagatacacatattccagacagagctagagaacttcctaaaaatgtaatatcctcatttgaaaatgttgatttgatattgcatgcaggagatttaacttccacaaaagtaattgatgaattgaaaaaaatagctccaacaatagctattcagggaaatatggatagggcagctggaataatgttgcctaatgcaaaagttatcgaagctgaaggattgaaaatcggaattgctcatggagaagtatatccaagagcagatacacaacaattactttatttggcaaaacagttagacgcagatattttagttacaggacattcccaccagccaaaaatagaacagattgacggagttttattattgaatcctggaagtcctgttgttccaagacttgcagacagaactgtaatgttacttgaaattaataataaagaggttgatgtggaagttattaaaattggaaatcctgtgtgcagtacattagatttagacaaatttaaaggagaatgaaaaatgggcagtcgttggcaaatggaaaaaaaacatgatccatattacaaaaaagctaaaaaagaagattatcgttcaagagcatcatataaaatcaaacagttagacaaaaaattcaaacttattaaagaaggagataccgttgtagatcttggagcagctccaggaggatggtcccaggtagctttagaaaaagttggagaagaaggtcttgtaatcggagtggatttaaacagaataaaacctttccctgaagaaaatttccatggaatcagaggagattttacaactacagaagttcaggaaaaagttatgaatttaattggaggaaaagctaaagtcgtaatttctgatgcgtcaccatcattatgcggaattaaaaatattgaccagttaagatcaattgatttgacaaacacagttattggaattgctgataatattttagagcctaaaggaaacttagttatgaaagtatttcaaggtcccgaatataaagacatgctaaccagacttaaaaagaaatacaggcaagtaaaaacaacaaaacctccatcatcccgtaaaaaaagctcagaaatgtatgttgtgggattagactttaaacctaaaaaaaataaaaaaagtaaagattaaagattattgtatgctacagtagcattctgtaatttttccttagcaaaatctattctactatcaacttcgtttgatgacttgcctgaatccagtgcactttgaacattttgaatagcggaatcagcttttgttaattccaatcttgcatcattatatttttgaacctgagctgtgtccccattatcataatacaaagattttacaccatcaaattgtgattccaaatcactatatgaagattttagctccgcaagttcatcatattgattaccagaagaaatttcattagtaattcctgatgaaacaatactaaatccaacatatgccacaacaacaattgttgaaataatcattataattccaacaacagaaataagcatggatgtggatttaaataaatttaatctagattttctcatattatcctcattttattaaataaaaaaactatctaataatttaataatatttttacttgtttttagtatataatattttacttgccaaatgctcaatacaatattttttaaagtatgaaaaattaataatattttaatgaatgctagtacaaaatcacgaacatctgttgcaaaatttgaggaatttttcgctacaacatacaaagatgatgtatttgaaatccttgaaaaatatcctgatgaaaggtcacttactgtagattacaatgatttagaaatgtttgaccctgatttggcagatttattaattgaaaaacctgaagaagttattgaagcatccaaaagtgcaataaaaaatattgaccctttagtaaaagatgctgatatcaatattcgttttgaaaatctttctaatataattcctttaaaaaccctattaagtaagtacattgggacatttgtcgctgcagatggaattgtaagaaaaacagatgaaataagacctagaattgaaactggtgtctttgaatgtagaggatgtatgagactgcatgaagtagagcaacgttccgacagcagaattatagagccttctttatgtagtgaatgtggtggaagatcatttagattgctgcaggaggaatcaaaatacattgatactcaaacagcaagaatgcaggaaccattggagaatttatctggaggaactgaacctaaacagatgttaatggttttggaagatgatttagtagaccaattaaatcccggagataaagtaagaattacaggaactttaaaaacattcagagaagagcgcagcggcaaattcaaaaactacatttatgtaaatcatatcgaacctttagagcaggaatttgaagaattgcagcttacagaagaagacgaggcaaaaatcattgaactttctaaagacccggacatttatgaaaaaatcatcaaatcaactgccccatcaatcagaggttatagagatgtaaaagaagctattgctcttcaattatttggtggtgctgcaaaagagcttgaagatgaaactagattaagaggagatattcatattttaatcgtcggggacccaggtatcggtaaatcccaaatgcttaaatacgtttcaaaattagctccaagaagtatttacaccagtggtaaaggtacaacaggagcagggttaactgcagcagcagttagagatgaattaggcggatggtctcttgaagcaggtgcattagtacttggggaccagggtaatgtatgtgttgacgaactggacaaaatgaggtcagaagaccgttcagcacttcacgaggcactggaacaacaaactgtaagtattgctaaagcaggaatcatggctactttaaattcaagatgttcagttctcgcagcagctaaccctaaattcggaagatttgacagattcaaaatacttgcagaacaaattgatttgccttccccaattttatctcgtttcgatttaatatttgttgttgaagataaaccaagtgtaaaaggagattcagaacttgcacagcacattctccaaatacaccagcaaaatactgtaaattatgaaattgaacctgaattactcaggaaatatattgcatatgcccgtaaaaatgtaaatccgaaacttactgatgaagcaaacatggttttaaaagagttttatgtaagtacaagaaacagttcaggtgatgaagaatccccagttccaattactgcaaggcaattagaagctatcattcgtttagctgaagctagtgctaaaataagactaaaagacacagtagataaagaagatgcacaaaaagccgtgagactgcaattagcttgtcttaaagaagtcggtgttgatccagaaaccggagaaatagacattgataaagtagaaggaagaacacctaaatcagacagagacaaattgcaaagaatcatttctgaaattgaaatacttgaagaagaatatgccggacaagctccaatgaatgttttagtatccaatatgagtgataaatacgacatgagtgaagaaaaagtagatgaaatggttagaaacttaaaacacaaaggagtaatctacgaaccaacaaacggttatctcaaaagagcataaccttctttttttattttatattttttaatcaaataggataacttaataaatgattaaaatcaaaattaatatattatatttatactaattttacggagcgataatatggaagaatacgaaaatttattaaatagagcaatagaccaattacctcctgaagtatttgaacacaaaagatttaaaattcctaaagcttattcagatatacaaggtaacagaacttttataaaaaactttaaagatgttgctgaagatttaaacagagatccacaacatgtattaaaatttttattaagagaattaggtactgcaggtaatttagaaggatcaagagcaattttacaaggtaaatttacacattacttaatcaacgaaagattagaagattatgttgaaaaatatgttatttgccatgaatgtaacaggccagatactaaaattatcagagaagataggatattcatattaaaatgtgctgcatgtggtgctaaagctccattaaaaccattataatcctatttaacttatttttaatgatttttatgttttgtgtagaatgtggaagtactgataaaaaaatggttggagatatttgcattgactgctttttaaaagactttcaaatgattgaaatcccagaaaatattaaagtagaaatctgcagccactgtaacagtagaatcgaagaaggaaaatggacagattcatttttacctgaagatgaaataatttatcgtgctttagagcgaaacattaaaatcagcaatcttgttgaaaatgaaattatcaatcttgaaatcgaccaaataaaaggaacaatagccaattgttatgtggaagttgttggagaagtttacggagttcagcttgatgaaactcatgacacttcagtaagaataatgaaaacagtttgtccaacatgcagtaaacttcaggcaggctattacgaatcggttgttcagtttagagcaaacaacagagatataaaagcagaagaatatgataaagctgatgaagttgttaaaagaactttaaataagcaaagcaaaagcgacaagcttgcttactgcccacaaatagctaaactaaaagaaggttacgattattatattggatcattaaaatccggcagaaaagtagctgaaagcttaaaagaagaatttggaggaattattaaagaatctccaagacttatcagtgaagacaaatctactggaaaaggtctttatagaatttggatttcaattagaattccggaatttgaaataaatgattttatcaaacatgagggcaaaatactgcaggtaaaagatattgataaaaatagagttgttggaatagatatcactgaccataaaagacacacaatacctttaaaagaaagtgaagatataacacttcttaaaaaggctgatgaaattgaaacaacaacaataatatcaaaatccccaagcaacattcaaattttagaccctgcagattattctgctgttgatttggatatgatggatgaatttaaagattccaatattggtgacgaagttaaaattattaaaattaacaattacatttatttgattaagtgattaagatgagcattgaagaaaaaattcaattaattgaaaaaggaacattagaagttatagatactgaagaattaaaagaagttcttaaaaaagaacaacctatagcttacacaggatatgaaccttcaggtaaaattcatttaggccatgcagtaacagtacaaaaacttaaaacccttcaaaaattaggttttaaaattaaaatacttcttgcagatttccatgcttttttaaatggaaaaggaagcattgaagaaattgctgaaactgcagagtacaacatgaaatgtttcaaagcattaggtttagatgaaactactgaattcatattaggttcaagtttccaattaaacgaagattatgcatctaaagtttataaattagctaccctgactactttgaaaagagctagaagaagtatggatcaagtaagccgtcatgatgaaaatccgaaagtggctagtgtagtttatccaattatgcaaactgtagatatggttgctttagatgtagatgttgctcttggaggaatggagcaaaggaaaattcaaatgctcgcacgtgaaaacttagagaaaattgatgaaaaagttcctgtctgtattcacactccattgttacatggtcttgacggagatgctaaaatgtcttcaagtaaaggaaattacattgctgttgacgattcagttgaagaaattactaaaaaaatcaaaaaaagctattgtcctcagggagaaactgaaggaaatccgatgattgaaatagctgaaacattcgtatatccaaaccaggaaactttacttattaaaaggcctgaaaaattcggaggagacattgaacttacacatgaacagttaattaatgatttctcaaatggagacttacatccaatggatttgaaaaacggaattaaagatttcttaattgaacactttgctcctgtaagagaatatatggaggaataaacaatggatgaaaaacaggaatttgaaatgggtttacttaatggtgtaggagaacagatgcttgctcatactatcgaaaagttcgatgtaaaattagaacatactgaattcggacctaaacttataggaacttatgaagaacttgaaaaagctaaagttttcttatacgaagctattgaagccagattaaatcaattagaaggtaaaaaataaaatttaccttttaattaaaatttaattaaaaaaatataaataacattttattttataaaagccaaataaaagcacataattaataaaactctcatttttcaaataaaagaaaaataagctactaattttaactatttttaataaacacctgctctaattaaaatatattaattttaaaacaaataatttcatttaatttaaaaacaaatccaatatattaaattaaattaaaaaatcaagccaattaatttatatacttttaatgattattattaaccatctgaggtgatactatgaaaaggtatacaaaaatggagtacgaaaatcctgatgaaatgacctttggattttcaaaacatcctgttaaaacaaaaaatggattagaaatcggagcaggttatgttaatccgataatcaaagttgctccaaaagaaggaagtgaaaattcaaaagacaccatggtatcagaatgtagaaatattgcaataagtgcttgtcaaagagcagtgaatattggactgccttcatttatcttagaacaggaacatattgcacaacaaactgcaaatcctgattgggcaggagagtgtactcaggcacaagtagaagttcttgaaaaatttcaagacgaatatggaattaaaactgcacttaaagctactcctgcagatatcagagatgaagcaaaaggagaaaattatagaacttcctcccagtatcagcaagtaatggaaagtatagaacaatgctgtgaaaatggagcatcaataatctgcattgaaacaacaggaggaaaatctgtttcagattacggaatatcccgaggagacccaagagcaatattatttggaattggagttttaggcagcatagatatggaattcatgtggacaaaaattgtaaaaatctgcagcaaacacaatgtaattccaggaggagacactaactgttcacaatcaaatactgcaatgtttctagcaggaggattgttagataaagactgttcccatacattagcagcaatagccagagctattggagcatgtaacagtttggttgctgtagaatgtggtgcaaaaggacctcttaaagactgcggttatgaaaaccctattgtaaaatcaataagtggagttcctattgcaacagaaggtaaaaatgctgtttgtgcacactctgatttaatgggaaatttaatagctggaataactgactgctggagtaatgaatcggtttatcatagagaagaaatgggtggaacaacacctgaagtctggttacaggcaacaggatacgaagctgcattaatgaatactgctattgaaaccgaaaatgataaaatattaagagacctgtatacattagcagacaaatacagagaccctcaagcattaattctcgcatatgacaatgcacatagaattggccgtgctattgtagaatatggtgatgacccatatcaaagaagcatagcaggagctcttgaagctggcaccattataagagaagctgttgaagacaaaaaaatgcaattaaccagattcgaacaggacagccttgatggagctatgaaaatctatgagaaattaccagaagattccggcaaatttatcaaacaatcatccaaacgatacggacgtaaagtagaggactttgatcctaaaaattatgaattataataaaaagaagggattaaaatgacttataaagatttagaaaataaaataaatcaaaataagatagctattagatacaatatagttgtagaaggtgcagctataaaacctgaagaatatcctgaagtaaaagaaggattgccaacagaagaaccctttaaatcaatagctttaggagtgctctatgaagataaagcaaaagtattaagcgatgttaaagaatctcttgaaaatgagatttcaccattggacatcataaacaaaggacttatgaaaggtattgatgcagtgagcttactttatacaaaaggagtttatttcttacctgatttaatgcttgcaggagatgcaatgatggaaagtgtaaaagaatgtgaaaaagttcttggacacaaaagtgaaacaaaaggaactattgtttgttttgttgctgaaggagatccacatgacatcggtaaaaacttaatcttgatgtttttaagagccggaggatatgaagctatcgatttaggaagagatgttcctaccgagaaagttgttgaagctgttaaaaagtatcatccattatttatgaccggtactgcacttatgacaactacaatgactgcatttccaaaagttgtagatgctcttgaaaaagaaggtcttgaagtgcctgcaataggctgtggtggaggagctgtaagaaaagactatgttgaaagtatgcctatgacagtatacggcgtagaagcttaccacacaccaaaattagctgatgcaatcctgaaaaaccataaaacatgggaagatttaagaaaagagtacagcgacattgtaggggaattcgtaccggaatattcaaactagataaccatggcagaacattatgcaatagctatagatattggaactagcggtattagagctcaaagctacaatctaactacccataaaacaatatctacagctataactttaagacatccattgcctggagctaatgtagtagatcatcttcactttgcattaaatataggtctcgaaactgcacataacattcttataactacaataaacagagttatagctaatttaaatattgatttaaataaagtagaaagattggcagtttgcggaaatccaatacagttatccttatttaacaatattgaaataagagatttggctttttggggagaaaatgctttaaaagaaaaaaatataactcctccgtccagacgtggaaaaatattaaatcctcaagcaatcggcttagatattaatcctgatgctaagatttacattcctccagccattaaacatgaaattggagcagatgcattagctatgctttacaaatccaaagctttagaaaaagatgaatattcacttattatagattttggaacaaatgctgaaatggccctgattgcagacggagaaatttatactgcatcggctgctgcaggacctgctattgaagggcaaaatattgaaaaaggcagactagcttctccaggagtaatctgcgatattaatgaagaggaaatgttctggagaatgaaaattcttaatgacaatttaatagttgaagacggagatttaattgatcctgttaatggaaatgtcattaaaaaatcagacatacaagcaaaaggaattaccggaaccggtgtaatagctgcatttagtttaggtagtgatgataaaatcataaaagacggcaaaattaaagatacaatttatctgcaggatgatgtttatctcaaagaaaaagatatttcaaatattggaaaggcattaggtgcttttagagccggacagttaacactagctgaaagtgcagatatccttttagatgaaattgaaagtgtatatatggccggagcttccggattttatgttgatgctaaaaaatcattaaacataggacaaattccaccaggcccccaacaagtttatcaaattggaaatacatcattagctatggctaaagatattgtattaaaccccgaattattagatgaattgcagaaattggctgataaaattgaaagcaatcatataatgcttgctacttctgaaatatttgaaaaaatatattccctggaactggctatttatgaacaaggaatgccattttggatgtataatcaatggctgcaaaaatacggcattcaggaaatcccaaatattgaaacagaacctgaaataactaaattatacccaagagatatttcagatttgggagaaaatgatttaaacacagttgatattgaaaatatattatctgcaaaatttgacagatgtatttactgtatggactgtgttaattcatgtcctgaaaatgctctgtcttttgagaaagatgaatttaaattaagaacagacttatgttcaggccttggctgtttaaggtgtgctggaaattgcaaagaacatgcttttaaatatgaagaattttacaaagatatatagtgattaatatgaatctaaaagaaaatcttgaaaatgcactttcaggtgaagatgtggaagttaaacctgttataagtgtaacacaagcaggaattatcgaagcaatggaacagactaatgcttcctggccggaagcacatacaaatcctgagcaaatggcaattttaggaagttccctacatgaacttgcaggccttgaatgtgcaagaataccttttggacttacagttgaagcgcaatctatgggagctgaagtaaatctcggaaacaatgaacgaactccggaagtaactggaactccttttgaatctgcagatgatattgaagcaccagatgattttttagaaaatggacgtattccagtagttcttgaagctattgatattttaaaagaaaaatatgaagatttgccgataatcgttggaattacagggccatttacattaacaggacatttgcttggaattgaaaatgtcgtaagatatatgaaaactgatcctgatgaaatagaaatagctatggaaaactgtcttgatgcaagtatggattacattgaatcaattcagaaacatgatgcagatgttatttgtgtaaacgaacctacagcatccccagaattaattgaccctcttcaatttaaatcaatgattaaacctaatcttgaagatttggcggattttattgatgtgcaaaaagtattgcatatctgcgggtcaacacaacctattataagtgacatgtcctctgttggctttgacggaataagtatagaagaagccgttgacatcccaaaagccaaggaaagcatcgaagatgaatgtgtcattgtaggaaacatctcaacatccaaaacattattgagcggaacacctgaagatgtaaaagaagatgtaaaaaaagtattaagtgaagatattgatattatagctccaagttgtggattagctccaaaaacaccactagctaatgttaaagcactagttgaagctagaaatgaatattttaatatttaaatattaaatgaaacaataattgtagctattgaagaatcatcaccataactatacttattttttaaatattcgtcagatttagttgacggacttgatgaaacaacaccatctaacttaaaaggatccaattccggaaatggaacgggaggtaaaacaaaatattcattgcctttttccaaattgtaattatttaatacatctttaaaaattacaaaatcatcacttaaaaacatgatatcttcatcatccctaaattttttcttatcttcaggatcaaaaacatcatgacccaatatttctccgtcaaatgtcagtaaaacagtgggagttgggggaactctgaaatatccttttttaaaaattacaaaacatacatcccttttgaaacattcctgaactccttcattgaataccggaactatatcctttgagcgctgtgcttccatatcaattatctttaaaatatcatcattggaaagttgccttacttccaaaacaccatccaaaccacttattacatttactacattgtttaagacttcgctcataatatcacctaatacaatcaggacaaatacccatatacggagctacagcttttttaatatctgttgatactttatttactccagtacttgcatcaattatttcatgattgaaattgctgattaaatccaaataattagctttgactttacttaaaaattcctcattttcaaattcgtcttctttagagcatcgatttacagaagttttaacatccacatctaaaagtaaaaccagatcaggttctttagcatatttattaatctgttcaatccattctgcaggttcctgataagctaaactagaaataaaagagcggtcacttaaaataactttagaatcatcattaagtttatccataataagcatcctgtctgctgcaaatagtagacctaatgttttttgaattctgtcagttgttgcatccggtctttgcagtatttttctaattaacttaccgacttcagaatctgtcggttccacaactgtttcaacatcaaaaccattctgatccagccaatcttttaacaggttaatctgagtagatttacctgcaccatcaattccctcaaaaacaatgtacataattttaaatttgaattaaactatattaaactttaactattttttcaatgtttcattaaaacaaaaagcaaaacagctatttaataaatacctattttacatatgaatgacctatgaaaatccccacaaacatgaactataaatttattaagcattatttataaaaaaatgatacaatatgatacaaataaatgataaaaaatacatactcacttatttaatcgggtttatattgcttgcaacctttttattttcatgtaacacccataatcatccaaaagcacagataatattaagtattttaactgtaataggtggaataatttgtataagatattctataaaaaataaagatgcattacacaaaacagcttttttaataatcatcatatttggattactaacagtatttgcttcaccacttcttgtagctcctgatgaagtagaacattttgcaagatctgatttaacctcagaaggaggacttataccaaattaccatgaaaatcagggatatttcataaacaactattttcatcaaatgacatattcacaaggtagtaccctactagacaatacttcctttatgcatcaagatattacgcactgcaaatcattttttacatcagtattttctcaaaatctattttacgtctatttagctcaaggatttgggatatttattgcaaaaatgttggaattaccagtaatattcgcattatggttaggtagactttgtaacttattattatactcaggaattgtatattttgcaattaaaaagacgcctgcttttaaaaaagagttacttgtattatcatgtcttccaatagctgtttttcaagctgcatcaatgagcagtgatggaattatttttgctctggcaatattaaatatttcttacttcatacagatgtataaatcagaaataatcccaaataaaaatataatcatttatttggcaacaggagtattgattggacttattaaatttccatatatctttttattactaatgttatttttaatacctgcaaacaaatttaaaacaaaaaaaatagctattatatctaaaatgacagctttactcttaatagtcatagctggagcatatagtaatttttatgcttcaaaagaattgttaaaaggtggaagaatagactattacatccaaaataatgttaacccaaccaatcaaataaattatataattcacaaccctacatccgcagttataacctttgtaaaatcattaatctttttaccatacttgatttttattaaagattgttcttttttccatttaatactttttccagggctagatatatacaatgcattgtgtttaatcttctttattgtatttttattcttatctgaagatttaaaaatggctaaaaggaaaaaattagaattgataatattatttttaataatttatacaagcatattttttatccaatatttaagttggactccagtaggttatgatggtattttaggcgttggagcccgttacttcattccaatattagcaatactgccattagtatttggacataagtctaacagtgaaaaattaacaaaatatttcatagtatttacaacaatattcttatctggaatgttacttataataattgcaggattttattaaaagaataagacatgagcctgtctcttcttaaatttcttattttttcttttacttgatttatattattattttgaatttaaaatacatcatatccttttaaaataatatataaaataaaaactaaacagtaaactacaaccccaacaatacattatcagcgatattttaaaatttatttatattacaaaaaacatatttttaaatgattaaatcttagggtgtaataataaaatggttttatcagaattattagctccagctggatcttatgatgtgcttgtaattgcagttaatgcaggtgctgatgctgtttatatagctggacaacaatatggagcaagagcatttgctaaaaacttcacaatggaagagatagaaaaagctgtcgaatatgctcatttaaatggagttaaagtccatgttactgtaaatacatcaataaacaattttgaaatagctgatgtaatgaactacctgtttaaattatatcaaataggaatagatgcagttattgttcaggattttggaatatgctggcttttaaaaactctgattcctgatttggaagttcatggatcaacacagatggcattaagcaattacagttccataaaatgggctgctaaaaacaatattaaaagagttgttcttccacgtgaaattaatgtaaaccagatagctaaaacacatgaacagctaaaaaaagacaatatcaatatggaaattgaagtattcggacatggagctttatgctatagtgtctccggaaactgttatatgtcttcatacaacagcggacgcagcggaaacaggggcgcatgtgcacagccatgcagacgagaataccgtttaaaatacagaggatacaatatcgggaacggatatcttttatcaacccatgatctggccacatacaataatctggacgcaatttcagatgctggagtaacttcattaaaattagaaggccgtatgaaatccggagactatataggaaccatcgtaaacagctaccgcaatatattggacggaaataccggagattatgccaaaaatttacatcttgtattcaacaggaaatttacaaacggatacataatgggagataaacccggtgaagtaatgggcagaggcagttcaggccacgaaggtttatacataggagacattgtaaaaatagatggaactgaagttacaattgaaatcaaaaataaagacaattacatcacactaaaaaaaggtgacggaatagcttttaaatacaacggcaaaatcaaaggaatttatttagaagacattgttaaacaggacgaaaatgaaattgtaattaatacaacacgtttggttaaggaaggcacagaggtatttatcagtttttccaagtcaattcatgaaaatcttaaaaaattccaaaaagaagtcattaaaaacaatatcccactttcattaaccctaagctggaatgaagacttaacaggatttgttaatgttgaatattatttagatgacgaattaatcaatttcagacataaagtcataggcaaatttgaaaaagctaaaaacaaacctattacaaaagaaaaaattgaaaagcagttatcaaaaaccggaggaacaccattctacatagatgaaatcaaattccacaatatgccggacaatttatttattccaatcagtgaacttaaccagattagaagggaagttctatctcaagcacaggacctgctgttaaatcactacactccaaccaaaaagtccgttaaagctacaaggaaaaaattgaatgagttttatgaagattatgaatctttcaataacatcagcaaaaagaaaaatcctaaaatatcattatttattgataacttagaccagttaaaatcaatttccggatttgaccttaaacggatttactttgatggaaactgtttatacaataaccctgaagattattatgaaaatattccaaagcttttagaagaagccagtcttatgactcctgatgcagaacttgtttgggtattgtcctcattcatcaatgaaaaagaagcatccaaatgcaatgaaatagttaaagaacttgaatcaaaaggaattattatttcagttatgggagatttcccgggaatgggtgagatttttgactgtcctgtttatggaaaccataatctgaatgtttggaactcatttacagttaaaaatcttaaagaagcaggattcaatggtttaattttatcttcagaactttcaggtaatgaaattaaacatctgatttctaaaaataacaccgaagacattgatttggaactaattgtaaacggaaatttagaggttattgtaagtaaggatgatttcagtaacttaaatgacggtaaagatttcataatacataacaatgcagattatgccattttagaagataaaaaaaggaaaaaattcaagtacaaagtattatttgactataataaacaaagccacattataaacaaagactgcctatgtttaattgaagaaatgaatgaaattaaacacttaggtcttgattccataatcctggattgcagatattccaatgaaaagtacacaacaaacatattatccatttacaatgattccctgaaagacagagatgatgaagagctttccaaatacaaatatcagataatggatttctcacagtcatatatcaacaagggaaattatattgaaggcagattacacgaggacaaacatgagaattcctgaattacttgcacctgtaggttccatggaccaccttaaagtagctattaatgcaggagccagttcaatatatttatctggaaaagaatatggtgcccgcaggtttgctgaaaactttactttaaatgaaatagccgaagcagttaacactgctcatctgcacaatgtcaaggtttatgtaactgtaaacacattaattaaagaagatgaacttcaagatgtaatgaattatttgtcccatctatattcaataggtgtagatgcagttttagttcaggatttaggtctggttgagctgataaacaaacacctgccaaaactaaaagtccacggttcaacacagatgactgcagaaaaccaacttaaattagattatcttgaaagcaaaggaattaaaagaatagttcttccccgtgaaatgagaaaagatgaaattaaaaatttgaaaacaaatatggaacttgagatatttgttcatggagctctgtgctattcctattcaggacaatgtctaatgagcagttttaaaggaggtcgaagcggaaacagaggaagttgtgcacagccctgccgccaaaaatacagattatcctgtttgaacagtgaagattattacctctcacctaaagatttgtcattatacgatcatttaaaagaaattgcagagctaaacatcagctgcatcaaaatagaagggagaatgagaagcaaggaatatttggctattgcagtgagcaattataggaaagccttaaacaaattgaaaagcaataaaatcagcaaaagtgaagaaataagccttgcatttaatagaggatttagcgaagggcaatttaactatgcatcttcaagaagtatccgttcaggacatgtcggtttaaaattaggtaaagtctgcaatagtgaaaacagccaaatagtcattaaattagatgacggtttaaaaacaattccccaaaaaggtgacggattattattaataaaagcaaaagatgactacggatttgaaatttcacaaaaccctcttttaacaacattcaaccattataaaaaaggcagaaataaagaaattaaagacattaacagaaaagacagagttttaatcattaaaaaagtaaagcagaataaaaaacaccatttcaatttaaacgattcaacagcatatcttacaaaaagaaacagattaacttcaaaagttaaagagattgaaaataagggcagcagttttatcaaatccaaattaatacttacattttcaattaaaaacaaatatcctcacttgaaaggcaggttaactcttgcaaataaaaaagaaattgaaagtgaagttaaaggagaagttccctttgaaaagcctcttaaaagaagtgtagatacaaaaacaataaaaaaacagttactgaaagttgacaaatacccatttgacattgttggagtcaatatcaactatgacggaacattatttatcccaataagtgaaatcaataaaatcagaagggaacttttcaaaaaattagaaaaagaagtgtattccttatactccaataaaaaggtaaaaataaatcttgaaaatgaaggcaatgccctaaaaactgaccaatacagtttatcctattatacaaataacctaactgatttagataaaataaataatgtaaaaagggtttatttggagatacctcctgaagacccgtcagtaataaatcaaagcagggaagaatacaatataaattatatggtcagctatctgcaaaaggctattgacatttccagaaacagagactatgaattaatctggaaatggccggacattgctcatgacaatttaataaaagttttaggaaaagtaagaggcatattaaacaaactgcactaccctattgaaataatgtctcccgattttacaggccaatacggaccatactccatgaacgtgacaaatacacaaacaataaagagtcttgaaaactacaaaataattacattgtcaccggaactgaaaaaagaagatttaaaaaatattttagacaattgtagtgacaattccaaattggaaattattgttcagggatctgttgagctaatgaaaagcagaaacagattatttaccaaaaaagaatctaaaaagttaaagaacaacacagacgacatcttcctgattgataagaaaaacaaaagatatcctattcataaaagcttatctaatgaagaaattataatttcaaatagcgaagatatttcacttttaaatgacattacctacttaaaatcaatagggcttgttaattttgctattgacggtcgatggagagatgaaaactatttaaataaaatacaggaatataacacagctattgacaaataaaaaataatacttcccaaatgctctagggaattttggatatatatttaaataaaaatgtatagaaaaaagggtttggttaaaatgcaaggagagaaagtaacattgcaaaacataaaaggtattggagataaaatctctgaaaaaatattaaatagtgttggaggagaagaaaatcttcaaaaaatagttgaaaatgtggatgttgaaaaaatagcaaatattgatggaatcagccaaaggaaagctattgaaataatgaaccagctattaaataatcctacatatgagtttattaaaagcgacagggcaatggagatttatgaagacatcataaacaaaatattagcatattcaaacacttcatattcaaaaaataggattttgctgctttccccttcaaaagatattgaaaaaatagaaaaacaaatcagttttgtgatggatgcaaaaaaacaggtttcacagcttccaataatcaagttaagaggattgatgaaaaacttaaaggaagttgaaaatccgaaagccgaatatgatgcaagtaaagttattttagtggaaacagaagaagataattcatatcttactgatttaggtctgaatcagtattatccaataattacagccactgattccccgttactgcaggaggaattaatgaattatgaccttatcttttatgtatattcacagggaatacttgattttgaaggaatgccaaaccttgtaatgattaatattgaagaaaatgattatgaaatagttcctgaaaaaataataaacttctttacacataaccaggatctttttaacagagtttatgaaatacaaaaaatcagaggccgggaaacaattttgggagaaattatcccaattattgatgaacttaatgttattgataaaagagaagtagacattgaagaattagtcaattctttaaaaaaggatatggatgaagaactagaaaatgccatacaaaatgttgatcttgaaggagatgaaattctcaacctattaaacaagaatctccctccaaagattaataaaatatttgatgaaattataaatgaaaggaagaaaatcatcagagaaaaaacaggatttgattttgatccgtatctcagaaaatatcctattgaaattgacgacagcgaaatccaaagaatccaactggaacagtcatccaaaaaagaaaatgatatttttgatgttaaaaaaagtgctgccattgaattgaactccataaaagaacaggcaatcaaagaagttgaagaagtaattaaatttgactatgaatttagcttaggcagctttgcatatgaatatgatttaaatgcacctgaatttggcgatgaaataaatttaaaagaggcactgcatctggaactggcccttagaaaagatgataaaaacacacagacaattgattacaaacttacaaatgacgaaaacatagccctgcttaccggggcaaacagcggaggtaaaacaacccttcttgaaacactaacccaaatttccataatggcgcaaatggggcttcctgtaagtgccggtgaagccaaaatcaaattgtttgatgaaatatatcatttttcaaagaaaagatcactggatgccggagcttttgaatcttttttaaatgtatttattccaattgtaacaacagacagcgaaaaattagtattgcttgacgaacttgaaggaataacagaactggaagctgcagttaaaattatttcaacatttatagatatgattaaagaatccaattcctacggaataattgtaacacatatggccagggaactgatgaattacacagatattcgtgtagacggtattgaagcaaaaggattagatgaaaattataatctgatagtggacagaactccgaaaatgaatttccttgcaaaaagtactcctgaacttatcttaaaaaggatttatgaaaaatcagacgataatctaaaacaggtatatgcaagaatcctggagaaattttaagatattaatatatagaagttttaactaattacaaaaatatgaaaataatttccaacacaaaaaatgattctataaaaagggtagaagaaatatataaagttcttaaaaaaaatgatttcggttaccttatcgaagaaaataccttctttaagaattttccttttttaaaagatactaaaagaggcaaatataaagaattacctgatgaatctattccaaaaagaataaaagatgtgctggaagaattaggaccaacatatattaaattaggtcagatgttaagtaccagacctgatttaattggagtggaaatagcaaaggaactggaatccttaagagacaacactcccaccacaccatttaatgaaataaaagaagttattgaaaaagaacttggaaagccaataaatgaaatctacaaagaaattgacgaaaagcctttaggttcagcttcaatcgggcaggtccataaaggaatacttcttgaaaacaacaaagaagtagccattaaagttcaaaaacctcatgttcgtgaaactattgaatcagatttaaagattatgaaatttttatctgataaaatcggaaaatacataaaccagactaaagtttataatattccatctattttaacagaatttgaacgctcaatattcaaagaaattgattaccatgaagaactaatcaatatgaaaaatttggcgcataatttcagagccgtgcactacatccatatacctgctgcttattcggagtactgcagtgaaaaaatcattacaatggaattaataaaaggaaaagaagtttctgaagtaatggttcacgattatccggaatataataaaaaattaattgctaaaagaggagtgaaatcttattttaaacaaataatgattgacggatttttccatgccgacccccatcctggaaatatgatgataatggaaaacaatgtcttatgttacattgatgaaggaatgatgggtattttagatgatgatttcagagaagaacttgcagagttaatattattgctattaagcagaaatgtagacaatattatcaaccagctaatttacatggacatattaacacctgcacaaaacactcctgaattaaaagccgatgtaaatgacataatgaacaaatattacggtgcagacctgaaagacatgcacggaggagtacagcaacttctaaaggtaatgattaaacataacatccaattaccaagagaatttgtaatgattgggcgtggaatggctttaattgaagatacaggaatgaaattggaccctgaatttaatgccatgactgaactgaaaaaattatccagaaaaataatgtttcaaaaatacagccctaacagattagcaaaagtaagctccaattacatgctgcaaatagaacacttagctaaagatttgccaacaacacttaacaatatgctttcaaaacttgaagaaggtaatttaagcgtgaaacttaagcacgaatcaatcagtgaaatcatgaaccagctgtcaatttcacttattttatctgcactaattatcgggtcatcactggccatcatttcagataagggacctaaactatttgatgtttcaatattgggactgataggatttgtattcagtgcagctttaggaatctatttagtaattcaatttatgttaaaagagaaataactgaaattaaaaaaatatttgttaattaactcgtaaccaataaagaaatacataaactaaaaatgattttatcaaaactaaaacctttgaaactgtgactgtgtgaaaaaaaaggatagtaaaaaaagttaaaaagtcttaaaaaaatttaattaataatttgaatattttgaattacagagaatatcaatggcattatacccaatataattacttactgtacttcttcaactgtttttactttaattcaatgaataaaatttaagtggaatcattattcaaatgttctttaaccatttttacataattttcataattttcttcagataatttttcatcaattgatagtatatttccagaagttaaatctatatacacttcataattcaatattttaagaattattctattcaataatgttctatatgcatcagttaaatacattaacttaaataaaccttcatcatctaataaatggccatgtgcaggtttatttctatagaatcttgcatctttttcaacatccccagtttccaattctaattcttctaggaaaaaatcaactttttgtttaccacttgcttgaaatgcattttcaatttttataaaaactttgggataatctttaaatgaatttttaagattatcaacatattcttcgattaattcatcaaattttttcttttctattaattcaccattactctttgattttgatgatttaaaccaaatttcagataatttatctaaacaagctccaatcatgacaatttctgcttcaacaggcacaatcattgataataataattgatgaatcacatatgataaatctattttatcttcatttaaataattgttaataatataacaaattctcttctccactataggtaatggaaaaccctcataaaaatcaatacaactccgatcactttttttacaaatttgttttaaatcaatttgaataggaatcagtggggattgacatgaatcattaattatattccaatctttgtcataatgtgtttcacctattttaattaaaaaccttcccaataaaaatgagattatttcaacaatttttttcctaatatcttgcgggggaatgtttaactctttttgatattcaattcctaaatttttagaccaatccggaccaaacttttgaggaacttcctgtaataaaatagaatagtcattcaattctaaaaataaggaatctaaaatagaatctggcattgattcctctaaaatatttaattcagaatttttagaaatatctcttgttttaataaactctttttttatattgaaactagtgcctcttttaaaaataagactatcctgtgtgctattaagataccattctttaataaaatattcttcattatcagaatatttattaatgtttctttcaacattttgaactttaaaaacaacattatattcattttgaggataagtcatagtatctttaattatatggcatgaaaaaagattatatgtatgaaattttgttttaatatgtatatctactggttgattaagcttttttatttcttcagagtcatgttggtttactttacctatgatacccaataagatttcatatttttcgtttctttttaaatagattttggtgacttcaaacaaatccaaatttgtttcttcaataaaactgatttctttttcttcttgaaggaattcccattctatttttgacaaatatttcatttttccaccttaactcctattctaaaacaaataataactatccttgattgaaaattcaaattagatatgtttaattaaaagtattttgtaaataatattattaaatttttatttatttttctatatctatttctcaaaatattgttataattaaatggagtctgtaaaattttataggtgtatttgatttttatgtgtttttctgtccaattttccatttggtagtctaaaaatgttagaattccgtttttagttttgtatattttctttattttttctgggttggtttgtctgtagtaattttcgattttgttcgatgttttttcaatattttcatcatctaagtgttgtacgtatctgtaaaagtgattaatgatatgttttcttataaaatcttttaatactactggtatggccatgtaattttgtaaatattgtttgaattgccctattgcttcttttgttgaattttgtctgaaacagttttttaattcttgcgcattttcatagatatgttctctttgttttttgttaatcttgtttcttctgcagtagccttttaatttgtaatttattgtttgaaataaatgaaatatgcataattgatgatttacacccatttcatcgactacattgcgataaattggaaataaatctgttgttaagcaaataaatggtttatttttcgttgaatctaagataaattttttagtattttttagtattctgcgacgtactattcgttctgagactggaacattaagtatagcatcaaataatgttaatctgtaatgtttgactccattaagtcttaaaaattgctcatcatatacataatagccagaatattcaaattcttcgttgttgattgtttccttgtgatttttattggaccaattcttgattgtttgatgagatacacggattccaaggaatatttcaaagtatttacttattttacgaagtgattgatatccaatttttattattccaggtattttatccattatttcttgtaaaaattgtttattttttccaattaatggattattgtatattccgaatttttttttccacattttttgcattgatattgctgttctttgaattctgtagtttttccattgatattttgtttgttttttgttattgtgccttttttgataattttatgagctccacaaacttgacaaattggattaacatatgaaaatatattattttcgtctaaaaatagtttttgattagtattttcaatatttgggcttttattaagcctttctgaaatgattttttcataatcaatttttttcttcagaaaaatcaaaaagtttaagttgtatgaagtttaaattaccattgggggcaaatttgttttgtttggtcataaaacattatttgtcctcacttatttaagtaatttactatttttaaatcaatattttctaaattaaagcaaaattagaacgaatttttcatcaaggtgaagtttcaactgtaaaaaaaaattaatttgaaaaaagcctataaaattttacagactcaaaaaaagaagattatacagattaactgaaaaaggaaatgaattatttaaaaatttagattaataattaattccactttctataatcattaatttaacatacaggtcttctcggagttttaaaatcctattgaatctttcattttcaatataatttatcttttcgtttggtttaaactggtcactttctaaaatgtcttgactaagtttggatatgaactcttctatatgaacaaggtttccccaaccatttaattcatatatggaatatgcttcatcataagtaagtttctcgggaagagtttcatcaattcttttaaagtcacattccagtttctcatcagtgtaatttttagatgatatgcatttaataatacggcctactgcaaaatgaggatttgataaataaacacatttgtcatataccaatgccttttcaccattccagtcaacagtaacggagttgtctttttcaatatcaaatggtatggtttctttttttaatttttccgaacataatgggcagaaattatattctttgtcaaattcttcaccacaattttcacatatgcttttacccagattatttaaagaatctataagtccatctaaattatattgatacatatcattttttaaaactttgccacagttcggacagaaaagaaaatcaggtttatcacaatattcaaaatttaaatcacagtcttcacagtaccagttttcatccacggcaggaaaatccatattttatcaccatactcactatcttatttattcccttattaaagtttcttataggtattttatattttgtgtatataacctatttaataacaatgtataattatgatgatgaatatattataaactgtttgggataaccaaagtttgatgaaatatctatggatgtgattaaatatggggatttgtccgaattgtggaagttgggttgatgaaggagacatatgtcatggctgtggtgccagtggtagttacattacttcagaagatgaagatgaaacatataatcctcctgttgaaagcagggcagacagattaggtaaacaagcatgggatttatatcttgatgaaaactatgatgatgcaatttacaaaatcaatcaggcattagattttgatgatagacatgctgaaaactggaataagaaagctattattcttgaaggcttgaaaatgtatgcaacatcagaaaattgctacaataaatcactggaattatccaaaagaaatatggtttatgacaacaaggcaagaatgttatttagatgggcacataaattacttgaagagtcaaaagatattcccgacggatccaataaacttgaagaagcaaaacaaaaatgcattaaagcaatgaaagcacttcccggagaaaatagtgaagaagatattaatcaatatctacgattatgggactcaataaatttctatattggctatgaaagaaaattcaaaagaaacattgaaacattaaaaaaatatgataaatcagaactatttacaataactggaataaactattataaaaatgatgtgcaatttaatccaggtttacctttgaaacttgtcaaggaacctgataatgaatttgataaggatgcaattgcagtatatgttgaagataaaaaaatagggtatgttgcaaacagtgattatactaaatataaattaacttcatctgcatcagaactgcagaataaaattccagatactgctaaaggaagctatttattttatttagaaagatatgtgaaaatacagtttcctattggaagaataattaaatgaactggaaataaaattaatattttgaatgaaaatttagtccattagattaaacgtgtttgtccttttttttgagatttttttccagttatcaatacttttttaatattctttgcaattttttgcattattatagttggaacagcttccccaatacattctcttatatttgcttcattttcctttaaaaattgttgtttttcttctaatggtaaattatttaattcttcttcacttatttcagaccatttaaaattattaggaatattcattaataataataattcatgtattgaaaatgctctatcatcaactggatggactgtattttgactcgctagattagccatataagtatgcacacaaggaccaactttatcccaacattgtcttgtatatttatcaccatgtttgttattatgaacaacaatttctccatcaacaattttatggggtcttttattaatgtcttcattatcaaatgcagattcaccttcggaaatatcatgaatccatgctctcatatcttctctatagggcttaaaatgatgatatatgtcagaaggatcaatttctcccatttcattcagactagataaattaccaatgacttcaataagagttttgggttcttctttatctggaaataaatctaaaggatgtactttatcaattaaatctcttctaacaccaattgtaactgaacgggtacgactgctgttcgctccataatccttgaaatttattatttgattttcatgagtctgtaaaattttataggcttttttcaaattaattttttttacaattgaaacttcacctcgatgaaaattcgttctaattttgctttaatttaaaaaatattgatttaaaaatagtaaattacttaaataagtgagaacaaataatgttttatgaccaaacaaaacaaatttgtcctcaatagtaatttaaccttcatacaacttaaactttttgatttttctgaagaaaaaattgatcatgaaaaaatcatttcagaaaggcttaacaaaagcccaaatattgaaaatactaatcaaaaactatttttagacgaaaataatatattttcacatgttaatccaatttgtccagtttgtggagctcataaaattatcaaaaaaggcacaataacaaaaaacaaacaaaatatcaatggaaaaactacagaattcaaagaacagcaatattaatgcaaaaaatgtggaaaaaaattcggaatatacaataatccattaattggaaaaaataaacaatttttacaagaaataatggataaaatacctgaaataatgaaaattagatatcaatcacttcgtaaaataagtaaatactttgaaatattccttggaatccgtgtatctcatcaaacaatcaagaattggtccaataaaaatcacaaggaaacaatcaacaacgaagaatttgaatattctggctattatgtatatgatgagcaatttttaagacttaatggagtcagacattacagattaacattatttgatactatacttaatgttccaatcttagaacgaatagtatgtcgcagaatactaaaaaatactaaaaaatttatcttagattcaacgaaaaataaaccatttatttgcttaacaacagatttatttccaatgtatagcaatttagccgatgaaataggagtaaatcatcaattatgcacattacatttattttaaacaataaatcacaaattaaaagtctactgcagaagaaacaagattaacacaaaacaaagagaacatatctatgaaaatacgtaagaattaaaaaactgtttcagacaaaactcaacaaaagaagcaataggacaatttaaacaatacttacaaaattacatggccataccagaagtattaaaagattccataagaaaacacatcattaatcacttccacagacacatacaacacttagatgatgaaaatattgaaaaaaacattgaacaaagtcgaaaattactacagacaaaccaacccagaaaaaataaaaaaattatacaaaactaaaaacggaatcctgacatttttagactaccaaatggaaaattggacagaaaaaacacataaaaatcaaataagcctataaaattttacagactccattttcagagtatttttccaataattcatcacaatatttaatcaattccacatattttcttgatttaaataataatttacatattgttaaagaatcttcaattctttccattgaaatcacattttcaaagttttatcttaattttttattaatctcaagttataatccatactaaaattttattatttatggcatcatccatttattcatttaatatttcatccccatattttttatataatttaaaatctttttcatcgatagaatttacatttaaaatatcttttcctgttaaatcaatgatctcctgagctaaatgcgtgaaaatatctggataatcattaccattaaaaatccgcaaatatttatctctttcaaagactagataaagactccattcatatccatcaaaatacgatgacgaatgataagttaattttttccaatattttccactatttaattgataaatatgatatttttcaagtaattcaaatactatttcaatatctttattcgtcatatttttatttatacagccttccattatctttttttcaaaatcaatgttaatattatgtcttgaaaaaccaaaattcattgatagtccctgattatattcaagaaattttaattttaacttttttgaagtttttttatcatatattccatcttgtctaaattcataatttaactttgtaatttcttcttttccccatgtatttatcattcatatattccctccagatattttttttatatgtggaatatttcttgaaatatccatattagcttttaaacatttctggattcaatattattgattcggatgcgggatttattacaatattttcatttgcaacatttaccaggtctttaaattgatatgcttggggataaatatctctttcataattattaaaaatctttttaaactcatcaatgtctgtgaataaaggcaaatgcgatttattatcgtcatcccatattaaaacaaaatttgtaccatcagcatcaacacaaccagtaatcattattgaagttaataatttttcaccaaattcatttaatttgtcttctgataaagaatcttgacgtaacaattctcttatttcatcatttcttatatcaataacttcattttcgtcattaaataaacttaaaaaagtttccataggcacattaatattataatctgtaaatggattaattgcaattaaagaatatctatcagtttgttttaacatatctgccaaatcacccatatataatacatatgttgaacttctaaaatctgcagcttccatcatttcatcactagtaaataaaggaactgctttatttcctttatcatcagttaaaaattcaatattaaacacaatttggacagtaggtccaatcacatcacctacttttgcactttcaataccctcaaacatatttttactataactaaccggcatatataatctggactcttttaacatgtttaaaaattcaatttgcattattggagttatttcttcttttgttaattcctctaatcgtgaattatcaacccccatttcattttttaattcaaccacattttgttcatctatttcatcatcaacaagatgatttaaataattattaaatttagaaacttcatctaaaatatttttaaagtatcctgaactgcttaacatattattttggctgtaaagtgctattaaatacattaatagttgaattattttaggattaacaccaacttgaatattattttgtctaaagtatataatatcctctttaacgggtttttgttcttcaccagattttaagaatacgaagaaattaaacagatgattatataattccatattctgatttgtgtgatataaataatctgcaagcttgaaataacttgaagttaatatgtcaacatcataagtatatttgaaaatatcacagcataaatcttttaacttttattcttcatgtttggattgatagaattcacatagtctaattaatattggggcagatactggattaatttgattagctatttttaaatacttttctgcttcatttatttgtcccaaattcatatatgctattgaatatatagtataaatatcttctaatggtttatctaagtccagtgttttaattgattcaaaatttccaagataattatcaaataacatttcttcaagaggatttgcaaaatgatgataatctatagttttatatgctggattttcatctaaaaaatcaccaatactatctattattttttgaaattcacccgaatttaataaatctattatttcatctaaaaattccatttgaatcacctttaataaaatatttataataacaaattaataacaattaccatatatagttgcagataaaactttgtgattaaaatgaaagaaaaagaaaaatgcgatttattaaatggactcagacaaaaaatcgcagatgagaataatattgattttcatattgaaaaatagacttttgaaggagaatgcttaggaacttgtcctaaatgtgaagcagaactagagtatcttgaaaatgaactaattaaaaaacacgaatctggtgaaaaaattaatattaaaaatatcttcacattaaaagaaaatgataattatgcataatgttaatatttcaaaaatctcaagattaagaataaactctgaatgtgatggagtttcaacgttaattggttgtatgggatgccctttaagatgcgcttattgttttaatccattcacatgggatggttcagttgaacctaaaaaatattctattgatgaattatatgaagaagtaaaacttgataatctttattttcttgcaactgaaggggacttagttttcggtggtggtgaaccattgttatattctacttttatcaaggagtttattaaaatatacgaaaactggttggaaattcacacttgaaacatcactcaatgttaaaaaagaatctatagaaaatataattcattgtattgattattttatagtggatacaaaggatatggataaaacaaggtatgaattatacactaaagggagttatgatttatttttatctaatttaaaatatttgcttgaaactgttggagcagataaaattagagtaagggtacccaaaatccctaaattaaacacatatgcagatgtcagattaaattatgaactccttaaaaacatgggattcactgaaatcgaaatttttgactatattgaaatcgacaaacataaaagaatatctgatgtcactttaaaaaataaaaatgactttgttgatgttgcaaataataattttatcaaagattacatcatatctgaaattattatcaaaattgctccattacttgattatcatataaaaaattttccagaagaattgtggaaagacatagaattcatatttgaatatgattcaacttatgaaaataatctgtacagtttaaaagaattaatagtttccaaattaagagaatgttatgattatttaggtttgaaatatagcttttatgttattttaaaaccagtagattatttaaaaactacttcaaatattgattttgataaaaaaataaattatttccttgatttgaatgaaaaaaataaaaaagaattaatgttagaatcatggaaagaaaataagtatgaatatcttgaatttaaagatttttgctataaaacaaaccaattaagtgaatattatactaattacacatataaacctcatgcaaagtatattttatcaaagtcttacaaagtggatcaatctgaattaagaatttacattaatctttcaggcaataagtataatattgtggaatatgatgatgctacacatgttttagttcaaaaatttgatgatgtgatggagttgacttttcaagaaattcatgttttaaaaaaataatattttgtttagatacaataatctcttttaacaataacacaataaagatttgtagaaaacttacattggatgaataaagtccatcaaagtcagttaactaccaattatattaaaaatacaatctattaaatgagaatgattgtaaaaactatagtaaataattaattgattctttgatcaaaaagtccatcaaaaagtccatcaaaaattgatgaagtccatcatattttaataatctggtgatgagaattgaactttcctattcactatactctttttaaccagattgagtttagccaattttctaaaatctctctcagcagttggttttgatgtattgaacatcttaatatgatcatcatatgtcatggaaacattattgtttataatttcagttaagataacaatttgacgttgatttaatcccaaatcttttaaattaataacattttcattattttcataatgagatatctttccaccatttcctttaaacattactttaaatgaatcatttccttcactaaattctggttcttccaaaccagatttcttcatctcaccaatcatttgagaaattcctctaccaatatgttccatataattagtcttatataatatgtcacatattctctcatttctatgaccaattccttcatcattttttatgtcttcaatagttaatggatattttaactttccgggatttattatttcaatgcggtcatcgaatatgtagaattctataaaacttgatgacctttcatagtttctgtgtgcaagggcattgatgaaaccttcacgaattgcttttattggatattcgtcaatattaatacgattcattccatcaatgataaatccagaatttgtattttttttaaaaaatctttcaaattctttgattcccattagaagcgaacctttaaaatttaaccgatcaattgcatcgaatttagtgattcctttaaatctcaccatcttgatttcatgagataaaaatttgttgacatcctcggcgaagaataatgctccagcaatgtttaaatgaaaaacaccattaactatttcacctgcacctatcctttccaacagatatgctttattatctatatcttttagtttagtgaatgaatcatcatcttttaataaatcaaaaaacaatccatatgcctcatcgtcaacatcgtcgattgatgagtttaagatgagctttttgtcgaagttatcattatctttttgtcctctttcaatatattttaccagacttttcttgatttcatcaatcaaatcttgattggtgtcaaaaaaagagtatttattatccggctggatttttaagatgaacctttcactttcagcatctcttttatcaacattttggatatagaaaaatgaatcaggattagatgcatgaaattcatcatattcctcttcagttggagataatccattatctttaatggttccatagtccgatccaatcaaaccaatgtaaacatctgattttctaacttcttcaaagtatgttgtctcaggagacaatccaaaagagggtgaatcttcaaaaaggaaaactttgaaaaatgattttaaaaaataatctgcttcaaattctttcttgatgaattggcgttctttttcaaattctgtctgattactactaataaaaactttaaacatgatgaccaccaattaatatgatgattaaaatacaattgcaagtactttgaaaaaaaaacatacttccaaatattggttcaatgaaatataataaaaatataattaatatcttaatctcatcaataataaacatttgccaactgcaactctatgaaaaaacactactaaaatccgatatttcagacaaaccaacacgttaaaaaaaaataggctgcaaaaaccaattaaaataatcaactattaaatttaaataattaaaacaaataaataagctttaaatttgaattttgcccgtatactaactctcttgaatcatcggtagaatacccttccctcctcgagtaaccctcgaaacgggcagcctatctaatgctgggtttctcctaatcacagacagtatcaactttcctcatagaaggaccgaaggcatcagtcattaaaaaatgatacggcaataatatttatgtataaaataatatttaactatttcttaatccattgaaaaaacaaataaaaataaattaagaaataactaaaacaataaaaataagtaaattataatataataggcttgcagcgaaatgaaattcccatagaaaaccatagtacacaaacaaaacacaaaaggacttcactactgggatcgaaacgagaccaggtataacccccatgctatgaccgcaaaacctattacaatatgaaaatgataagtaataagtaaataagtaagtaataattgtaatagaagaaagcttgcagcgaaatgaaattcccatagaaaaccatagtacacaaacaaaacacaaaaggacttcactactgggatcgaaacgagaccaggtataacccccatgctatgaccgcaaaacttaaccttctaaaacatatgagtatgaaaaataataataatttcgtacattttcacccgtactattaacacctaaccagattacagctaacttatacatcatcaatagatgaatagtttaacaataatctataaaatcatgcaagcgaacaattggaagtagcggactaaacaactcggaaaaaaaacctcgaagcttacatccctaccccatcaaacaagtcttctactcgcgtcctaagcaatctattttcaggggatacctcaggcttagatgctttcagcctttatcacctagcgcgtagctgcccggcactgccttatcagacaaccggtcgaccagaggcgccgacaactcgttcctctcgtactggagccaccttcccctcagactactaacacatccattagatagcaaccaacctgtctcacgacggtctaaacccagctcacgttcccctttaatgggcgaacaaccccacccttgggtgctgctgcacacccaggatggaaagaaccgacatcgaagtagcaagccgcagggtcgatatgggctcttgcctgcgaccacccagttatccccgaggtagtttttctgtcatctcaggcccccatcaaggaggactctgaggttcgctaggcccggctttcgcctctggatttcttgctgatcgaaatacagtcaggccaacttttgcccttacactctacggtggatctctgtcccacctgagttgacctttgggcgggcttgataccatttcaagcccgtgccgccccagccgaactgcccatctaccgatgtcctcacacaaagtaagttagaaacacagtcataagaaagtggtgtctcaagaacgaatcatataaacctggcgacttataatcgaattctcccacttacactgcatacctataaccaagcttcaacgacagactgcagtaaaactctacggggtcttcgcttcccaatggaagactctggcttgtgcaccagaatagcaggttcactaagttctagctagggacagtggggacctcgttctaccattcatgcaggtcggtacttgtccgacaaggcatttcgctaccttaagagggttatagttacccccgccgtttactggcgcttcactgaactgaactccagcttcacgtgccagcactgggcaggtgtcgccctctgtacacacccttacgggctagcagagagctatgtttttattaaacagtcgggcccccctagtcactgagaccagctattcacatagctggcaccccttcttccaaagttacggggccattttgccgatttcccttagctagtttaccttaaaacgccttagcctactcagctaggggcacctgtgacggatctcggtacgaaatagtaaaatacaaaactaactcccttttcaaggactccatgaatcagttaaaccagtacaaaaacgaccagctcataatgcctacacctggttctcgctattacacctctccccaggcttaaacacgtaaataggacgacaatcctacaaaacatatctcgaagtgtcagaaattagccctcaacgtcaccgcaaatttactatgtacaggaatattaacctgcttccctttcgaccagctcaacttatgactgaccttaggatcgactaacccttggctgacgaacattgccaaggaaccctagcccctccggcggtaaggattctcacctcactttgctgctactactaccaggatccacatacctgcaaggtccaaaggaactcacgccccctcttcaacccacacaggtcgccactctacacaatcaccaaaaaaaaggtgttccatggtatcggcaactggattaattcccgtccattttaggtgcctctgacctcgatgggtgatctgttacgaactcgttaaagggtggctgcttctaagcccaccttcccattgtcttgggccaaagactcccttacacttatccagtatttaggggccttaaccatagtctgagttgtttctctttcgggacacaagcttaccccgcgcccctcactccaaccttctacgacggtgacgagttcggagttttacagtacgccgagaagtttccctccctaaacgtccaattagtgctctaccccgccaccaacctccagtcaggctgaccttagagtcatttcgagtggaaccagctgtcgccggccttgattggcctttcaccactattcccaagtcaaaagagtgttttgcagaacaacaaccctgcgaacctccatcgctcgtaagagcgacttcatcctgctcaggaatagatcgaccggcttcgggtttcaatgctgtgattccaggccctattaagaccttgcccctcaacaacgctgcgggcatatcggtttccctacgactacaaggataaaaaccttttagcctcaccacaacaaagaactccctggcccgtgtttcaagacggacgatgcaacactagtccaacctcctcatactacaatgttaccactgattctttcggaagaattcattccttacgcgccacatctggctgtcactatctggtttcaggtacttttcacccccctataggggtacttttcagcattccctcacggtactaatactctatcggtcttgagacgtatttagaattggaagttgatgcctcccacattcaaacccgatatccaacggatcctactcaagaaaaaatcatacacaaaacctcaaaaagagaatatatctacgggactatcaccctctacggttctaaaattccaaataaaattcgatttatcccacgaggcctaaaagtatgtctatacaccacatctccctaatattactaaaagggattcagtttgttctaagtcgatttcgctcgccgttactaacgacatcgcatattgctttcttttcctccgcctactaagatgtttcaattcggcgggttcccaatcctacacggatcaacacaaaaaaaatgtgctaggaagtcccattaggcaatcttgggttccaaagatgtatgctcctcgcccaagcttatcgcagcttaccacgaccttcataggcaactcaagccaagccatcccccagatagcataagtagcaaaattttacaaatgaaagatttataaacaaattaagcaaactattactaaaaaaaatatctaatacacaagaaaaaagtcttaaaaaattttaaacaaaccatcaagaagaaaaaaccaaactaaaatagtcttttcaacaaaataatgttgtttaaaaaaagaaaacattattccaataagattctttttttaatctattaaataacacataaactaacaaataatctggttagttagtgctagtagggttacttatgcacggaaaatcatttaaaatattttcccttcacacctgtttcacgacaaaaacggtgctgcactaataatgataaatattaatccaataatatcagaatgatactcttagctctgtagatgatttagtgtttgattacagttacaattaaccaaaacaatgtgatttgtgtctataacacacataaaaaatgtaatcatataataataattataaagtgtaaggaggtgatccagccgcaggttcccctacggctaccttgttacgacttcgccctccttaaaaaaactagattcgaatataacaaaacattacatcctcatccaatccctttttgggtggcgtgacgggcggtgtgtgcaaggagcagggacgtattcaccgcgcgattgtgacacgcgattactacgcattccagcttcatgagaacgagttacagtcctcaatccgaactacgactaagtttagaggattacctccgcctttcggcgtcggaacccattgtctcagccattgtagcccgcgtgttgcccagaggattcggggcatacggacctaccgtcgtccactccttcctcctatttatcataggcggtccccttagtgtgcccggcatccaaaaaaggatccgctggtaactaagagcgtgggtctcgctcgttgcctgacttaacaggacgcctcacggtacgagctgacggcggccatgcacctcctctcagctagtcaagcaaagtcatcaacctggctatcatacagctgtcgcctctggtgagatgtccggcgttgaatccaattaaaccgcaggctccacgcgttgtggtgctcccccgccaattcctttaagtttcagtcttgcgaccgtacttcccaggcggcggacttaacagcttcccttcggcactgggacagctcaaagccaccccaacaccaagtccgcatcgtttacagctaggactacccgggtatctaatccggttcgcgcccctagctttcgtccctcaccgtcagaatcgttccagtcagacgccttcgcaacaggcggtcctcccaggattacagaatttcacctctaccctgggagtacctctaacctctcccgatctcaagtctaatagtatctccagcaattcccacagttaagctgcaggatttcaccagagacttattaaaccggctacggacgctttaggcccaataaaaactgctaccactagagctgccggtgttaccgcggcggctggcaccggtcttgcccagctcttattccaaaagctctttacactaatgaaaagccatcccgttaagaatggcacttgggatcccccccgtcgcgatttctcacattgcggaggtttcgcgcctgctgcaccccgtagggcctggaaccttgtctcaggttccatctccgggctcttgctctcacaacccgtaccgatcaaaggcttggtaagccattacctaaccaactacctaatcggccgcagacccatccttaggcgaaaaaacatttaaacaaaaaaccattacaggaataattgcctatccagtattatccccagtttcccagggttatcccagtcctaagggtaggttatccacgtgttactgagccgtacgccacgagcctaaactcgttcgacttgcatggcttaatcgaatcccaatagcagtagcatctgccaggatcaaacagaattgaatgaaaaaagcagataatcataaaaaagctaaaatttatgaagtacgctaaaaaaatatagacgagtaataaatacacataataatttgatataagagttcctataatcaaatatcaccacatctacaaaaccaacatcatacccgaaaaactcaggtactcataaaagcacattctatagatattaaatttaattaatacaataaatatgataaatttatagccatatgtggaaaagcagtcatcatagttataattgtcaatacaatgtaacttagaccaacgccataagacacatggcacatctaatagacagggaaattatatgaacaaagttaattaaaaattattgcaaaaataattaatattccaccatactgaaaattataaattattaaaataaactaggtacaattaatttcataaaataaaatataataaatttaatctaaaaaaaaaattaaattttagaaaaggatcacaatataacaataatataataaacatcaaattcaagtaataaaaaaaataaaaaaaataatacatccttatttggcatgaaatttcaggtgtccgaacatgaataatatttaaaactttctatctaactcaaataataagtgctttatatattctttaataaattttaatatggtgataaaatgaagttcggtatagaattcgtaccaaatgaagacttaaataaaatagtagaacgtgtaaaattagctgaagaagttggttttgaatatgcatggattacagaccactacaacaacaaaaatgtatacgaaaccttagctttaatcgctaaagaaacagaaaccattaaaatgggtcctggtgtaaccaacccatatgtaagaagccctgctatctctgcttccgcaattgctactatcgatgaactctccgacggaagagctacttttggtattggtccaggagacaaagcaacttttgatgctttaggaatcccatgggaaaaacctgtatccacaataaaagctgctattgctgacattaacactttactcgctggtgaaaaaactgaaaccggtgcagcattaggtggagtaaaagctgttcaagaacaccttccaatttatatgggtgctcaaggacctaaaatgttagaaaccgctggagaaattgcagacggtgttttaattaatgcatccaaccctaaagattacgaagcagcattacctcttattaaaaaaggaattgaaaatgctggtaaaaatgtagctgactttgatgtaggtgcatacactgcaacctctatcggaactgattctgaaaaagctaaagctgcagcaaaaattgttgttgctttcattgcagctggttcccctcctatggttatcgaaagacacggattacctgaaggtatcaacgaaaaaatcggtgcttgcttaggtaaaggtgacttcggtggagctatcggattaatcgatgatgacttactccatgcattctccgtagcaggtactcctgatgaattcatccctaaagtagaaggattagctgaaatgggtgtaacccaatatgtagctggttctccaatcggaaaagatgtagaagaatccatcaaattattaggagaagtaatcgcaagtttctaaactcctaattttttcttttttttatttttttaaatcattgctgttttgatgccctgttttttacaaattcttactacttttctatataaattattctgatacttatttgaaggatattccctattataaaataagctttttacatcatccagtatttccggaaaattacttttaacaaaattataatactttattctagatgaaatttcactgcttccaaaaagtgaaagtgcacctggaattaaataggcagcattgcttttcctaaatactttaacaaaattttcaagactttccaaatcatcattaatataaggcaatattggcatcaatgcaactcctacatgaaaacctttcttagctaatgtattcattgcttttagtctttgtgaaggcaaaggtgcatttggctcaaccaaactagctaaatcatcatcaactgttgaaaatgaaaatgttacacaaacttttgattttaaacctttcaaatcatcaggcagtatcgctgcatcatttatcttttttagaatgtcagtgtcccttaaaattaagtcagattttgttataatgtgtacgggatatttgaatcttagaaatatttttaaaatctcacgtgttaattccaattccttttctatttccatatatggatcagatgccgaaccgaaatttaaaaatactctttcgtgatttctggctaatttttttaatttgttataaaccagatcacatgcattagattttacataatagctgttggttttctttgcatatttacttccgtttatataacagtatacacagtcaaatgaacatcccatatatggattaattgtataatcctctaaaaagagattaaaatttctttccccttttcttttattgaaaattgaatttacttttttgtttttaaatccatatttttttaagattaaatcattactattagcaaagtttttaattatatcaacaccttaaatattaatattaattttattataaggtatatataatggagattgaaaatttaactaaagaaattagagccctggcttttgagagaaaagatccaaaaacccccagccaggtagcagccagctggtataatgatgatttgacttatgacggagttgcaaaaactttatttattatattgcctacacccggatgttcctgggcaattggagacagcggcggatgtacaatgtgcagttatgtttcagactgtacattagagccaatcgacagcaaaaccatagtggacatattcaaacagcacctaaaccgttttccggttaatgaagaagataaaataactgtaaaactatttgcttcaggaagttttttaaatcctcgtgaacttccaaaagatgcccgtgatgaaattttaaatattttaatggacctgggcaatgttcatgaaattgtagttgaatccagagcagaatatgttaaggaagaatacatcgatgaagtggtagatattattggagatactttatttgaaatcagtatgggtttggagacttccaatgattatacccggcttaaaaaaataaacaaaggattcagtttagatgatttcaacaatgcagtatcattaattcaaaaattaaatagcaaaaaaggatataatcttaaatccaaagcatacatttttgtaaaacctattcttttaaatgaaaaagacgctattgacgaagctattgaaactgcaagatactgtgcagaccataatgttgacagactctctttctgtcctgctacaatacatggaggaactttaattgaaagaatgtggagaaaaggagcatatcagcctccttggatttggagctgtattgaaattataaatacagtacgtaaagagttggatattcctacattacttgacacttcaggtttcggttcaagacgcggaccttacaattgtaaaaaatgcaataaagacttaaaacatatgataatagccaataacttaacacaaactccaattgagtatgagtgtgactgtaaaaacaaatggttagctgaagttaataatgcagatatgaataagtcaactgtacctgcaaaacatctcccattatattaaaaaaaatattttttctaatataaagagatataaaatttaatttttatttttaaattccaatattttatcaaccagcaaataatctaaaattatcattacaaataaataatttaaatatattctgccatcactagttaatgaaggagtaaaacctgaaataatcacagatccgaaacccaatattaataatacaaatataaaataacctaactttttattgtctttataaatcagataaattgaatataaaggtattaatgtaattataagatacatcacaccacagctcagcattcttataaatcctaaacttaataaaccatgtttcaagttagttaaatcaaaataactataaacagtggtgaaatttgcgaatcttagtgatgcaaaaaataatactgccaaacagggaattaaagtaattatagttattttcttcttattagatattaaataagtataaaaaccaagcaaagctaggaaaattactgaaaataagtcttttgccattaaaatccaacttaagaaataattaatccctacatctaatttatttatgatgttgaaattagcataatccggaaatcccagtttagtaactacttttactctatttatatttcccggacagcagaaatcataaatgaaattaaaaagaattatgattataaataaataaattaatttaggaatttcaatctttttatataaacaataaactatagcaaataaatatgcgccaccaaccataaccagtaactgttcagagctaatagcttccaataatgtgataattaaaattaaatatattattgtccttttaaatttagatatgtccttatttttaaatataaattctttaagtagataaaaatgtattaatataaaacaaatcggccatatataatttgttgtagttgctaaccaacccgcagattccaatattttagaaaaagttaatataaataaacctacaaataaacaagccaaacaattataaaagaaaggactttcattattattagccagcaatttacttaataacacagcaatagctgtaaaaataactgaatccaatattctccaaatttctgtaggaacagataccaatacccctacattaaattctataagagatctggaactccaggttgcatacctataacttaaaaatccatttttagttaatgataataaaggatgttttgaaactattgtctggaaagtaggataatctgcagtaactactgctaatttccaatgataacacaataaaatgattaaaaatatcaaaaaaggaatatatttaacatattttttaaaattcatatcactatttccagctaaatcaataataattaatattatttaaacaacatgataaaatttttgcatgaataattttaactactttaaagaaaaaatatatgaatatataaaatattaaaattaatacggaggaaaaagatgaaaaataaatttgttagtttactgggtatcattttaggaataataatcatcgcatttccaatgattggtgttattgggaccagttccttaataggattatctgttcttttaatttctatttatctgcttgttgcaggagtagctattatagactataataaatccggagcaattattgatttaattttgggaattatactgttattcttaagtcttggtttaatatttaatcctaatttatttgcatttcttgcagaaatttcactttatcttgcaggaattgtactgattattgttggagttgttgctttagttaacaaccgccacgcaagatttggattttatataggcgtaagcggaataatattaggtttactctacattattgttggtacttacgttgcagaccctattattctaggtactttaataggattatggttagtaataaccggtgttttaaaaattatagatggttaaccccatcaactttttctttttttggtgttgaaattgatagctattagtgcagactttgacccagtacacaaaggtcatgaaaaattaattaaagaaggaagaaaactagctgatgaaaaacaaaaaaagctagttgtatatttaaataaaggatacagtgctaatcacggtccattttttgtaaattttgaagccagacgtgatatggctttagctcttggagcagatgaagtaaaatcattcgaaggtcttcaccatagacttgttttatcttatagtgttccaatcagattaaataaaatgtacgaagatggtgctactgattatattacctcagcacatatttcacttgacgaaattaaaaataaagctcaaaaatttgttaaacagggaaattttgtcggtatgcctaaaaattatcccaaccgaaatgaaatacgctggtatgccctaaatgaatttttaggatcgcctttggaatatcatgtaattcccgaatttaacaaagagaaatattccggaagaaaaatcagaaagtccatcttagataatgacatgacaattcctaaagaaaccagaaagctacttccaaaaacaactattgagattcttgaagatgaaatagctgccggcagaattccaggtgagcgcaattgggctgaaatttataaaagaatgaatacctattcaagaggaaatcttgaaaagatagcttacctaaacggaaatactataaatgaaataattaaaagaagagtttatagagatcctgagtcaatttgggcagtattcagaagggcaaattacggaccagttatgaccaggctggctgtaagtgctattgaagaggaagttactaaaaaagaagtaatggaccttatgaaaagttatgaagctaaaggagttattcctgaaggtcagaaagttcaaagagtaattgatagagcatggtacgttgcaaatgaaggtgaaaaaggagtaagcgccaaagaagccaatgaaacctttagaaacaaaaacattaaagttgatactcctccattgaacattcatgcaggtttaaatttaaccaaattcgaaaccaaaattgtttcagaaggactgaatgctgatttatatattgataaagataataaaatttcagttcagctaaaagcagacggtaaaaagattaaaaccaatttaagattacctgcaaaagaagttacttatcttagatacattatggattcaaactttatcccaacaactgcacatataaaaaaggataaaaaaggatataaagttgatataactatcggttgagctttttaaaagaagctttaaccattgtcaaatcctggttttcaaaatagtcaattatctgttctaattcttcagcctttctttttttggaattttttgtattgttaattcttgacaaagcgctttttttaaaatcttctccttcggttaaagataaaatatcaaaaaattcctcttccaaattcaaatttttagctacttcagagctttctattaaaacagctgaaagagacttggtatacatgcttctaagtaattttaatttagatgcatcaccaggattttcactgatttttcgaatttccaaaaaatcatttaaaaaatcaagactttccagatttttcccggacagatataatatcggatttgcagaatctatttttccaataatcgccccgtctacaaaattatttacatgtttgttaatttctaaagtttctttaggagaaatgttatttaaatccatatagattcctttagaatacttcccatatttgacagctacatccaatgcctgatttggactgtttgctgaaattaaaatatctgaaagagtagccacctctttaaaagtatctaaaatttccacatccgattcttccatatttttaatcgtgttttctgatctgttttgggcggaagttaaaaaagtaatattttcagagttaattaaccgtactaagtttctagctacctttccgaatccaataaatcctattttcacaaaattcccccaagagctgttattaacatataaatagctccaaatataattaatattgcaaatattttctgaatatgttctgttttcttggcaaatctggagatatccatactagaaattatatatcccagaactaataatgttaatccgaatccaaggcaatacaaaagaatgttgactgctacaaaagcaggatttcccgaacttacaagcaatgtcaaaagtgaaattaaatatccgctgtaacatggtgcccatgataatgaagttaaaaatcctaaaataaacgcattgtctctatttttataagttaatgctggaaacctacatgaacatgaagttaataaaaatccgccaattaaaagtaaaactaatgcagatataactcgaatataatttaagtatctgtaaatagctgctgtaaaatatactgttgcaaacagtataattataaaaatagcaaataaacctaaaacaaatgaaatgatttcagtattttttctcttttttaaattaaatcctataaaaataggtaaaacaggtaaaatacaaggagataaaattgaaattactcctgtaataaaagaaacaaacagaaaaatttccataatctctcctcatatcatttttattaaatcctctggcccataatatccttcaatagattttaattcattaccttcactgtctaaaataagcatagtaggagttgaataaacattgtacttactggctatttcaggactgtcattaacattaattatgacaactacataactttcattaagtttctccatgacttgagcatcatttagagtattttgccttaactgatggcaataagtacatgtatctgattcaaaaacagcaaaaacctgtttatcacttgttttggctttttgaagtgcttcagacaaacttcctgcagtatcaataatgttgaattctgattcggaagcttcttctttttcaaaatcaccattgattgaaaaccatccgcttaatgcaataattacaattattatgaaaataatgaaatataaactacattttttcatgaatgtattataataaatcatcagatatattagtttctattttttaaaagtaacatatcatgtaaatttacaccaatattttttgaaattgttgtacacttggaacataataaaaagaaaacttccttagaagacaaatctatttcagttaacccctcataatttcccattcctttagaaattataaaatcatgagctgaaaaaatttctctgaattcatctgaaatttcactgtctacatatccaactgttcctgcaccaatatctacaatttccccaaattcatccagccccacattgattgcgtcctgtctgcatgcatcatttataattggcctggatttgaccgctattgtaatatccaaatcatactgttttattttagaaagcaaaagtttgtcaaatacaatttcacctgtattgtcaaccaaatacagtactttattatatttttttaaggcattttcaaactcatcaatgtctttaacagccagatttctttctaaagcagagcttattaaacttccaacatcagtatctatagtaaatgctccaaaatccagaatatttcctataatagctattttaacatagttttccaaactattattctttttgagaacttccttaactgccggcagatattttaaagctattttgttgcctgcaattttttcattgatatatggatcttcacagccggttttttcctgaatcatattatggatggttgaacctgttttgtttgaattggttgttttatagaaattggaacttaaaaatgtaaatatatcattcataagttctattttaaggtcctcatcatcactagctaaatccatagcctcttttgcctgtcttaaaaaacatgccccacattcataattgattttcacttaaccaccataaataatctgaattaatcgtatttcatcatcatcgtggatttcactttcttcaataactaattcaccattttgttttggaacaatagtttgtgaagacaattccaaatcatttaataaatctttaattgtgtaactttcttttggtatgtctctttcttcactgatatctttgaatattaatgtaaatgtcatatcatcactttcctaattcttctaaaaatgtacatgctttgcataatctgttggctgacggttcaccgcacctttcacatcttgattgaggataagtttttttaaatccgtctccaatagcttccttaattttgtcatatcccctaagtgctgaatattttattgtaggatgtttttctgaaagtttgtttatcaaatctgaaacttcccctctgaaggactgctgcgcataaggacagctgtcaaagtgaacttccagttcttttgcaactacatacaaacctatttccctttcaggaatttcgcgtaaaggtttgattttaactgtgaattctttagcttttgaagatgatttggcccctaatttagttagattatcagtgtttccttcaagataattcatcataatagcctgaacttcatcatccagattatggccggtagctattttagtagcacccatttcacgggctgccttatttattatggttcttctgaaaacaccgcagtaactgcatgacccgatatgattatccttttgcattatttcatctaaagttattccatattcctctttaagagaaactaccttatgttcaatacccaaacgttttgcatgacgaatagctatatctacaccttcctgacggtagttatcaattccttcgtcaacagttactgcacagatatctataatgttcattttacggaaactgtttaggatttccaaagttgttacactgtctttacctcctgaaagtgcaactaaaactttatctcctttatccaacaatttttcctttttaactgttttaataacttttttttcaattgattcaataaaacaatccttacataagtattggccggattgctgttttttaataataacttgagaattaccacatttactacattgcataactacacctacatttgctctacaaattgagctaattgatttagagtatttacttcaaatacatgaactcctgcatcttcatataatgaaacacaactatctacaatatcccatttatttctgtcttcaggatttaatattacaacttttttagagtttttaaccatttcaccgaccaaatccacacttgccggaatgccttttactttaggtcctgcccaatccctacaatcagacagtataataacataagacttattgtttaacttagccacatccataaacttctcaaatgcagtatacatattggaggttccgtgaaccattgcatttttaagtctcatgtctttaacttttgtaaatgcatcaattaaatattcctcctttaaagcacccgttgtttcaataaccttattatcaaattcaaaagttcttgaatttttaaatgcactttgagctgaaaacatcaacatgaaaaaccagctactgatccattcacaggatccactgatatcatttaggaacaggtgttcatttttatgaggacgtggtttagctttaatcagttcaaaaggaacgccaccatatttcatatttgcccttatggttcttctgatgtctattctatttgaactggtttgaattttccttcttgaacgtttgttagctatttttctgcctaatctttgacagatttcaagcattcttgggtcaaatttgttaagttttgtcaaatccttatttaacaattctccgtctctttcaagtttttgaacttcatcaagtaacggctggccagataactgtttcagtttttcattatcaattttttctttcttaattttggtggaaatattgccctgttttttaataatatacttattagatttaggtcctgttcccttgtaggctttgcctctctgttcagcatcaagaacttcctttttcttggcttcctttttgaaaacattttcaaatatcttgttgaacttaggaatatcatatttgtctttaacataaattgctcttaaggctgtttttaaaagatttctgtcatcttcgcctaattcacgataaatttgagcagctgactgtgtacttctaacactaacaggcaaacctacttcccttaattgatgagacaaatctgcaactttatcaatcataatatcattataattaatatttcttatgaattacgtcttttaaaactctttttttatcactttcagttttaatagctacaccaatactgtcctctaaagatttattgaaatttttagtacctaaactggaaactgatctaacccaatctacagtccctcttacagatggttttttcattaaattaagattacgtatctcatgcactattttaactatttttgaaactgtttcatcttcagcaccaggaagtcttgattttacaatttcaatttcacgttcaactgaaggatatgggatatataaaaacaaacatctgtctttagtttcatcaagtaaagacctttgagagttagatgttaaaataacaatcaaatcatttgctaactggaatgttcctaaatcatttatagttatttctttttcacctaatgcctgaagtaaaaaactttcaacttcctcatctgccttatcaatttcatcaataagtaaaacagaatccttttcatttaaaaaagcatttaataaaggacgcctaataaagaattcttcatgaaatattttttcttcattgtcagattcgtttttggctgcttcaaggtgtaataattgtttttgataattccattctccaacaatctgttcaaaagtgataccttcataacattgaatcctgaagaaatccctatcaaaagcactggctattactttagccagctgtgtttttccaacacctggaggtccttcaataagcatcggttttccaagtaaaaaagataaatataatgttgttgaaatctcgttatccgggacataattttcatttaaaagaattttgtcaatttttttaacagataaatcgtcaatttgcacaatcaaaccttctttattattatataattacaagtattaatgatgcatttatttaaaagttttgaaaatagaattaaattttaaattcatccggatttttaaataaatcaaagtcctgaacatattcttttccagtaatcatagctatttgtgctttttgaagctcactgcccaaatatgctgcatgttccattcttgttacaagttttttatttattatttcttcataaatttcttttgcagtatttccaacaattaccagatcagctttgttctttttaaaatgtgtagctataatcctgctggatttaacagtagttccataatcaacactgattttgaaactccctgctttatctcttacaaatttcataggttttgcctgtttaacttcaggaaccccatcagtttcattttcaattatatccaatcttttatgcttatctttaaattcaacaaggttaattcccaggtcttttggaatagattgtctatgtttagccaaaaacatcattttagatgctgttgataattcataaacactgccccttgtttttccactttcttctggagtgaataatatgcttacgcccaattccatacctattcctgcaagaagaacattaactcctcccgaatcggcatccatcagttcagtaacatttccaactccaaaaaacattggtgccttatttgttttatgaaattcaaagcaggccataattgattcaacaatactgctgctgtttacaggatccaaaattaaatctgcaacataatcaataccttttgtatcttcaattagctggttcattgcatttactctctcttcaggagtttttggagtgaaaccttctgaaaaattagttggaagcaaaacagcaggagtattggtttcctttaaaacatcaagtactttggaattatttcccaaatccaaacttaatactaaatcaataccatgttttgcggctacttctatttcctttgcatttaatgtgtcaatacttaacggcctatctccaacaattggccttaaggtatcaattaattcaggaaccttatctgaaaaatcttcacctgcagccatacctatatcaatcatatcagctccagaatccacaaaatattggcatttatgaattaaagcttcttttgacaaaaatggagcattagctatttcagacagcacccgcattggaaaatcttcacctaccggaagattcccaatcatgatgttattaggtttttttaataagtttttgattgtttcttcatcattttcaaaatcattaatgaattttaaagcttcttttcttttctcttcttcaatcagtttatctgcaggtttgtcctcagacaattcaatctgatcaattaaatttaagaccatggccaaatcagccccatcagttgaacctttaaaagtaggaattcccaattcttttgttatttctctggttcctttttttattaaaccaggaactaaaatcatgtcaatttcccctaattgattagcaaaatgagtttttatttcatcaataataattctaggagttaaaaatgcagccacctgcgtattatcagctatatgaatgataacctcaacattagcattagctacaacatttttaattaaaggatatgccaaatttccagtaataattaaaactttcataaactcccccacttattcataatattaatagttatatgactatttaattattataagtaactacaaaacaaagaaatatactccacttaacaatattaataatataaaatattcactaaaaaaggattataaaatctataatgattatccatgataaactttatatattttgtaatttataatgattatacatgataaactatggaggagactaaatgattgaaattcgttttcacggacgtggtggacaagggtccgtaactgctgctgaaattttagcgaaggctgcttttaaagatggtaaatacgttcaatccttccctttctttggagttgaacgtaggggagcaccagtaatggcttttactagaattgatgacaaaccaattgacataagataccaagtatacaatccagactatgtattagttcttgatgatggattaatgaatgtggtggatgtattttctggaataaaagaaaatactgaagtaattatcaatattgctgaagaatttaaaggttcaggtgaacacccagttcatagcattgatgcaaccggaatagcattagatttattaggacgtaatattgtcaacacaattatcttaggatactttgctaaaaaaaccaatgtcgtaagtattgaatcacttattgaagtaattaaagaaacattccctggaaaagttggggaattaaatgcagaagctacaaaaaaggcttatgacatgggataaaacataaggagaaggtgaattaaaaatggtagctatcggatgtgtaataaaaacacctggaagtagtaaaaataacaaaactggaagttggaggacttttaaacctattttagataaagaaaaatgtatcgattgtgacaattgtattattttctgtcctgactccagtgtaaataaacaacatgacattaattacgattactgtaaaggatgcggaatttgcgcacatgaatgtccttcagatgcaatcgaaatgattaaagaatagggagtgaagaaatgacaaaagaagttatgacagcaaataaagcagttgcagaagctgtaagattagctaaaccacaagttattcctgtttatccaattacacctcaaacaacaatttcagaataccttgcacaatatgttgcagatgaaaaaattgatgcaaaatatgtgaaagtagaatctgaacacagtgcaatcagtgcatctgttggagcaagtagtgcaggagtaagagtatttaccgcaacatcttcacaaggattaatgttaatgcacgaaatattatttgcagccgcaggtatgagaactccaatcgtattggctgatgcaaatagggcaatatctgcaccattaaatatctggaatgaccaacaagattcaattgcacaaagagacgcaggttggttacaaatatatgttgaaagtgcgcaagaagctttagataccacattaatggcatataaaatttctgaaaactatgatgttttacttccatcaatggtatgtttagatggatttattctaactcatactgtagaacctgtagaaatcccaactcaggaagatgtagataaattcttacctccatatgttccaaaacatgctttcttagatcctaatgaaccaatgtccataggtacattagctgatcctgattactatcttgaagcaagacatgacatgcaagtagctatggaaaaatcaattccagttattgaagaaacctgcaaagagtttgctgaaatattcggcagagaatacggtcttattgatacctataaaacagatgatgcagacatcattttcgtagctatgggttcaatgtgcagtactttaagagttatggttgatgaattaagaaacaaaggagaaaaagtaggtttacttaaagttagagcttacagacctttccctgttgaagctattgaagaagctgtgaaaaatgcttcaaaattagcagttcttgataaaaatgttacattcggaattggtggtgctctctacaccgacattaaagcaaaaatccataaagaagcatacggatttattatcggtttaggtggaagagacattactccagaatcaatcttagacgtttatgaaaaaacaaaaaatccggaaaaagaagttagctggataggacttaaggaggaataaaaatggaaatatctgataaagaatacttagcaccaggacacagaggatgtgcaggttgtggagcttccattggagttagattagctcttaatgcattaggaaaaaataccgtagctatttcagctaccggttgtcttgaagtaatgacctccccttacccagaaaccgcttgggaaattccatggatgcatgtagcttttgaaaatgcaggagcagttgcatcaggagtagaaagtgctttaagaattcaaggaaaagatgatgttaatgttgttgctttcggaggagacggaggaactgtagatatcggtttacaatcattatccggagcaatggaaagaggacacaacttaacctacatctgttacgataacgaagcatacatgaacacaggtatccaaagaagtggtgcaacaccttacggtgcaagcactacaacttcaccaaacggaagcggcagttttggagaagacaaacctaaaaaagatatgcctatgattatggcggcacatggaattccatatgtagctactgcatctattgcatatcctgaagactttgtcaacaaagttaaaaaagcagccgaaatcaaaggtcctgcatacatacatttacaccaaccatgtactacaggatggggatttgcttcagaaaaaactattgaaatgggaagattagcagttgaaaccggatcatggattttatatgaagttgaaaacggtgaattcaacatcacttacagaccagatgaaagaaaaccagttaaagaatacttagctcctcaaaaaagattcaaacatcttgatgatgaacacatagaaaaaatacaaaaatacgttgataaatcctgcgaagaattaggcttataaaggaggaataatagtggaaaaaatatttgtaaatagagatgcatgtgatggatgtaacaattgtgtaaacatgtgtgcatctattcactctgctcctagaattaaaattatagagcatgattccgcatattattcattagtttgtcaacattgtgaaaatgcaccctgtgttaaaatttgtcctacaaatgcaatgactacagacggtgttaaaactgaagattgtatcggatgtggattatgtagtattatttgtccatttggtgcaattacaattgcagaaagtgtagctgaaaaatgtgacctctgtgcagacagagaagaaggtcctgcttgtataaaagcatgtaccaaaagagctatttcagttattgatcctgcaaaaatcaaaattaaaaatcaggaaaaatatcttgcaaaacttgctggagaatatgatgttggaagtacctctggccgcggtttcgtacactttgtcaccagtgctgcaagagcaagattagctcttgatgaataaatcggaaaaaaacatgactgaaaaacttcacataaattgtgtaagttgcggaaattgtcagcatcccagagatgctgataatctttcattattttgtatggaatgtcctcccaatgaagctccctgtttgaaggtttgtcctaaaaaagcaatagaaattttaggaggagcaattactttaaataaaagcaaatgtgataaatgtggagaatgtgtgaaagtatgtccacttggcattttagacaccatcataaaatagctatttttaaaaaaatttattaaagcttaaaatataaaattataattaatttttctttttaaaaaaaaaaaatattaaataaggtttttattttgattactcaagacatgataaaagatgctgtttatgaactttacaaaaaagcagcaatcgttttaggaaatgatgtaaaaaaagcactagaagatgctcttaaagtagaagataatgaacttgcaaggttaaatattgaagctatcttaaagaatattaaacttgctgaagaaaaacaaattccaatgtgccaagatacaggtttgccagtaatttttgttaaattgggaaatgttgaagttgaaaatttaagagaaggaattgaagaaggaattgaaaaagctacaaaagaaataccaattaggccaaatattgtagatcctataacaagagaaaatacaaacatcaatgtcggagactacattcctccaatagatattgaattaatagatgaagattatctcgaaataactattttaccaaaaggatttggttcagaaaacaataatgctatgaaaatggctcttcctgctgaaggaattgaaggcataaaagactttgtagttgaatctgtcctgaaagcaaaaggaaaaccttgcccgccaacagtaattggagttggaatcggtggaacctctgatttatgtttaaaattaggtaaaaaagcacttcttggagaagttggtaaaagaaaccctgatccggaaatagctaaactggaattagaaattcttgaagaaattaacaaatcaggaatcggaccaatgggattaggcggtaaaacaacaacattagatgttaaaattctaaaagctcacacacatactgcaggactgcctgttggtgtttgcgtacagtgctgggcagacagacatgcaacaactaaaatttatgacaaaaaataaaaaataggattgattatttaaaataatcaatttattgttcttctttttttaattcctcaatatgaggtcttttatgagtattgatgaaaataactctttctccaatattaactaccctatcggctattctttccaaatatcttgcaatgaaaataatattgacgatttccaatgcattctggattttttcagttaataattcagtagtatgggacaatataatatcaaataaatcatctactttatcatcatcactagctaactctcttgcaacgcttatatcctgattacaaaaagatccgaatcctctagtcaacatgatttgaacataatcagccatgtactccaagtctcccattattttatttgaaactttaattccttcaatagtagctgctgattctgcaatatttctacataaataagctattctttttacatgagaaataactctaattgatgattcaatatacattaaatctgtagctaacggctgttccattgctataaatctaatacaactcctttcaatttcataaccgcaaacatctaattctttagctttttcaacgacgcctgctgcaatttcttcatcgaaattgaataataaagaggttgattttctatgtaaatctaatgtgtcattacagtaatttctaagatttttcttaattgattccatcctttcttcaaatacataagtaggatattccttattcttcatcaaatcaccttaaccaaatcttccagtaatatattcttctgttttttgttctttcggatttacaaatatttgatctgttaaaccgctttcaattatttctccgtttaagaagaaagaagtgtatttagatacccttgtagcctgttgcatattatgtgtaaccataacaatagtatacttttctttaagtttatgaattaaattctcaattttcaatgtggaaattggatccagcgcagaacaaggctcatccattaaaattacttccggactaacagctattgtacgtgctatacataatctttgttgctgaccaccagacaaacccattgcagatttatctaatttatctttaacttcatcccagatagctgctgattttagactttcttcaactacctgagcaatataatcttcatcttcttctccatgaattcttaatccgtatgcaacattgtcaaatatagattttgggaatggatttggcttttggaaaaccatacctactttttttcttaaatcaacaacatctacagcatcatcataaacatccacaccatccaaactaatattaccgtcatgactgaatgttggaattaaatcattcatacgattaactgttctgatgaatgtagatttaccgcagcctgaaggcccaataagtgcagtaacagaattctccggaacatccatatttacattttttaaaatctgagtatcctcaaaaaatgtatttaaatttctaacttcaagtttcattatttatttccccataattttcttttgatacctgtcaacaaccaaattagttgctatagttaatactaatacaataattaccaatactgctgctgttccatatgcattttgaagtgaaacaccttcagtagctaatacatataaatgaagcggcaaaggtctacccggatcaaatattgatactggaactgttatagcagatcctacagcatacataacagctgctgcttcagaaatagctcttgtcatagctaaaataacaccagtaattattccaggtaatgctgcaggcaaaataactgagtaaataacctgccattttgtagcacctaatccgtaacctccttctttgtaggaatttggaatagaagataaagtaacttcagcaacttggaaaattgttggaatagccattaatgctaaaactaatcctccggacaatatacaccatcctaatttcaagaatacaacaaaaaatgccaaaccaaacaaaccaaatacaatagatggaattgaagccaatgtttctgatccgaatctgatgaatttgataactttttgatttgatgcatattcagacatgtaaatagctgcaccaacccccaatggagtagctattattgcagcaatgaaaactacatatatacttgaaataatcatagggaatattccaccttcccttccggcatcaataggacttgagaataaaaactcaaaattaataaccggaagtcctttaacaagaatataacctaatatagtaaccaatataagtaatgtaataacaccagacaatatgaatacaccattcattattttctgggaagtcttaggagagcaaaaactcttcattcaatcccctccgcaccaataccatatttattttgaacatgatttgccactaacaataaagcagcaattataatgaataatacaacagcagtaccaaataatgcattataatgtaaatttgtagcataacccatttctaaagcaatgtttgttgtaagtgtcctgaccggagcaaatattgaccctggaatttgagcaacattacctgcaaccataattacagctaaagtttcaccaattgccctgcctataccaagaataactgcagtaataattcccggcagtgcagacgggaaaataatatggcgaattgtttgccaatgagtagatcctagacctaatgctgcttccctatattcacctggaactgctttaattgcatcttgagaaactgatataatagtaggcaatatcataactgataaaattaaagcagctgtaaatacactaaatccagtacctccaaaatgttgacgtacaacaggtaccaatactgttaaaccaaaaaatccgtaaactactgaaggaattccagataatgtttggataaccggttttaaaagtaattttattttatcaggagctatttcttccatgaatatggcacataataaagataatgggactgctatcaccaatgaaagtaaagttacaaatattgaacctataatcattgggaaaacaccaaattgaccttcgttaggagcccaggtacttcctgttaaaaaatggaaaaatccatatgactgaaatgcaggaattgcttcactaacaataaatgccaatattgtaaaaataacaagaatggaaaagattgctgttataaacaatcctttctcaataaaaaattcattaatgtttttagtttccatcaaaccactatgaatctattttgaagttttaataattttttcatcagccaatactttaccaccgtcatcacttaaaacccaatcaatgaagtttttagtttcgccagtaggttcaccattagttaagaataaaaatggtctttgaagttcgtatgtaccatcagcaatagtagcatcagatggtgcaactccattaacattaactgctttaatatcatcactcatatgagcataagatacaaaaccaattgcattaggatcttgggaaactgattgttttactgcttcagtagaactttgaacaacagcatcatctttgattttactgtctcccataacaatactttcaaatgcatctaaagtacctgaaccttcttcacgtgtgatgacgtttatttctccatcacttccacctacttgattccagttggtaattttaccagagaaaattccttgaatctgttcatcagataaatctgaaacttggttttgagtattgattgcaattacaattccgtcttttcccaattcatattgctgtaaggaactgttattgtctaaagcttttgaacacataccaatatcagcagatccgtcttcagcacttttgatacctacactagatcctccaccttgcacattgatttgagcatcaggatgagattctttataaacttcgactaacttttcagcaacaggctgaactgaggttgaacctgccacttgaacctttgatgatcctgcatctgcagaaataatcaaagcacctgcaattataacaataattgctataataccaattaaatatttatttttctttttcatttttctcctcacataactatcttaacaaagcagtatataaatgttactttttgtgaattattgttcctatttagtgaaaataaggcattaagcgaaaggatattttatgaattaaaattcctaaaaagtgaataaaaatagaaaaataaaaaaaataataaaattatctgaatgtacgaggagtggtggacctaggtatattattatggaattcaatagctacatcaataatctctatagaaatatctcctatcctttcaaaggctttaacaaccctaaatagatacatgaaataattagaacgttctttttcatcaaatgaattttcagccatttgagtggctattatgttaatagatttattttgaagcatatgcatagattcttcaaaatccatgatatcatccttaagattagtttttccttctaaaaatgcaagcatcgcagacctaatcattttttgagcagttttatgcattttctttaaatttttaagaataacttcatcaacctcataaacatcctcaattacgaactttgcaatatgtccacaataatctccaatacgttccaaatcataagctacttcattataaagcatggatttagataattccgaatgctgattaatactaacaatagtttcaacagaagttctcactttttcaaccatattattagttgtataatccatttctaaagcaagattagctttattttcatcataatcctgaacagcatcaaatgactcctgtaactgagactgaacatgcttagccatgtttgacagcatatcattaactaaaatatatccagaatcactaactggagcataatctccaaaggattctgctaatttttcatatacatttaaatcaatcatatatgctcttttaacagttccttcctttacaagaggctgaagcagctgagtaacataacgtcgtgttatccccagtttttcagctatttcatcttgagtagatgggttttcatataagatacaatctaaaatatctttcaatgttttattttttttactcataatatctactttttatagtcatctaaaaactcattagtttcaaattgaatgttttcagaagatttgtttatttggtttcgtctgactctatgttttattggtttttccctataaccatgctccctataactattatcttttgaagatgcatccattcttttttgacgaatttgtattagctcaagatcatccaaattatgattaaccggacgttttttaatttcacctttagcttccttagcagaaatcaaaatcttataaattactgtagacaataatacaaatgcaattaaagctattgggaaatcaaaataatggaatatgtaatacaacactaaaaatccactatcacagaaacctttagctaaaaatatcagcccaataaatgcaattaaacctccatgagattttttaacaaaatcaggttttaatacaaatggataaacactcataatcagcaatgagaatcctaaaactctatataaattattatctgcaacattttgaagagataaataaacatttaaaaatgttgatggtaaaaatcccatttcagacaacatagcaaaaattaacaatagctgaattaatgccataacaattaatggaaaggaatatgctatttcccactcaaaattagctttaagctttgcattatcaactggtttttgtaatgcttctgaaagtacattataaagtacagaagataatacagaaccaataatagttcctgcaactccaagtaccgcagtagtaatagctacaaacgctgaaatgaaagccaccaaaataatttttgaatgattcaaattttcacctttattatagttaattaattaaaaaaaatgtaataaacattttatcaattattacattttattatttaattaatttataattttaggtttatacaatattaaatgcattaggaactttatttaaaattttattactgatacctggaactgttgaagagataatagaactatctgcctgcttagcactatttacatcaccatctccaggaataatagttgcatctaatgcatcctgcaagttctcaacagtcatacgttgaacccatgggtctgcatcagatataataatttcatcaacttgtttatccaattcattagctattacccaggaaaggaacctcccaccaagtaatgccacactatttccgttaacagaatttacaatatcatttaaatcattttttaaagtaagatttttatacatttttgaattaattaaagtagcccagtgtgcatcacctacagtatatgcaccaatctttttcggatagatataatctcttccagctattttaattgctgttgtaagtgggattaagtcttcttttaaaacaggaacctgaacattaggattatgaacttcctctttcattatttgcattattcttggaagaccaaatttgcctcttctggcagttccaggttcatacccgcacatatatccgtgatggttttttggaaaaccagttataataacattcagaccagatctgagacctattctacattctctttcataagcaccattagtacctaccactttacccggacataatattctggaagctgcaactgcttttgcaaatgcttcaacaggatttttagcaccattataaggtcctccttcaagtacaaatacatcagcacctattccaatagctttttcaaatcctgtaataagatcatcataaccgtcaccaataaacatgatagcttcaagacctctctggtatttcttagccagattagctatatcctctgcttccctgtaaggtgccgcatgaccctcaccagtctgttcactggttaaattaatagctactgaagatgataattttacccattcttccttatctgaagattctgctttttctttatcaattaatctttcatgaattctatctctcggacattcagtataaaccggtcctttattataacattcaccgccacagcctacaatattctgcggaagtctcataggtccgttttcaccaaaatgatctaaatcaagaggaacatcaacactgtcatacacctttctcattacttcgataccgcgcatgccatgtttttcagcaatatctgcaaatgcatatgcgcaaatatgaataggcaatcccaacatatctgataaacggcagtttccaagtaattccattaattccaaatcagatgcacatgttccaacaaccgcttcggtcaagtcacagcctaatggaaatcttttaaatttcattcccaatttcattgtgtcttctaaagacaattcagaaattgcatcaacaacttcaactacatttttatccattttggacaattcaatagctgcatcgtcatcaacaatagcttctttaattaaatcatacatttgattacaacctttaaatttaattaaatatattatatgaacatatcaaataaataaattttgttttataagttaagaacaatataagcattatagccaaaaatatcttaactcaagtacggcaataagtttttaaaaatcgtatataaaaaactagttattacgaacagaattacaatagtaatacttaaaaaaagctcaaaataacttaaaaaaatcaaaagtaatacaaaaataaaaaaacgaaaatataagttaatactactaaaaaacagatgtaaaaacttatatattgtaaagatataataatttaattgttactacaactgctgaattcagcgaaaattatttaaaaattagaatgaatgtttactaacaaacatgaaattcttttatataattaatagggagattattaaggcacattttaaataattattaatgtagtaaatgttttttaagaaacttaaaaaataaaatatatatatgttttaaaggagacaaaaataatgaaagtagcaattttaggtgcaggatgttacagaactcatgctgcaagtggtattacaaactttacaagagcttgtgaagttgcagaagaaaccggaaaagaaaaaatcgcaatgactcactccactattgaaatgggtgcagaattattacaccttgctggagtagacgaagtagttgtatccgaccctgtattcgacaacgactttaccgtagtagacgatttcgatttccaagaagtaattgcagcacacaaagctggtaaagcagaagatgtaatgcctgacatcagagcaaaagtaaatgagttagctgaatccctccctacaccacctaaagcagctatacacttcgtagatcctgaagatttaggaatgaaaaccatgaacgatgatgcagcagcagtagctgacgctgactgggtaatgacctggttaccagaaggtggaatgcaaaaacctatcatcgaaaaattcgcaggagaactcaaagaaggagctatcctcactcatgcatgtaccattcctaccaccgaattcaaaaaaatattcgacgaatgtggagcaaacgtaaatgtagcttcataccacccaggtgctgtacctgaaatgaaaggtcaagcatacatcggtgaaggatatgctgatgaagcatccatcaaaactttattagaattaggtgaaaaagcaagaggatctgcattcacattacctgcaaacttattaggtcctgtatgtgatatgtgttccgctgtaactgcaattacttacgcaggtatcttagcttacagagacactgtaactcaaattttaggtgcacctgctggatttgcacaaatgatggctaacgaagctttaacccaagttactgctttaatgcaagatgaaggtatcgacaaaatggatgaagctttaaaccctggtgcattactcggtactgctgactccatgaacttcggtccattagcagaaatcgtacctactgttttagaaaacttagaaaaaagaagctaagtgaaacacttaaaataagttcatgttgatttcatatcaacatgcaaaacttattttttaataattgagtcatattagctattaaaaaataagtttactatttttatacggatttttattatattaatattctcaaccgagggttcgaaattgattgatgaaattttaaaaaaggctgtaaataataaaaaaataagtgatgatgaatttcttcaattattaaaaataaataaagaagaagacttgaaaaaattatgtgaaactgctgtatccattagaaacaaacattccaaactaattaaattgacatcaacagtccacattacaaataaatgtacaatccaaccaagatgtaaatattgcggatttgcacccaaaacctcaactgaaggatattatgaatctttttataaaacagatgaagaaatacttaaagctgcaatatccattgaagaagcggggatccctagagtaagctgctctggaggttatggctacaaaggcaaacaggcagttaatgcaacagaaattgttaaaagcaatacttccttagaaattttggtaaatgttggaggagatttaacagaaaaatcaatcaacaaactggctgatttaaatgcagatactgtatgctgtaatttggaaaccatcaatgaagatgtttttaactttgtaaaacctggagaaaccttaaatgataggattgaaacatgtcaaggagttagtgatgccggaattgaactttcatcaggattattggtcggacttggagaatctctggaagacaaaatagctcacctacgttatttaaataattttgaaacacttggtgaaattccaataatgggatttaatccatataaagacacccccatggcaaatcatccaccttccccactggaagaacagctgaaaattatggcagtaacccgtataatgtatcctgaaataaggattacagtacctaccccaactataggtcctaaaaatgtggaatattctttaaatgctggagctaataatttagctactgtaatagctgacaattacccattagaagtaaaaggtgtaggatcacctgtttgtggaaactatgatgatgtagtttccgttataaataaattaggtttaacaccacaaacaatctgaggctaaaatatggcttttgaagaaatgattaaaaaggcattagacgaatcaagaaataactgtcgtttgggagatactttagaagaagtacgggaaattcaaaactatattaaaaatgctgaaaagatttatatcccaaataaaaatgggattaaagttgatgttttaaataaagttttaagagaatataatttgccttctgctaaaatacttcaaataaacactaatgaagcagacagtaatcgcagtcctgcttttgcaaaggcaattatggcattggatgtatgtgatgctgatttaataatagccaggggtcgtttaggattacccggttcaggatcacttttactttttgtagacaacaaaggaagaatactgacctgcggaacatcaccttcacatgcaatcagtcaaaaaacccttgaagatgcagtatatgaggaagcaaatgaagctttgcaaaaaataggatttagaaaagaaggctaaaaatatggatgttgacaccggaataacttctgaagtttttactataaaatctgaaactaaactaatagacatttttaataatatcattaacaaaaaatctgaagcatgcctaaattacattgacagtttaaatttagataaaaacactaaaatcgttgttgttggaacctactttacaggagtaggaattgtcaaaaaattaaggaaaaaatacaacaatattctgctaatagatatttatccccacttgaaagaattactggatacggatattggtggagattataaaaaaagtatagaattttcaaccagtttggagctgattaattcaggagatgtagttattgacactacaggttttggaggattaactgttgaacagtcatctgaaattaatgctgaagtatttttaatagaagatccagtggctgaagataatgatagattacttaaagataaaaataatattcataaaagaataaatgctgttaatgcacctaataaagctatcctgaaaactaaaggaatagatactaaaacatcagggactatgactttaactattggtgttttgacaaatgcattacatgaatcccaaaaaatggaaggtgttctttatagtgcctgcgaaatgggattttttgaagaagttattttcaaaaaaaaagatattccaaaatttattaacttaattaatgcaaaagctatgaaaatatcaactatcaacccgtttagctgtgatgatttaataaaaacacaattagataaaattgaatcaaaaatgatttaaatgaaacttaaagaaattattgagtttatagacaaaaacatacctaaaaatctggctttagaaaatgatgaaataggttttaaaaaagaatataatttaaatcaggatatcagctccattaaaatatttatggatttatatcctgaatttgacactcaaaaaacaaatactttaattttaactcatcatcccccattatttaatccaaaaacaccaacttataccattcactcaaattgggatattattaatggaggagctaatgaagcactagctgaaacattaaaattaaatgtcatatcaccatttgataagactacaaatattggaagaatctgcaaaacagacaagtcatttggtgattttgaaaaagatattttagatagctttaacgaaattagaattgtaaataaaccttccagcagcaaaaagcttaataaaattggaattgtttcaggatttggtcttaaaaattccgaatatattaaattagccaggaaattaaatttggatttgctgatatctggagatttgactcaggaaagtgcagttttagccaaaaacttaaatattactttaattgatttaggccatcacagcagcgaagttccaggattatacaaattaaaggaattattaaaaccgcttaatattaaatgtgaagttgttaatataaaaccctgggaaaatatataacccataatcataataacaatagttatacaacatctggagaatattgaaatgatacaggaaatagaagattcaagaattccaaaaggcagaatagacttaattggatttggaagattaggattaagaattggaattcatttaatacaggtacacagaggcggacctaaagaaataggagttttcgatgggcaaaaaatagatggtggagatgttatttttacaatgaaaggtgctaacatcggagaatataaagctgattttctaaataagttatgcacccatgatgaaaatttcagaaaaattatcagcgtttgtgaagacattactccagacaatttggacttgataaaaggagatgtagttgcaatacagatagctggcggaaatacaataccaattgcagctaaaatcattaaacatgcacatgaaagaggtgctaaaacaataagcactgcaggaatatttggatttggagatgaaactatagaagtaaaagatatttctgaatttgaagacaaccctgcagtagatgaacttagaaaagaaggaataaccgaaaaccatctaattgttactaccaacaaattattaagggaccatgagcctattaccccatatacattagatgaagttgcaaagcaaataacaaaaacttctttaaaattattgaaggattcatatgattaaaatagctacagcagaatgttttacacatggaaaaataggaagagaacttcatgcaatagctcaaggatatacaggcaatttcggaagagattacattgaaaatcctgaaagctatggaaactttaactacaatgaacttagtgtaacatgcagtctgtttataccaactattgaagctgtaaaaagtgttctgcaaattgaaaatcctcccgaacctacaacactaattaaaggaattaaatgttacaatgaaacagaagataaagaagttagtaaaattatggctgaagctgtaaaaaaaataacctgctgcgatatagctatcggaactacagcaggaataggcagagggggaatatctgttgtaaccaatgactgcacaatcataacaaccagtgatgttacgagcgatttaagagaaaataacagtgaagaactgttccaaagacaggaaaacggaattgaaaaatgtataaaaatcgttttattccttttaaatgatgattttgattctattaaatctatgaataatgtagagattatagaaaattaaattatcaaaacttttttttataaaataattaagaaaaatagtttttaaagaagccttaggggggattcgaacccccgacttccaccttaccaaggtggcgctctaccggctgagccactaaggcaaaatcgagaaaaaaatacagtttttaaagaatagtgcaagggaagggattcgaaccctcgaaggcctataccagaggatcttaagtcctccccctttggccgctcgggcacccttgcatatgatttacatacaatataagattgtatctaatactatataaatgttatgtttcaatcattaaattaaacaaacataaactaaaagtacatagaaaagatatattaatattgagttaactaaatatataaatattacggtttatactaataaattaaaaaattggtgcttatcttgaaaatcgataatgaagaatgcggagtttgtgaagactgcatagacgtatgtcctgaagaagctatcataaaaaaagcatttaaagttgaaattaatgaaaacaaatgtgatgactgtggagaatgtgtagacatctgccccgtgggtgctatttatgatgaataactaaaggattttgagattatgaaaaaaggaatattaaaaaaacttacaattgttgactatattataatcattgcagtaatatgtgctgttgtttttgcatttatccatattacaactgatgattcaaatgacacaaaaacatcatcatatgactcatctacaatgaataaaatagttgaaaattatttgaaattatacttagaaggaaatgtagtggaaacaactgtcagcggatataatgcaagtactgggaaagctgttgaattacatggaaacatatcatggattgatgatgacaaaggatcaaatgtcaaagtactgattaattcaaatggaaaagaatatctggcaggattatacaaagacattcctaatgcagacatttatatagactccatttctcttgaaacaaatggaaagaaatttaacaatttaacagaagtgacagtcaaaccggaaaatattacttcattaaatgaattaatttcaggaatcggcaacactacaaattatgaaattacaacagcaattgcagttgatgaattaactacaattaattatcaggatttgacaaacagtctttattcccatgataaaagaatatcaataaaaggatcaaatgcaggtatatacaaccaattaattataacccgagcaacaggtgatgaaataaatcttgcagacggtattttaggaaactttaatggtgcaacaagcccaataaccattagaatttatgactgcagtgaacaggacttaaaaactattgaaaataactataatgttaccaatatcaaaacattttaagatgtgtagcttatgagcttaatatatacaaaattaacctcaattgtaaataaaatatcacaactatttcatgaatcccttttatttacaattattttttcaattttaaattattttgaaaatgcatgggtcaatagctatttaaaaggactttatcctggtgaaaactttttaggatttattaaaaaaaataaaatattgaattctgaagcattcaatccgctgattgtacttgttgtattcggagcatttctaatactgtcaatcaatgctgtttcagccagtttagctatcacattagctattgcatttattgcattttttataggatctgcaatactgccaagatactttttaaataaagaatttaaaaaaccggcaattgaatttaaaagcaaggatttctattcaatcggattttgtttagttttaataagcatattattcttctttgtaagtgtagcatcagtcggcggaattccaattcttaaaacctctttaagatatcaattaaaaccattatttacaatgcctgtgtttttaataattccaggagtttgtatacttgccagtgcctatttaaaaaaattccaagaaaacaaaatcacacgttctcaggcaagattccgtttcttaattttgataggtatcagctgtgtatttttattggctttaggttataggacaccactacttgcagtcttacttatcatgataatcataggttactatggaaatatcttagctgtatgggaagttgtggtaggtgcattaattggtgtatgtgcaattatcggaatcggctatttcagatcagttgaagaatacacagtcacttcagccaccaatccattttacacattggaaagcagggcagattttacattaaatgtattgaacctgcttgattttattggaggaaactttggagtaacccatggaaagttattagccagttccatacctggaagtgacctcggaccaagaatgatgattggaaaattaatagcatggagaacagaagttactgtaacaccaacattaatcggccaaatggttattgacttcggtaaagttggagtagctgttgaaatgtgcggactcggattcattttaggtatcggatataaaataatgaaaaaaaccaatgactttgcatacatcggactctacagcctgcttctgacatactcaattttaggagttgaaacaggaatactggatatccaggttttggcatactttgcagtagctattttcatttatttggcatttattatcaaatcaaataaatgctaatcttactattttttaataaaaatctttatatactaaatgttttttaatatcatatactattttatgaaaaaatccccagttattggaggttttggtatgtctttagaaaacataaacaataaaatacaatttaacaaagaaaacctgaaaacaatataccttgcaggaggctgtttttggggcgttgaaacctacatatcccgaatattgggagtgtatgaaacagaagtcggatatgcaaacggaaacaccaaaaatccaacttatgaagaagtatgtaactttgatacaaaacatgcagaatgcgtaaaagtgacatattcaccagattttatatctctaaaagagctattggaagaattttttaaaataatagatccaatcgcaatcaacagacaaggaccagatataggaacacagtacagaacaggaatttattacacagacattagagataagcaaatagctgaaatgtttattaaagaaaaacagttaaactattccaaaaaaatagctgttgaagtaatgcccctaacttatttttatcctgcagaaacctaccatcagaaatatttggaaaaaaatcctaatggctactgccatgttgatttaagcaaacttccggaaatagatgaatccttagaaaaattaaaaataaaggaaaatatcagaaaattggatcctactgaatatgaagttacacaaaacagtgctactgaaattccatttagcggaaaatacaatgatttcaatgaaaaaggattgtatgtcgatgttgtaagtggagagccattatttacctctcatgataaattcaactcaggatgcggatggccttccttttcaaaaccaatatcagaagacaacattaaaaagataaaagatacaagccataatatgattagaacagaagtgaaaagtaaaaaagcagattcccatttaggccatgtttttgatgacggaccctcagaattaggcgggatgagatattgcatcaattctgcagctttaaaatttatagcttttgaagatttggaaaaagaaggttatggagaatatatcaaatattttgaaaagtaaattgagtattacttttataaaaaaataatataaaatagtaatactttaataacatttatataatacaatttttcataattatatagtgtatcatgataacaatagctataaaaaggttatttcttgaataaatcgagaatacatgatattttaataaataaccaatgaaagtaatacttttctataattttttttaaaaaaaagtattactcaaataggaaaatggaggaaaaaatatgcatatacctgatggatttataccatggacacaatgtgtaatatactatattattttaattgtagctctttattttgcaacaaaatgggctaaaaagaatcttgatgacaaacatgtcccacttatggcaatacttgctgcgggaatctttgcaatcatgtctatgaatatgccaataccattcggaaccagtggacacatggttggtggatgcttagtggcattagtattctgtgctcctgaagctgcagttttagtatttactatagtattgcttatacaagcattaattttcggtgacggaggaatcaccgcactcggaaccaatgtattaaatatgggaataattggaggatgtgttggattatacacatttaaaggattaaaaaatacaatcggaaaataccctgcaattggagttgctgcatggttagcaactgtaatagctgcagcagcagctgttgaacttgcaatagccggaacattcccacttactttaggaatctactcaatggtattataccatatgtttataggaattatcgaagctgttttaactgtaattgtaataatggctttagaaaaatataggccagatttacttatgtggaacaaacaaacacaaggaggaaaataaatgaatcttagtaaaaaagacggatacctaataattgtagcagttattatctgtattataattagctgtttatcaccatttattgcctctggaaaccctgatggtcttgaaaaatctgcagaagatgcaggattagctgaagactatggtgttgacggattaaatgaaatttactcatccccattcccagactacacttttgaaccattaggatcacttggtgaaattggagtcctcatattaggtgctgtaatatgccttgcaggaggattcgttattggaaaaattatagaaaaaagaggttaaatttataacttctttttttcatatttttatactagattttagaaattttttggagattaataattggcagacattactcaaacacttaagttagatgatattgcatcaggagatagcataattcataacttaaatggtcctgtaaaactaatttcagcaattataatcattgtttttactgttttttcacagcagattattgttccaataataatggaaatatttttactgcttatcttatatttatcaaaagtatctataaaagatgcatttaaaagaatagcattattactgccttttggtggagccatcataatatttcaaccatttatccatcctggaaatgtactttgggcatattcatggatacaaataactgataccgggttaaactgggcgattttattattcggaagagtgattacatcacttacagccatcgtacttttatcttctacaagtccgatgcaggaaattgtggcatcatttagaaaattaaaaatgccaaaagagttagctatgattttaagtattacagtgcgatttttatttgtatttattgatgaattaacaactatcagaaatgctcaaaaatccagaaactttaatatacattcaaagttagttccttacagatggatagtaaaacaagttggctatacaatagctatgatgtttttaaaatcttatgaacagggagaaagagttcataaaagtatggttagccgtggcttttcagatacttcccagttatttaatgaaaaaacacagcttgaaaaatcagattacatttatttaatttccataataacccttatgattgttattgaagttatattatacaagtacacaaatcagttaggttatttaggaatgaaacttacaattaattaaaattaggaaaataacatgacaaatatacaattatcaactgaaaacttaagttttacataccctgacggtacacgggctttaaaaaatatcaatatcgaaattgaaaaaggagaaaaagtagctattatcggacctaacggtgcaggcaaatcaacacttttctcacatttcaacggtttaacagaacctacctcaggatgtgttaaaatagaaggcaaacctatctcttttgagaaagatgaactacttaaagtcagacaaaaagttggaattgtatttcaagatccgaatgaccagttatttgcaccaaccgtaaaagaagatatagctttcggacctatgaatttgggtttaagctacgatgaagtggaaaaacgtgttgaagatgcactgaaaatggttggtatggaaaattatgaagataaaaccccacaccatttaagtggagggcagcaaaaaagaatagctattgccggaataatagctatgaaacctgaactgatgattctggacgaaccgacagccggacttgaccctgacggtgttgaaaaagtgctgaatattatgaatcagcttaatgaagaagggatgacattaataatttcatcacacgacatagacatgatcagcaagtatgcagacaaaatattcgttctttataatggtgagataatagaatcaggaaataaaaacaagatattttcagatatggaattattaaaaaaagctcatttaagaacaccgataacaacagaaatactgtataatttaaaagaatcaggtttgaatgtcaatacagaaaaaataagtgttaaagacacatgtgcagaaattataaaagctaaacaaattaatgagtagctttttttctatttttaattttatctttaagttttataataaaatcaaattcttgatcaagttctggtgagttaccaaatccacaattagggcaatgaacagaatgacatccatgttttccgcagccggagcaacctctgtttggaatctcattttcgtcaaattcatatccacacattctacatttcataaaaatcatccagaaaaaataaataattaaaggatttattctacaataatgtttttagcttcttctttacgaagacaaacatcataccctttaattttgaattcaataggatcgcctaaaggtgcaactttttgaattttgatttttgaacctctaacgaatcccatacctaataaatgtctttttaaatcagtgtttccaccatcattatattttacaatagttacttcgtcaccagcgttcacatccaataaagattttaccattttatcaactccacaatatatctataaaaatttaggcttacctaaaataaagtttttagttatacctaattaaaatctaatttaatatttagaagaaatagtatataaatatttaggtaatccaaaaaataataatataaaaaaattatttggaaggagattttccttccacttttttatttttagggatcttaatgcccctaataccacttttactacgcaaaatcatcacctaagcaaaacccagtaacgaaccgccttgatatattataagagctacaatataaccggttgctaatgtgataacagacatagttaacggccatttccaactgttggtttcctgtttgattgtaccgatagctgcgaaacaaggaacatacagcagcacaaatgccataaatgcatatgctgaaagtggagtgaataaatcatgaacagcagcttcaatacccgaaccctcttcttctacaccgaacagtgaactgaatgtagatacaacaacctccttagcaactaaaccaaataatattgctactgcaggttgccattctccgaaaccgagaggagcgaaaattggtgctattgcagtacctatttgaccaattgcactttcctgagatccgtattcaacaccaaatggcacactacttaaaacccatacaatgatagatgctacaagaataatagttcctgcttttctaaggaatcctttagttttatcccaagtatgtaataatacaccttttaatgatggaactttatatgtcggaagctccataacaaatggggaagacattcctttaaacatagttcttttaagaatagctgcaacaacaagtgcaacaacaattcctaacaaataaattgaaaataatacttcgccctgatttgcagcgaaaaatgctgaaatcaacaatgcatatacaggcaatcttgcagtacatgacataaacggaacaagcatcattgaaagcaaacggtcagattcgttttccattgttctggtagccataatagcaggcacaccacaaccgaatcccaaaatcattggaataaatgatttaccatgaagaccaactaacttatgcataactttatccataacaaaagcagctctagccaagtaaccgctgtcttccaggatacttatgaataaaaacatgattataataatcggtaaaaaggtcaatactccacctactcctccaataataccgtcaacaataaaagatgaaagtactgaatcacctaacagaccaccaatagcttcacctaacaaaccaaaaccttcatcaatcagatcctggaaaggtgctccaattgtaaaggtaagctggaacataatatacatgataactaaaaatataggaattcctaaaattctgttagtcaaatatttatcaattttatcagatactgttggtttttccacagcaggtttacttactgcttcattcataagtccatcaataaatgcataccttgcattagctattacttcttctgcaccttcattataaatatctgctaaatgtgcagctactttatcagtttcccttaatatttgagaagaatatttggatttttgaactttttctattacaatagcatccttttccaataattttattgctgtccacattgctggaacatcagttaaattaacgtccttttcaattaatgcctgaagatcccccaaatgttctcttaattcaggaccgtaaaccaatttttgagtagtatcaatatgtttattagctacttttttaactgtagataataattcatcaaacccgtccttatttttagcattaatttcaacaaccggaaaacctaataattcagccattaatttaatatcaataatatgttcttttttctttgcaaaatcattcatattaagagccattactaagtttgcacctaattccatcatttgaacagtcagatacaaattacgttctaaattagcagcatctactacattaacaatcacatcagaatcatcatctacaatgaaatctcttgaaacgatttcttcaatagaatgagcacttaatgcataattaccaggcaaatcaacaacatcaaagcgagtatcatcatgatcaaaatggccttctgctctttcaacagttttacctggccaattacctacatgctgatgcatacctgttaattgattgaatactgtagttttacccacattagggtttcctgctaatcctacaatacattctttcattaaccattctcctattttctttagaaagaatttttatttatattaattaaataaaaatttgaatttaggcgtgcctaaattaaagtttaaaaatttatgataattttcaaatatcttctgcttaaaaataaggcttgcctaaacctacacttaactttgttttaatgctatttaaatgtttaggtaaaccaaaaatatcgaataatttatatagcccattataacaatagtaatattaattattaaaagtgactaaaaaatttaggtatgcctaaaaaaatagaaagctttatatactacaacaactaacttaatacatagtggtgtaaagttaggctcacctaaatttataggatcctaaaattacaactactcaaaacacattattagtcaaataataaactccaaaatttattatattaaattggttttcacaattttctgatttaatataaagatcaaaaacatggaaaaactctgccaagtttccatgtaaaaacacgaggtgtttaaaatcaatggacatcaatttaaacaccgaattatctctttttaaaaaaaattattttttatataataaatttaggcatacctaaaaaaatgaaaacatttatatactatcatgaactacagtataactggtgatgaaaaattaggctcacctaaatttattggaagtctaatttaaaattacctatatcagtcaaataataaatatggtctccaaatagatattaaattaaatataaactactccctaatttaatattctacctccatattattttcctcaaaaataggtgtttaaaacggaccaaacatcaatttaaacaccaattatctctttttaaaaaaataatttattgttgtatataaattttaggttgacctaaaaaaataaaaacagttatatactacttcgaactacagtataactggtgatgaaaattaggtatacctaaaaaatatctaatttgaaattactaatgtgttgttggtttaaaaccatattactacactccgattgttattaaattagtttatactctctttctctaatttaataaaaagcatataactactctcacgaaattaaatatgtattatcatatttaatttcacctatcaaataaaatatttatttttaagattaaatcgaataatcaaaactaggagatgatctcatgggtgtaagaccaagctgttgtgaaacaccaaaagaggaaacaagcaaagtaaaaaagaatattaaaaaagtatttaatttcttcttcggatgctgcaaaaataaaaaataaacaattataaaaattatttaacctgttataaacctttttttaaaatattttaaaaactaaacaaaattaatatttagcttaattattctgaaaaaatcaataaaataaaaccttttttttgaaaaaaatataaacaaatgaccatacttaaattagaataaacatttaagtataatgaaaagaataaataaattacaatattaataaacatcaaggtaggcgcaatatgagaagaagaaaaaaactgattatcgccattttacttgttattttaattggattaatcgcagtaattgcaggtgaattattcttacctcacgataatgaattagctcaaggctcaaagaacatacttgtatgtgcaattgatgaaagtgaacctagacctggaatgggtgcctgtgatatggcatttatcgtgtcattacaagatggtgaacttgtcaattatactgaaatatatcctcacggaatgactcaccctaatgcttcggagccccaagaagctcaagaacaaggagcaggcgaaaaattgttacttcacgattcattctgggacaatgatactaaaaaatccatgcagctagcaaaagaaattgtagaatacaatactagtgaaaatattgatgctgttgtagctgttaacagtgaagcattagatgcaatattgaaaagtgctggaacattagatgtcaacggtactcaaatgaatgcaagcggtattgacataataagagaagaacaatatactggtggccaaactagaggagctgcagtaatggacattgtaaaagctgcaggtcatgctgcaagcgaccctcttaaaaaagcagaaatggttaatgctgctttagaccaatattccaaaggaaatatcgtaatggatcccccaggagcatttgtaggtttacttgcttccaaaggaatcaataatttaatataatgggaattacattcccaacatcttattttttaaaatttaaactgcatttaagtacaaaatattaatttttataagaaaaatttatatataatgtaaactaatttttacatatgtaatgtatatattacatattttattttttaaaatccaaaaaattttaaatcataattacagcagacaccacttcttacttgctacatgtgtaaaatatatattacatttacaagttataaaatatccaataacaatgagccatttgctattataacgaggtaacactatgacagaatacattatagaaacaaaagacttaacaaaacgctttggaaaagatgttgctgttaattcagttaatatgaaaattgaaagaggacaaatctatggactgctgggcagaaatggtgctggaaaaactaccacaatgtgcatgcttctaaatttatcaaaaccaagctccggcgaaattaacctttttggagaagattaccgaaaacatccaaaagaaaactactccaagataggatcaataatcgaaacccccggattttatgaaaacctcaatgctgttgaaaatttaaaaataatagctaaattaagaggcaattacaatagaaaaacaattgatgaagtattaaatcttgtctgtttatatgatgcaaagtataaaaaatttaaagatttttctttaggtatgaaacagagattaggaatagctgcagctataatgcacagcccagaattgttgattttagatgaacctataaacggattggatccagttggaattaaagaaataagagcacttctaaaaacattggcccacgactacggaacaacaatccttatttccagccatattctaagtgaaatcgaacatattgctgatgtcattggtgttatggatcatggaaatctcatcgaagaactctccaaagaggaactggaaaacagattaaataaacatgctgattttaaagtctcagatattcaactagcttcaaaaattcttaaacagtcaggatttagggaaaatattgattttatagttaaaaaaactcctgaaaataacacatcaatccgattatttaaccatttggatttaagagatgaaattaatgaaaaatttgtcaaatctggaatcaaagtatcagaattaatgttatgtgaagaaaacttagaagaattctttacaagacttataggtaatgatgtacgtttttcataggtgattattatgattgcatttattcaaagtgaatttataaaacttaaacattcaaaaatatttttattaactgtacttggagcacttacacttccattcctactttatttaagtttaattagtggaaatgctgacggatttgaaagtatgcttttggcatgcaatcagtttaccggctccatgttcaatattgttctttttgcaattgtagtttcgtacatatttggaagagaatacacagaacatagcttaaaaacaatgatgacaattccattatctcgtggaaaattcattttaggaaaatatttgatgtttttcatatggacaatgattttagtggccattacatttttatcaacctgtttcttcggatatctgggcggagccagcaatataacattggcaggagctattgaatgctgtaaagaaatgtttattacaaatatattgttatttttaagtttttcaccatttgtatttttatcactgcttgtgccgaatatggtagctgcaatggttaccggagctgcattcagtattggaaatctcatgatttcttcaaccaagtatgctccatattttccgtggagcagttcatatctaatcggagcaaatgaaatagccaactattcctgcaatacagcaacttcactagctataatactagctacatttgcaatcggacttacaatttcatacatctactttacaaaaaaggatgtttgcctataaacatccttttggaggatttttacaatgttaacctttattaaaacggaatttctaaaactgaaacattcaaaaatatttttattaaccgttcttggagcacttagcataccttctttattgtatattggcctgcttacaggagaacatgcaacatttcaaggaatacttgattactgtgccacttatgcctgctcattgttttacataatcatatttacaattattatagcttatctttttggcagagaatacacagaacatactttaaaaaccatattaactaccccattatctaaaacaaaactattaattggaaaatatctgatgtttttcatatgggcattcataattactacaattacatttacaggtacggtaattgccgcatatcttggaggtatttcagacattacattaagtgttggattaaatagctataaagaaatgttaatttcagagattttactttgtttaagcttttctccatttgtagttctttcattagttatgccgaatatggttttttcaatggttgcaggtgcaatatttagtattataaatttgtttgtttatacaagtaaatatgctccctacattccatggtgcagcccgtatctaataagttcaaatgaaataaccaactattcctgcaatacagcaacttcactagctatactactggccacatttgcaattggactgacaatttcatacatctactttacaaaaaaggatgtttgcctataaacatccctttaaatttttggctccattcttttaatgaacaaagccatgaaaaccacaatcaatggaaaaaagaacatatacattataaataccatttcctcagatacaatatctcccacaactgttgatgctgccattaacatgattaaaattataacaggagctaaaatagctataaatgtataaattaagataaatccatttaatttttgagaatattcttttagtttaatctgcatatcaaatgaaatatcttcagcaataacatttaagctattggccaggtttccaccaacccttaaagttcctacaatctgatgaactgcccttgacaaaccttctgacgatactcttagtgacatttccatcagtgcatcttcacttgatttaccgtatttaatctcttttaaaactcttttaaactcaccggaaagagacccataatttgcaatagatactgtaagcagcgtgtcatgcaacccttttcctgctttcagttcagttgccatatgcctcaaagcataaggcaactcaaaatttaagtcatcatactgatgtttctggctgatttttggaaaatacagcataaaaatataaatcataactattgaagttaaataaattccagcgatttcaaaacctgcaattgcaaacagaaccaaaaacattaaaatctcagtagctattgtttttttacctaaaaaatattttaaaaagattttccgcagcttattgaataatttattttgaatgtccttctgttttttaacttcactgaaattcaatttggtaaataattttggattaatctctttttttgttttattccttttgggaagtttaagatttttaaaattgaaattcttaaaaaaatcaaaaatatttaaaaacacatccgctacctttataaagaaattaccaaacatactaccactatccagccaataaaattctgtttaacaccttttgagaatccaaataatacatctccaaaacagtgctgacatccttgattgatctgatattccaatcaaccatatgctgcagaacaatttcacggttcttgatttcatcataaagactgtttaaagaatttccactaacattagctatttcagttaatgttttactggtaattcccacatttttaatagtgtcactttgggggtcccattcaaatatcttatttaattgaattactccctcttcgattccggatacttccgccacttcacttattcttctgaatgacactccatcagacctataaattctgttttgcattattataaaatcaatagctgaaatcataatattcggaacagacatcggagcattagttaatcgagtgatcgtttctcttgcatcatttgaatgaagtgtcccaaatccagaatgtccagtatttagtgctgtaaacagtgtaatggcttcacttcccctaacttcaccgacaattatcctgtccggcctttgtcttaatgagtttttaaccaagtcattcattgttaattcacctctgttttcaacatttggcggtcttgtttccattctaataacatgttcatgaggtatttgaagttctaaggtatcttcaattgtaattatcctttcttttggatttataaatgaagataatgcatttaatgttgtggtttttccggaactggttcctccagatattattgcattagctgattttactcccaaaccgtcaaaacacagccagaaaaatgctgcaagttcaactgaaattgtttttgagtttatcaaatcaattatggttaatggatctcttttaaatttacgtatagtcattgacggaccgtctgctgaaattggaggaattgttgcattaactcttgaaccgtccggcagcctaccatccaaaattggtgattcctgatcaattctgcgatttatctgtctggctattgaatcaatcagattcatcacttcaccagcatctttaaacagaatattcgttttcatcataccgtattccctatgataaacaaaaaccggtttatctataccaattaccatgatttcttccaaattatcatcacgaattaatgggtcaatttccccataacctacaagatcctgaaacagttttcttgctaagttgtccaaatattcatttgaaatggtattattttgagagttgtttgctaactttgcaaataaaaagttcttaatatcatttaataacttatcttcatttacctgaagagattcatcagatgatatagctaaatccactaaattttcacgaagttcacttaaaagaagtttttcctcagaagagtatttttgtttaaaaacattatattgaggtacaacatcaaaattgcttccaatactgtcaaattgttttttaattacattattgttcatatttacaacctaaaactattttaaatctattttagacattagtaatactaattaataaagtttttattactttccaaataataattacatattaaaatcaatatacagaaatatgacacaaaactgctcctgtggaaaaaattgtattacaacaaaagaaaatatggccggcaaaatagctgaactgaacccctgtgaaaactgtgaagatgttgcaataaaaaaattcagtccgttaaatgaattgattgactttaatgagcttgactcagattataaaaaatgcaaatgtgggaaacgacctatcgacattgtaatgagccatgtcttaaagataatgattgaagaggaaataattcctcaaaatgcaacattaagaagacacagccctgttccccttccatgtttttattattctacacaaatggcacagtttattggtaaagattcattagtgttaatccatcctgatttcaacaaaaaggttgccaaaagactgactgatgaagtagatgaagtcaaaggagttttaaaaggaaatcctcaggaagtcaatggtatgattgacaaagattcccatataaaaaactttgaattgctgtcaggctgctgcaaccgttcagacgttatgagaacacttatcaaaaataatgatgaaatggaaaaaataatcataaacaaagaccagcacaaataccatattgaagtagctccaacaacagaagaaaaacttattaaacttcacaattacttggaaaacagcaatatcaaaaaaggaacagctattgatggaatgtgcggtaacggatcaattggaatctatttgctcaaatacggatttgaaaaagtaatattcaatgatgtttacagcgaagctattgaaaatctgaaatttaaccttgaagttaatgaaatactcggaaattatgagatttacaacaaagcatttgaagatttggaaattgaaaaatgtgatttgtgtgtaattgacagttatcctcaggcagatattgaaaaaattatcaaaaaagccgaaaaaatagctgacaatgtgctgataatctaaataaacatttgcatataaattacaatagccggaacaatcagaactcccattaaatgagactttccaactccaatataatgcggcagcattccaagggcagtagatgtaatcaaagccagagtcatgtaaaaaattggagctttataatataatgtaaaaatgtataaaatcccaatttgcaggataatcacagctattgataatttacggtaatcaactccacccattaattttgaaaaagagtcccctaattttaaacataaaatcagagatattgaaactgctattaaagatgcaaaaataaaaatcatcaaatggctgattgacatatctgagattaaataagacatataaactgctatgccgcttctgggatttccaattatataaattgccattaaagaaaaaagacaatctgaaatattcaaaccggaagtagccagtaaaaaattaactgtatcatcttctgaattatcatttgtaccgctagctgcctgaactattacagttccctgagcaggaccaaatcccggcagaaatcccaaaatagctcctgtaattccaccagcaaaaatgcttttaaatttattgaaatctatgtttaattcataaaaactgttctgatgaggaatagtcgaattatcatttaaactaaataaaattgtacttatcccaaataaccctgaaaaaatacacatcaaagaaactcctgatgaaattggagtttggaaaattgcccatcccaaaattcctgaaagcaaaaacagcaataatgaccatgcaaaatctctttttgaatttgtaagggcataagttaaataaactgaagctgaaagcaaaataatccaagtgtatggctttgtaagctcatgtaaaaaaggcaatgtcactgcaaaaacaggcatcatcaaaatcgtaattacaattgccccaaatcctccaacggcaacaattcttataacttcttttgaccttccctgtagaaccattctgtggcctggaagaatagatgttgcagttccctcctgaggaactcccaaaagcattgaaggtacaaattctgtcaatgcatgggctatagacatggataccattaaaacgcataaaaattcaggagacaagaaacctaaaatgaatgcagacgatgcaaaaagtattgcaccggcagtattgacgtgaatccccggaatcatcccagttaaagttccgattaaaattcctataaaacaagcaaatactaattctaacatagctattaattaaattaactgcaatttatactttgtttaatttaaataagaatatttagctagtattgaaaaaatgtatccaaaaaaattaaaaaaaaatagtggtgcagaaaataatcaatatttaaaattatcaattctttgcctgtcaaactccaatgcctttaaagctaatctttccaatgttgtaagtaactctcctctagacatttccagttcatgtgcaatttcctcttcccattccagttccttatcatgtaaaaatttacctaattcttttcctttttcagtaatgtctattttataagctcttttattttcctcagtatattccctggtcagaatccctttttcttcaagctcaccaaatgctcttgaaactccagacctgtccatcaaacaggctgttgcaatatctgactgagttgaactttcattataaaaaacatgcatcagcatatagtactgatttttattaatcccaaaatctttaagataatgattaataaaaatgtcatgaaaagaatgcaggcttattatatggcaaatcatatgggggcttattttaataagatcatctgttgtatacattaaaaaacaccattgaaatttataataaacataaacaagttaattgaaatcaacccattagttatcaacagatttaattttttgagtctgtaaaattttataggcttatttgttttttaattttttacagttgaactttcattttgatgaaatttcattctaatttttctttaattttaatataaatgatttaaaaatagtaaaatactttaataagtgaggacaaataatattttatgaccaaacaaaacaaatctgccctcaatagtaatatagacttcatacaacttaaactttatgatttttttgatgaaaaaattgatcaagaaaaaattatttcaaaaagattgaataaaacacctaattttgaaaatactaatcataaactatttttagatgaaaataatacttttaaatatgataatcccatttgtccagtttgtggaagccacaaaataatcaaaaaaggcacaataaagaaaaacaaacaaaatactaatggaaaaacaacagaattcaaagaacagcaatatcaatgcaaaaaatgtggaaaaaaattcggaatatacaataatccattaattggtgaaaataaacaatttttacaagaaataatggataaaattccaggaataatgaaaatagggtaccaatcacttcgtaaaataagtaaatactttgaaatattccttggaatcagaatatctcatcaaacaatcaagaactggtctgacaaaaatcacgaagaaagcatcagcaatgaaaaatttgaatattctggctattatttatatgatgagcaatttttaagacttaatggaactagacactacagattaactttatttgatgcaatactcaatattccagtcacagaacgaatagtacgtcgcagaataccaaaaaacacgaaaaaatttatcttagaatcaacagaaaataaaccattcatttgcctaacaaccgatttattcccaatgtatcgtaatgtagcagatgaaatagaagtaaaacatcaattgtgcatatttcatctgtttcaaacaataaaccataaattaaaagtatattgtagaagaaacaagattaatggaaaacaaagagaccatatttacgaaaatgcacaagaattaaaaaactgtttcagacaaaactcaaaaaaagaagcaatagaacaatttaaacaatatttacaaaaatatacggccataccagttgttttaaaagatttcataagaaaacatatcataaatcacttccacagatacgtagaatatcttgatgatgaaaatatagaaaaaacatcaaataaagtcgaaaattactacagacaaaccaatcctgaaaaaataaagaaaatatacaaaaccaaaaatggaatcctgacatttttagactatcaaatgcaaaattggactgaaaaacacattaaaatcaaataagcctataaaattttacagactcaattttttgaaaaataatatataaatgttgttatgcacaacaataattttatgaatataaaaaaagtaattaaaaagaagatttacattaatcttctagtatcagtaatttccacactagctacatcagctaattttgccatagcttcttcagtagattctgttccaccttcaccatcttcaataatgaaaataaggtttaatgcaactaaaccaaatgcaattggttcttcttcaattttgtggaattctgcttcagcaggcatagctgcttgaatagctgcttttaaagcttccaaatctacatcaggactttctggcatgatttttaaagttgctacaacttcacccatcaacattcctccattactaagtatttatggtccttcaaaaccacattcacatttataagcatgaccgaaagtacggcatttttcacatcttgctatttttgctccacaaacaggacattcaaattcaacgaaaggcccggttaatggaatttcttgtttacatgaaatacattctacttctttcatctaatcacctattatttgtgtgtaatcgaaattataattatctatattatcatcaataagagataacaccctttcagggtactttccatttacaacaaaacaatcagacccgaatttaagtaaaagagaaggcaacattaagtctattgatgtttcatcaaaagtcagtagtttttttgcatcaatgacattaataaattccgaaccttcttcattaggttctcgggtatatataccatttacatttgttactattaaaagctttgcatttaaggagtgtgcaacatatgctgcaattgaatctgaagttacatcccatgagcattcaaagggatcttcatttttcaaaaattcagaaacaataaaaataggagtaaaaccattatctgaaattttttcagcttcgtcaattgtatatgccaattttgtagagtttactttatcattaaccaatttagataaaatatccatacattcaattgcagtattgtgactggcttcatcagaaaaatgataatatgaatcatattcccttatcaaattagcaaactccccaccacctaaaataatcaaagaatttgtattttccagttttttagctaatgttattgcatcttttggaaataaacttcccccaattttaacaacctgtttgataatgatatctccaacctaatttactatgtgtttaattaaaactagctatcattaaattaaataaaactcataaaagttttaaatccccagttatcttatccattatttcatcttcatcaggcccaatgcccaaaactgttgtggttgatgtaggtaactgagtccttccagcatcaactaccaaataattagaaacattgtttttatcggcttcctttttaaggtccaataattcttccaaagaatccactttacaaactaccttagcataaccgtcagattcccattttttaattaatttagaatctgttcttttatatgaacctatagaaccatgacaacattgagcagcaatttttcccttgcccatttttaaatctcttcttacaaccatcacttgtttcatacacacatttttctatgtgtccacttaaataattttagctccaataaagtataatacttataatgtttatatagattattactattttaagtgaaaaaaatttacttaaataaggagatgagcctatgaataaaaaagttattgtaatactagttgccatctgtataataggtgcaattacaatacctgcatttatttcagaaaatgactcttcaaaatcaaatacaaaaagtgattttaaaatcaagattgaaagtggcggaacatggagacttgatcttatagttgatgggcatcattcacttatagaaggaaacggttccagaacaatcaaccttggaaacatagattctgcaagtataacatttaaccaatataaaggcggaccttctacaatttcattattagatggagacaatactgtcataaataggggaagagctcctaacgaaggttttgcaactgtgtacttttatcataaagcttaaaatggaagtttaaacttccatgtctattttttaaaaactcagtttaaaacttaaatacttcctaaccaaatcctttaaaaatgaaaaaaaactaatataaaaatactattaatttttatttttattattataattaaaggagatataaatgagtcgtatttctatattagacaaagacaaatgtcaacctaagaaatgtaatttcgtttgtattgattactgcccaggagtcagaatggatgaagacacaatcatcattgatgaagacactaacaaaccattgatttctgaagaattatgtgaaggatgcggtatttgtacaaacagatgtccatttgatgctatttcaattattaacttacctgaagctataggagaaccaattcacagattcggacaaaaccagtttgaactatttggacttcctagtttaactgaaggtagtgttttaggtttgctcggtccaaatggaatcggtaaatcaacaataatgaacatactgtccggaactttaattccaaacttaggagattatgaaaaccctcaagataattgggacaaagtaattgaacattataaaggttcagctcttcaaaactactttacaaaattagccgctggagaaataaaagctgttttaaaacctcaaatggtggatcagcttccaaaagttgtaaaaggaaaagtaagtgatttgcttacaaatgttgatgaaagaggaaaattggattatgtctgtgatgaattagaccttcataatgttttagaccgtgaaatgaaaaacttaagtggtggggaactccaaagagtagctatagctgcaactgtcttaagagaaggagacttctattactttgacgaacctacatcctggctggatgtttcacaaaggttaaatgcagtaaaagtaatccgttcacttgctcaagacggcaaaagtgttttagttattgaacacgatttggctactttagatgcattgtccgacaatatccatgttttatttggtgaacctggaggatatggtgttgtatcaggtagaaaaggtgttagaattggaatcaatgcatacatcaacggatttttagctgaagaaaatgtaaggataagaagaaatcctattgaatttacaatcagaccaccgactcctgaagatgaaggagaatcactgtccagctattctgatttaagtaaggattatgacggattcaaattaactgcagatgctggagaaatattccacgacgaaatcgtaactgcatttggttcaaatggtataggaaaaaccactttcgccaaaatgctggcaggagtagaagaaccgacaagcggagaagtagacacagaagttacaatagcttacaaaccacaatatatagtttctgattttgaaggaactgttagtgacttcctgtacatgaatgctccaagtttcggaagcaacatctttaaaagcgagattatggaaccttttaaattagaagatatgcttgaaaaagaagttaaaaagttaagtggtggggaactccaaagacttgcaatagctgcaacactttcaaaagatgctgaaatttatcttttcgatgaacctactgcatttttagatgtggaacaaagattaatagctgcaagagttattagaaaaatggttgaaagcagaaatgcagcatcacttattgtagaccacgatattgtatttatcgattatatctcagacagggcaatggtatttaacggtactcccggtttagaaggtcatgcatccaaaccgacagatttaagaacttccatgaacgaatttttaggaaatctaaatattactttcagaagagataaagaaacaaaaagaccaagagttaataaattagacagctatcttgatcgtgaacaaaaagaaaaaggagaatattattacttatcagattaaatattctctaattcttttaaaatataatcttttaaagccttaacggccttttcaccatcatcatctaacctaactgaatcattaggattcaaatcattttctttgacaattgattcggcatctatgttttttactatatcaacatctttttcttttagaatagttgaaacacaatcgtctgtacagccagttatagacactacttttgcatcttccaaaataggactgcattgatttggctgtgcagaatattcagttatacatgctgcaacaatattttcattatctagagctaattccacagtagcagcccttactactaaaccaaggggacttaatccgctacatgacactaatgctattttatcattcatataatcaacctctctttttagctactcttttatcatatttttgctttattttaatataaccttttttataaaatggacaaaccagcatacactggctgcatccttccctatgggcagtgcaaacttttcttaaaaccagctcattttcatcaaatgcattttcaggacatttcctgatacattttccacaggttttacaaaattccccaacccagcacatgtcattttcctgtttaaaaggcaagttttcaattgatgtgtgaatcatgaaaaatcctatatttaaaccctctttaaaaagacacatattgcttcttgtaatgaccgcatcatttgactgcatagctattgcccttaaactaattttatcatctaatggattaagcagttctgcactaaattcgttttttcttaaaaaatcagcaaaaccatacattttacggccaatttcctgaaattcatcatctataagcttgcattttagttttgattgatccatttccaaaatttcaggagacatcaaatatttaaaaataataacattgtcaaaatcaatattccattctttcctaaaatcatcacttaatttagaatagctaatgcctgcacaattattttcagcagccaatttttccaaatcttttaaaacagaattatcaatttgagttttgggatttgcaggatttgaaactttataaaaattaggtagcggatgatgatatctgaatctgaaatcctcatccataatttcgaaacacatgattatttccttaatgcttcaacagctttagggaattcttcacagaatacttttatttgctcctcaggaatagaataacttatacgcaaataattatccccaaataaattactggtatattctccttcccttgtgaatatttttctcttaagcaagtaatttgacatatctttaggactgatacctgcaccagataaatcaattgccatcatattagcttcagacggataaaccggtaaaaacacaccatcaatttcatcaacaacctctttaattaatttttgattattgaatgtgattgattttattttatcttcccattcgcttttggattttaaacctgcaattgcaccatactgagcaattatattaactcccaaatcattgacaactgcattttttaaaacatcaatgatatcggaagttgaaaccactgccccaatcctaacaccagccattccgaatatttttgaaaaactgtaaatagtcagggtttgttcaggcgcataatctgcagccagataatgattccttgcaaaatctttgtatgttacatcatctaaaagataaatgtcattttcaatagcaatctcagcaaactcttttatttcttcttcagtataacctgaacctaatggatttaacggatcgattaaaactaccattttagtgttttcatccatattctcacgaagaagttcaggagttaatttatagccacattcctcattataaaccggaacataccttacttcacctgcaaatctgtttgcaaagtttccgataattaaataacccggatcagacatgaccacattatcctgaggtcccaataatgcctgcatacaaaggtataatgattcagtagctccagcagttaataaaacatctgaatttttaaaacctaaatcgtctaaaattaattgcttaagttctgaaaatccttctggaggtggatatttacagtattctttagctttagcacagctagccatagcatcagctataatatcaccatgtaaatgatttgtgttttgacccatccaaatcatatctttatccatgaatacatcttcaaaaaaatcgtttgaagattcatatccttcaggaggaactcttacaaccttttcaaatttctttttaggatgttttatgttaccttcctcataactgcttaaattatttttcataaaaatcacataatactaataaaattccaaagtaattatttattttaagttatttataaaattaatgtttaaataattcccctttccactattttaaaagtagcctgtttaccttcaccgatacttctatgtctttttagtgtagctactcttttattaaactcatcatttcgctctaactgaataatagttttactccagtactgcaaaatagttcctccgactgctttaacaacgtccttgttatcatcatcaaaagaactgtaaatttgattggtaagtacaactgcaacatcataattacgagctattttagctaaaatccccatctgtttacctaattccttattaagtcttgaagatttcatatcatcaacacgataaagagcaacagctgaatccaaaacacataaatccacatcatcatgatgctttctaatccagagctcaatagttttaagattttcattttgctctaaaaatgaagtcggttcaaaaactataatattattaactattttaggaaaatcttcccctgctatttgtttaattctgttgattgaaattcccccttcagtatcaacataaacaacttttttaccctgtttagctacattaactgccaataccaaagagatattacttttaccagaaccgggcggaccgaatatctgagtaacagttcctttttccactcccccgtccaataaattatcaatacctgaattagttgggattttatgattatcctcaaaattagccaagactttcataatatattatttagttatacaaagtatatatttttaagcttaccttttaacaaaaataggttcttcagcagtcaaatcaataattgttgatggatttttagattttaaaggacctacatcaataaccaaatcaacttcacatcctaattgtttcaatatttcttcaggagtgtccaatgtattttcacttgatatattggcgctggtggtagttattggaaaaagtttagctaaattacatgcaatctcactttcaggaacacggatacccacattagcagacccgcttgtcagatgtctcggaacaatttttgacttttttaaaataaatgtataaggtccaggcaaatatttgtccataaaattaagctggtttacagaagcccttgaaaccaaaggaattgcatctttagaagaaactaaaagagaaatcggttttaaatagcttcttttcttaatattataaactcttttaacagcttttctattgaaaatattagctcccaaaccgtaaacagtatcggtaggatataaaataactccgccatcagctaaaactttaacagcctcatcaatgacctttttatctactttattttgattagtttttaatattttcattaaattacccgaatattttgtgaacaattatatatgagtaaaatctttatatataaattatgcttgaaagtctacgtccttttttaacaaaaatattaaatccgctggccaaacatttaaatataaatccgaatatcgtaacagtgatttctccgtttattgcagttcttgctgcttacggatttgccaatcatttactgattattggaacattagctattttactaagcggatttttagatgttgtagatggtgcagtagccagatatcacaacaaaacttcaaaatttggagcatttctggactcaacaatggacagatttgcagacgccataatctacataggaataatatttggaggatactgtgactggtttatcggtgttctggccatacattcagcaattacagtcagttatgttagagctagagcagagtcccagggagttgaatgtaaagttggaatagctgaaagagctgtccgtatgataatattaatgatcggagcagttatcggatatttaacaagcccaatttactttacatacaccataataattttagtaatattatcctacattacagtagggcaaagaatatatcacgtatggagacaacttaaatgaatgatttagaaagtgcagaaaaaataagtattgacattaagaaattggaacgcaatctgaaacaggttgaagacataaactttgaaggtaaagaaaaagaagtttatgacagagctgttgattatatgaacgattcaaaatattatcttgaaaagaaaaaagatatgcgtacagcatttggatgtatcgaatatagtcatggattattagatgctcttagaatgattcatggtttaatttaaacaaaaaatcaattaaattccaccatttaataaaaaaaccgtccccatttaccatctgcagcttaaaaataaagtatttgatttacaataatataaaaaaagtaaaaaaaagcagagattaattaaaatcccttaaatttattccatatcttcgaatctatcttcgagttttgccattacaccaggtaatgaagtatattccatttcttcagcaggtaatctgtgaggttcaaatggaccgtgtcttctgatgtaggtagcgattcttgcagattcttccctagtaggatcaaatgcagggtcatcaaataagtcaacaggacctattaatttagcatcagatacttggaaacctaaaccgattactctaggtggtccgtcaaatctaattgggtttgcatctctttcagatacaggcatcataggaccgttgtgggaacctctcatccatccacttaccatgtgagggaatgcaaatggttctacacattcaccattagctgggaaaccagattgtgctcttacaatagctgcagggtcatctttaccaacgtattctccagccattaagtttaatctttcagtactgatagctgctgcgatttctccgtttttcttccatactcttttaattacgtatcttccagtagaaccgattaatgcgagtaaatcgtacatttcttcaggacagtttaagataacttttctgtgttcaattacatcaaatacttcaaatttgaatccatcatgtaaacttgggtcaataacaagacctgcagtgttaaatggatctgcgaacattttaaaaataggtaagttaaatgcaccaggttcggttttgtcacagcagtatactaaaacagggtcacttggcctttctttgaattccatttcagcaacaccaggacccatacctttaatgtttccagaaaaggtgtcagataataaatcttgacctgcaccgtataattttaattcacgtgctctttcagtagctttcatgaaagcattgtaagcagtttcgtgaacttcttcgttttcttccccatttctatgagtcataatcaagtcaatgtcgtctccacaacgggagatataataatcagttaaaatatttgtctctaaagcttctgctaaaacttcatcacaaatatccattaaatctgggtgtgctacacaatgtccagacacacttccaatatcagctttaattacactaacagttgttttcatttaaacacctcaaaattgtatattctaaagtttagtagaaaataaaaagttaagcaactagcttaaaaaattatttaatatacattcatatttttggattgtatactatttaataattatgttttaaaataagttaaaaaaagaaaaagataagaagttaaattttaacttcttaagctgaaattgttattttatttgatgcccagcatttgtcatatgttgatgttatgatgtaatcgccaggcattaatctgatgtttaatctagctacaccgtttgcgtcggttgttttatgatagaatacaccgtttacattaaatgttatgtttacacctgttactgctttaccttgaccgtcaacaagtgttgcgttaaatgaactgccgtcaagatacttcatggagatatcctcagcaatgattcttggtaaaacagttacctcattagctctttgttcaccagtttctggattgtaagcagtaataatatatgaattaggatctagtctaatatttaaactagccataccgttttcatcagttacacgagtgtagaacacaccattaatattaaatttaacagtagtatttgccaatgcatttccatcactgtctaagaatttagccacatatgatgttccattaaggaagtataatgtagtgtcatttcctaaaattgtgcttttaactaatacagtagcatcagcagttgccatatcataatcatcagttccgttaaatactgcacttactttgtattcattaggaactaatccaatacccattgaagccataccgttttcatcagtgattttagcataaaccctgccatttattgtgaagtaaacagttgcattaactattggatttccaaatccgtcaacaagtttagcaataagtttttgagaacctccgaagtatttaacaacatcatccattattaaagtggttctggtgtttttattaactgttatagttccgttaacaaccatggaatcatatttgttatctccagtgtagaatgttacaactttgtagcttccttcatccaaaccaggaatgataactttagcagtaccgttaacaactgttccgttataatctgttccgtttattgttacaattacacttccggttccgtcttcaggaacactaacagttattgtagcattttcacctttaacaatatctgcaatatcaacagtcatattataatcagacactttggaaacagtaaaagcagtagagtttttaataggtgcataaatgtcatcaccattatagaacacatctacactgtaagtaccattagccaaatcagaaatagttacactagccattccatatttagtcataacagtgtaatttttaccattaacacttataattacctcaccagttgcatcttcaggcaatgcaacactaattacagcattttcaccaactttaatattatcaacagcaatatcaattgtagaagctaatttagttacattgaatttagcactatcttcactagctaaatatttgtcatcaccattaaatttagcaacaacatcataagaaccactagccaaaccagataaagttaaagatcctttaccatcaacaacagcaacattataaattgcatcaccaacagtaacactaactactccagaagttatttcaggaacagcaatactaataacagcatcctcaccaactttaatattatcaacagcaatatcaattgtagaagctaatttagttacattgaatttagcactatcttcactagctaaatatttgtcatcaccattaaatttagcaacaacatcataagaaccactagccaaaccagataaagttaaagatcctttaccatcaacaacagcaacattataaattgcatcaccaacagtaacactaactactccagaagttatttcaggaacagcaatactaataacagcatcctcaccaactttaatatcactaacattgacagtagttgtagaagctaatttagctacattgaatgttgttgaattgtatgaagttttatagtatttatcaccattatagtaagcaaatacaggacaatcaccagtagttaaatcagctatttttaaagtagctacactatctgtaatatctacaacataggttttaccatttacgaagaatgtaacagttcctgttgcaccattagtaacagttgcagtaattactgcttcttcaccgcatttaatgtttttagcttcaacagcaattgaagaatcaattaaatcaatagtgaatttagtggaattataactttcagttacaatggaatttccattatatttagcttcaatataatatactccagcaggcaaatcacttaaagttaatttagcagaaccattaacaatagctacatcatatttgtcaccgtctacaataacagcaatgtttccagtagcttttttatcaatagtcacatcaattaaaatttttccaggttcttcagaagtaatgttgaatattaaatcagaacttctaggatagttgttttcaactacattgtttttacctgctttaatttcaacagcagcatctccacccagattacgagtaatcaataagttgccagttacattagatccgtctacattaataaatgaaactgcataatggccgtcaacgtatattctgttgtcacgtatatcaaatgaacggtctccgtacatgtattgagcatagctgataccatacatataattttcaggactataatcgcccacgttgtaagtgtagattgtgttgttgtatatttttgcattaccgttttgcacttcaatacctgaaactaaagcccagctaccactagcagaagctaaacctgttacattaattaagttatttgcaatgtaaagttcagatgttccgccagtcatacttgcaaagtaaatacctaagtttggaccgttacttatacttgtaatgttgtttccaatcatagatacttcacattctacgccttgtattgcatatgcagtacctgcagcatctttaccaccagcagtagacattttaaagtcattattggaaatcattaagtttttattgtatccaatgttaattccatagaggtaattgcttgtaccagcaggaataagtgtatcaatcattgagaaattatttccatcaattacacagtcattagatccgacaataaacatacattgtaaagtagggaagctggcacttccatcatttgcagtagtgtttacattgtttttggaaaatgttacattattacattccctcatcctaattggatttacagtgtttacacccatcatgaagtatttcatatcataattagatgcaaataggtaaggtaaaacagcagtaatattatttccattaatgaatgaattagaaacaccatctatattaataacgcatgcagttaatgtatcatctttaggacatgattcaaagaaaatattgctgttaacaacatttaagtttgaaacaccatttgcattaattgcaacagcatctacactttctttaataatatagctaatgttcatattagaaacatttacattatttccagctaccaatatgagagctccaccattatcagcacatgaaacattagagattaaagttaatccgtttaatactacattatctgaaagcacagcaaatgctatgtttcttaatactgcattatcgctggttattttaagaggagttgtaatagaaataagatttacaatatctgagaattctcctttaaatattaattcatcgaaaggaacttcttctcttaataatccgtcttcatcaaagtagataaagaatgtttcattagttacaacatttccgtaaactgaaacatcagaagtagcattaattaaagtgtatgtttcatcaccataagttacagcaatatcatatttacctgcagtcaaatcagaaatagttacattagcttttgaatcagtaaatgaaagaacatattctttattattgattttaagcatgaatttttcagttaaattagataatgaatcaacagtcacatcaattattacatcagtgccttcaaatacatcttttgcagtaattgtaacattgacaattcctccaggaaggttgtcttttacaatgtttgtttcaacagtagaattaactgcattatcacctaatttatctccagcaattaaatagttattggtaattacattatctccaccagttgcaagaattgctgcatcaccagtagcaagtacaatattattatatttaattgtgtttttagcactttgaacagtaagcatacctccaaatgtggagttaattaatgtagtgttagttgcactggatttaatagttccaacaccactaatagatacattttcaataactgcatttttaccgcttacagataaagaagcagcagttacattagctactttagctcctgcctgaactgttaaagctgcagttgcactactattagatacaacagaattagaactgacagatatagcttttgcagtgttattgtaagcaactgaacctgatccgatagttaaagtacctgaaacagtgttgttgtaagcaatagaactagctgcaacactcatactagctcctccaattaaaacattgtcacagtaagtgttgttgttaggagtagcaccccatgcaggaacaataccattaccagcataattaattacatttcctgcaattaaattattattaccgttaattccaataccgtaacaaaatgccgcagcaggacttggacctgttattttattattgatgattttattgtaatcattacttaaatcacagcctgcatcgttaaaggtattcaagtaaagtaaattacctacattaccttcaccgacaatagtgttattttcaacagtacaattttgaacgtgagttaaaacaatactgcttgacccaccattattgctggtgtaaatgtagctgttcttaagagttacattagtagatccgtgacgtatagcagtagttccaacaccagaaccaactcttttattttcaacaattacactaatattatttaaaactacattatgagcatcataaatccaaacctgagtgttatggaatataataccagacacattggatccggaacctccattattgattgtaaagcatgaacctggattttctccaagtaaactacctgcagtagtgtttaaatcaataaatgcatcaccagtagttgaaatcatattaattggtttattaatagctaaatcaaatttaacatcatcatgactatagaatttacctctgaagtctaaagttgcaccttcaggaacataatctgctaaagtaccgttaataaagtaatcaaagaatgtttcattagttacaataccatcaaatactttaaatgttgtgctgttggttgaagatttaaatttgccatcaccatcataatccactttaacagtattttcaccagcaggcaaatcagatacttttaaagtagctttaccatcagttaaattaacagtgtaagttttaccaccaaccatgatgtttgcagtaccagttgcagcagaattaagagttatgccaataactgcttcttcaccaatccatgcattatttacatcaattataatatcggtagacataggataattatttttaactacattattagttcctgatttaaatattgctgcatcatcaccgtttaactcatgtgcatacaatgtgtttccaattatttgtgaatctttagcagatttaattaatactgcatattttccttcagaataaatggtattattctgaatatcaaattggtggcttccgctggttgattgtacataagtaattcctgcaatattattgtcatcattatattcgtttacattttgaacatagatagtgttattatatgctttagctacagtatcctggaattccatacctgaaaccaaagcaaattcggcaggtccagcaaaaccagttacattaatccaattattctcaacagtaatttcagtagcaccataataattttgtgagtacactcctaaattaggaccgttagatactgtggttaaattatttcctttaactacaaaattattataaggacctgtaacctgtacagcataagcagcgccggcaccctctttaccaccagtagtattaagtaatacacgattatcttcaacaattacactgttggattcataaaaatcaagtgcataaatataacttgaatttcctttcagagttattaaatcagtatgagaaatagtattgtttttaattaataaattattagcagtatgagcaataaatgcatcgaaagtagggaaattagcattatttcctttagtccaagcagaattatccactatattattaataattttaacattttctgatttttccacaccaattgcaaataccaaatcagtgtcaatacttccccaatggctgtactcaacatccactaacggacatgaagtagtaattatatttgaatcaacaacagcattgttactttttgctatttttataccctgagcaaatactttaccgtcaacattgtttccagtaaaagtaattgtactgtttactaatttaaagttatctgcaccactagcataaactgcaattgcattattagaaccatcagtagcattataatcaatagtaatattattcactgtgacatcactaccgatagcatatataagtacaccatcagtatcagcaacataatcagtagcatttaaagttaaattatttaaagtagttccttgttcacacattattgcaatatttcttaatactgcattatcaccattaataacaatagctcttggaacataaacaacatttacaccaagattagagaattcacctttgaatatcaaagtatcaaaagtaatatctcccaataacattccgtcatcaccaaagtaatcaaagaatgtttcattagttacaatattggttaattctttagtggtaactggaacggttaaagtttgactgcctgatttaacagtaatttgatcattaccttttacagtgtaagttacactagctaccccattatcagtagctgcaacatcactggataaagttccattaacagcttcaaaattaacattaatagatggaatagatttagctaattctttaattacgccatttgcattataatgattgaagttaactgttaaaattttttcatttccaactatgaccttttcaatacttgttggatcaacactcatgacaacccagttagaaacatcaacatcatcacatggttcatcataataatctaaaccagcaccaactaaagttgaaggattgctgttagttccccaccagttatattgagcattagcacttggttcacggccttcattgtaaattaatttattagttccttttccaagtaatgcagagtaatgtaaagttaaaatacctgaattgtaaatatcatcaccataataaccagtatttccattggaagctgcattagcatcaaaaatggaagtttcaatatttaaggtacctttattataaatagctccaccatctttattagctttgtttccaatgaatttggaatctttaatggttgcagtacttgaatcagattcaatgtgaattgctccaccatttcctacagtaactacattattttcaaatgttgcattattaacatttaaagttcctttattaagccaaataccacctaatctagcagtattatcagatagtgtagagttaattacatttacagcaccaccatcaatatataaaaatgcataagtagtacctttaccaacattattactggaaatagatgtattgataatatcaagattacctgaattaaatattaatccgtaaccgtcattttcataaatatttgaattaacaatagtcattacaccagtattatatattgaacttacagtaggagtacttcctgatttttgagtgtttttgtaaatgcttacattatttaagtttacagttcctttactttgcataactccaccataattatttaatgcattggtaaatgcaacattagtgaagttaacaattgtattctcatttatattcatgattttagaagcattaccatcaatgataacttttcctgaaccaatcattgcaaatgatttagctattgttaaagaattagcaatataagtaccttcacctacatgaatagtgtaaccttcagcaactaattcaattgcttttgcaatagtagctacaggactatcctgactaccatcatttgcatcactaccagtagatgatacccaaacatcagttactggaagttttgcaacaacttcaatagttaaagtttgactacctgatttaacagcaatctgatcattgccatttacagtgtatgaaacagcagcaacaccattaacagtagaaacaagattacttgctaaagtaccattaacagcactaaattctacatcaatagcaggaagaggttttgacaagccatttatagtatcaaaacttgaatatttgttgaaattaacagatattgtttttacatcacctatttcagcatctgttacagtagttggatctgcactcatgattacccaattgtttaatgttactgttgaaggcactaaattcttaggagaattagttccccaccagttgtaattaactgtagcaacaccagatgcagattcagcattagatattgcatagtctccttcagcaacattatctaataaaactgaatatgaaatggttgaattactgccaccatttaagtataatgcagcacctaatttagcctgattgtttttgaaaacagaatctgtaacactgacattaccgtttaatgaagtgtatattgctcctccctgaccaccagtgaattttccaggattagctttgttattaataaacatagattcttttataatacattctccaccagaaacaaataatgctcctccctgaccagtatttgcactattactttcaaatgtagaattaattatattaacaatacctatagttgcatcagatgatttagttgcataaatagctccaccatatttaacagcattatttctaaatacagtattggagatagttgcatttgctgaagttgtataaactataccataagaattagaaaatgaagtcatatcattattataaaactcagaattatcaataactaataatgtatcattttgattgtttacaacacctttgcctgcagaattttgataaaatttagaattattaatatttaatttatttttattagtaattatagttccagaattaccagtggccttatttgaataaaagttagagttagaaatggttaacttaccttcatttgaaatagcacctacaagagcatcattaccatttgtgaaagacaaattagttaaaacaacagttgcatcagcagttacttccataatttttgaagcattaccatcaattactgtattagcactaccttctaaagttaaacttttagaaatgcttaaagttttatcatttacataattaccatcagcaatatgaatagtataaccatctccagcaagttcaatagcttttgcaatagtagctacaggattagcttgactaccatcattatcatcactacctgtagttgctacccaaatatcagctgctgcttgttttgcaacaacatcaatagttaaactttgactacctgatttagcagtgattttatcattagttgtagtagtgtatgttacagtagctataccatctacactagctacattatttttacttaaagtaccactaacagcactaaagtcaacattaattccagaaatagactgagctaaatcttgaatactaccagaagcatcagtataatgattaaagttaacacttacatcaatagctttaccactttcagcatcaatagtagtttcaggagtactcataactacccatttatttacattatcaccagtataagtattagttccccaccagttgtaatctaaattaacagttggagtaactccagatgcaatatttaaatttttactgaatccattattcataatagaagaataagttaaattaacaatggaatttttaaaaatataagctaatgcactagtatctgcattaccaaaagtattgttttcaattatacagttagtcatatttaatgcagttacaaaattagcatagcccaaatataacaaatattgaccattaattccactttctgtttttccaattacattattggaaattacagtattggaaatagttaaagtacccttattttctataagagacatcataggtccactagctccagttatacgagaattagttaaagttacagttgcatctttgttatctaaataaaacacatttcttaaatgtaccgcagcaccagttacagaatcagataatttaggattaataatagacaaattatcaaaattatattcaccagtgcctgaaatataaacaatagatcccctagttactccacaggtcacatcttttattgtagaattaataatatctgcaacacctgttgtgtataactgcattgcaccaaatttagcactaatatctgtaaaagtacaattaattactttaagatttccattaccacctactcttaaaccacaggaactaccactagcagatgaaacccctgtgaaaacaagattagtgaattctaaagtacagtcattttcaagacattcaaatacatttgcaccattactacttaatataacattaccttcaccaacaaaagataaagttttattaagacttatttttccctgattataagttccttctttaatatgaatagtagatccactttgagctaagtctacagctttgctgacactagctacaggactagcttgactaccatcattatcatcactaccagtagttgctacccacacctcaccagatggagaatcgccaactacctgagaatcctctgaacttatctgattagcaaatacaacatcatcgacagatatgtcttcactaataccaattgcatcagatgaattcataactatctcattactatctgctgcacttacacaagatattgaaaatgccacaatagctatgagacagattaataaaattttcttatccatgagtatcctcctttttattttattttgaaaattttaagtttttgaaagtttttatattatcaaacatcaccaatatatcattataacccccacaataagttaaactagctttaaaccagcaaaacacacatctataaattcaaaataaatttatcaaaactaaacaaattttgaatatgatttatatttatattataaggatatatttaagatttatcaaataattttgaaaagtaaaaaataagttacatcagaatttaaaaaaaagaagaaaaaagattaatcaatggaatcaaaggctttttcaatagcttctttttgattcattgccctgcaagcctcttcaaccctgtcaacatctgcttttgtttcaggatatttgggaactgcatgacatcccccgtcatccaatttagaaatttcaaaagttccgatatcttcagctattctggtaatttccaatttgtccagacctatcaaagggcttaaaatcggcatgtcaacaccatgacgggtagccaatatattagacaatgtctgtgaagctacctgacctacactgcttccgtctacaatagctgatgctccatatttatgtgctaatttttcagctattttatacatccctgacttgcataaaacacaggtcattttttccggagcacagtctttagcctgctgcaaatactccccatattttacaactttttttgtaataggaactccttttgcataactttgaagctgatcaattattttatcaaagttttcatgaactttaggtcctgtaaatggagcattatcacaatgaagtgctataacctcgcatcctcttttcatcataagataagctgccaccggagaatcaataccgctggacaccaaaacaacaacctttccctgagttcccagtggaaggcctcccggaccgtcaattttttcatgataaataaaagcttcatcatctcttacttcaacataaattttaagttcaggatttgttaaatcaacaggacatcctacttttttaacaactacagaaccgcagaatgcagccatttcctgagatgtgaaatcatggtttccaacccttctgcattttatggcaaatcttgtatctttgcctatgaatccatcatcaacaagattatctacatattcacctaatgttttttcaatatcttcatagtttccatatgttgaaacagccggagagtaagatacaacaccaaataccttatttaaattttccaaacactcgccatagttttttggaaagatatatattcttccctggtttctgtcaacttcacagtcaatagctgctttaatatttttaaccaatttgcgctcaaaacgtgctcttacttttgagctttttaaaccaatttcaccataacgtgctataactacatcataattcatattattcctcttttaatactttaaggtgtccagccataaatttaagagtagatccctgtaccagtactgaaatacaagtaacaaccattacaatatcaaatatcatttgtgcattataaataccatgtaccaatggataaaatgcaaatacaataggtactgcccctttaattcctgcccatgaaacaaacgcctttgaaggtctgtctatatcaaatggagccaaagatatcagtactgcaattggccttgccacaaatgtcagtatcattgcaatccatattgccggaattaacataggtataagttcctttattgatgaaaatgcaccaagtaatacaaacatcacaatctgcataatccatgcaataccttcgaaaaaggataattgagtatatttatatttgattttacaattacctattattactgccgcaatatatactgacaggaatccatttcccccaacaacttcagtagctgcaaatgaaagaatagctgcagacaataacagtaccggatacaatccctcaacgcttaatttaatccttgcaagcaattttgaaaatcctttacctaaaattgctcccattattaaacctaaagccagtgatttaaagaaattaaatattagaagcaacatagatgtctcaggatgaattattaaataaatcactgatgttacaagtatataagccataggatcgtttgtagcactttctaactcaagcatgtgatccaaattatctttaatatgtaacttttgtgttttaaaaattgaaaacactgctgcagcatctgtagaagatataattgaacctattaaaaatgaatccaaccatcctaacccgaatagtaaatgaaccagtattcctacaacaattgcagtaataaaaacaccgacggtagataaagagattccttcccatgttactcttttaatgttggcaagttcagtgtccaaaccccccgaaaacatgataataatcagagcaaaaatacttatcgattgaatcatattataattcgttatcgatgatgatataacctggttggtgtctaaaatcaaacctacaattaaaaaaatcaataatgcgggaacaccgattttagctgtgaatttacttaacaatacacagactaaaagtaaaaatcctataaacaacagtaccaaatgaacatcaaacataaatatcaaattatttcaaaaaatttagattaaaatcgccattactaaaaaaaatataacagctaatataaacttttaattttaacatttataagcattattgttaaagaccctattatctaaataaggtcaatagcaatatttaatgcttcattcatgttctcgcatttaggccctgctccctgagcaagagttaaacggccaccgccgccaccaccaagaacccctgcagcttttttaattatttcatttacttttatgcctgcatcaatagcattttgggaagctgcaccaacaattttaccgtcattgttacccattaaaacaacatcagccttgtcattatctgtaaagtcagttgcaatcttttgaagctctttaaaatcagcatcaattaactgtttaacaactttaagaccattaatttcagtaacatcatcagctaatgaattcatttttaaactagctatttcagactttaacttgtcaatttcatttttttgtgctttccattcagaaaagaacctgtcacaggtttttggaagttgatcgtcatcgactttaaatattcctgaactttcacgaagcagtttgttttcgttctgaattgaatcaactgcagctgtacctgctgagaaatcaatcctttcaacaccgtcctgaaccctttcggttttattgattttaattggaccgatatcaccagttcttaaaacatgagttcctgcacaagcctgaacatcaatacccggtattttaacaacacgaattgacttacccggcacaataccaccctgataaagtttaaatccatataatgattctgcttcatcccttgtataaaatttaatatccaattcaatattgtccattacatattcattagctaatttctcaatttcattaagttcctcttgagaaatacgtttataatgagataaatctatacgggatctggatactcctttttgagcacctgcttgccaaatatgttcacctaagattttacgggcagctgctacaataaggtgagttgctgaatgatggcgggctaaagtaattctcctgttccagtcgattttaccttcaacttttttaccaacaaagttatccaaatcaacatcaccatctacatgatgcaataccacattgttaactttttcagcataattgatattaacaacagcaccatcaacagaaattgtacctacatcagaaggttgacctcctccttcaggataaaatactgttttatcaaataccaatgtgtttttaccgtctttttcaactactcctaaaacttctgcttcaaattctttctgattaaaatctttatagaataataaatctgtttcaggataatcaatttcaaaagattcctttttattggaggtgtctttttcatgagctcctgctacaagagtaaaaaaattatccggaacatttacagtaaaattatctccagctatttcaacaactgtttccggaggaattccatgagcatcatataaatccattaacatgtctaaaggcatttctgttttaccttcttttttaagacgtttaattgatcttttaacaatactggttccttttttaatagtagattgatatctttcctcttcaagagaaataatattcataatatgatcttcagaatctttaatttcaggatagaatttagttaaaaattcaagctgaattcccataacctctgccaaagactctttcatgtttaactctttcatgaaacggatagttcttcttaaaactaaacgggccaaataaccttcctttacatttgaaggaataattccgtcagccagcatgaaagcaagacaacgggtatggtctgcaataatataaattgcttccataggttctgcagattctaaaagttcatctaaagtaatgcctaaactattagccacctgttgacgaagctctttaatatctccaatgtcctcaatatccatcataccagctatttgagcattacgggccaaaatatcagtattgaccttaacatcagttaattcttttaacttatccactacaggagcaaaacatgcatcataagcagtaggagttccctgagaaatccaagctattctttccaaaccataacctgtatctacaactttaattggaatttcttctttttcgccattgtctaaagttttatattgaatgaaaaccaaagtagctaattccacaccacgaacacaaacttcgtaacaaggtccttcattacctccaccactccaccatgatttgataaagcagatttcctcagtgttaattccaatatatttaaagaactcatgacaaagtcttattgtctcatcttcccagtaaatgaaattttcttcagtatttattacagtgtgagatcccattgtaaaacaggtcatgtgtctacctgttcttccaacattatcaacatcatttaaacgaacagaaggttgttcaatttctaaagggtttgctggcggtttaaccatacctgaagtaacccaaggctggaaacagaatatagaagctccaactaaaaatacatcatctctccatcttttagctaaaataggatatctcttaataggagtatgtccctctttttctaaaaattctctgaaaacttgttgaatttcatataaagtataaggtttatcagttgcaggatttccaataaattcatattcatcacatggagcatccccacaggtatccctgtcaacttgtgcgtaaaattcatgtccacaagttttacatttttgttttttataaccaagtttatcgaatatttcaagcatttcaatcaattttaaaatctatttattataatttactatttgtttttaatataataaatatatttttagaaaaagtaatcacattagtaagtgcttaaaataagtgttaagttgaaaataagttttaattaataaaaatagtagttaataaaaaagaaaagaaaaagatagaaaaaatctatccgaataaagctcctaaaccagctgctgctgcttcttcagcttcttcttcctcttcctcttcttcttcctcttcttctacagctgcttcagctgctgctggagctgctgctgcaggagctgctgccatagcagtagtttccattgcttcatcaatgtcaacatcttctaaagctgcgattaatgctttaattctagcatcatcagcttcaattcctgctgcctctataatacttttaacattttcttcgttaatatctttatctgcactgtgcaaaatcattgccgcatatatatattccatgttatcaccattagttttataatctaatttgtaaggtttataataataaaaaattttaattaattattttaaccgaagagagcccctaacccagctgctgcttcttcttctgcatcttcttcctcttcttcttcctcttcttcctcaacagtttcttcaacaacaggagctgctgcaactgctacgttagaaagtttttcagctaattcatcatctaaagctccttcagtacctgatacttcggatgctaaagctaacattttagcttgtgcgagaccaattattggctctgaggtttcagaagtcattattgctgcatcaacaccaacattgattgctctggtataagcaagagtaatgattgtggaaatagtttcctctgtaggaatagctgcattaacagacaagttgaatgcatttctgaatgcattttgaacatctgctaaagtttgttcttcgtcgattgcgagtacttcagaagtataaattgcttcttcttcgtatactgctcttaaatcgatcccaacttccataggattaatatccattcttgataaagtacttgcaacagcagcagatacttcttcacctgcttctacaagaacggtttctttagaaacaacaattttacctttatcaattttagctggaattccaacttgttgtaattcaccgaggaatggacctggttcaaaacctgtgtctccttcaggtataacaatatcatcagtagcaatagcacctggtttagcaggagctgaagttttactgtcttctaatattttatacaatttgaaaggattcatttcagttgcaataactgcaacttgaccttccatatgctctgataaatcaacaatgttgtttttactagcattacaatcttcgagagctaaatcaataagattcttttttgacattctgatgacagctttgttatgaagagatttcctcatttcttgaagctgttttgcaggaatgtttaataaatctacaatcccgataacatcatatttatcaattaaagatttaagctcattaacttcttcttttttccattcagcaacatgagccattagatcaccctcactattggacccatagttgttttaataaacatggatttaatttgatttcttcctttatctaaatggcggtctaagactgtaagaacagtttcaatattttcagctaaatcttcatctgacatatcttggcttccaacaataatctgaatagcaggttgttgtttgataccaactttaactgtgctttgtaatctttctaaaagtggatctaatttgatactagctggcactggttttggcattttattacgaggaccaagaattggacctaaaaatctaccaacaagtggcatcatatcagcttgagctataaagaaatcaacagagtttgctgcttttttagctgcttttctgtcttttcctaactcttctaaatccgctttattaatcacaagagcgacaccagcatctttagcttgaacaataagttccccatcagctatgactccgattttaacttctttgccacggccgttaggaagagtaacttcctcattaaacctattttctggttttttgacatctaagtcgcgaatattaacaatcatatccacagactgtgtgaagtttctcggctttgattgttcttttgcctccttcaccgcttctaatacttcttgtgtcatattatcccccatgaacaaataagtgttcattggattatttttttaaatttggtttcatgagtaatcgattaaagaaaaaattcttcttcgattgcatgaattaaacagtatatcaattataatcgcaattataacatcatatacactgttttataagtttgaattttaaatttgaatagataatgtttattcaactaaaacatcatcgtattttccagcatcaacatctttttgtgcttctcttgggtctttaccatcaacagaaagtcccatacttacacaggttcccattacctctttgacacctgctttgtaatcattagctaataatgaatcaaatttcatcctagctatttttaaagctttgtcaataggtaaatcagctacaatatctgcacctggctcatgagaagctttttcaatgccgagttcttccataatgagagaagtagttggaggagtaccaatttcaatttcaaattctttagtatctctatcaatgctaactttaacaggtactttcattcctgcaaagtctgcacttttattattaatttcttcaactacttgcatcatgttaataccgaaaggtcctaatgctggacctaatggaggtccaggagttgcgcttccgccttcgataagaatttcaactgtatctttagccatcagtcagcctccttttgaataattctaatttgatcagcttttacagtaaccggaataggtactgctgcttctattaactctagaactacttcttcacgtgattcatcaatacgaaccacttttgctctttctcctttaaacggaccagaaataagttcaacaacacttcctttttggatagaggaaatgataggttcaggtttcaagaatcttttagcttcttcaaaagtaattccatgtttaccttctacaacacctcttaaatgaggcactttaagatccggattccttaaatctatttttgttgaagattctactaatatatatccttttaaagattctgggacaagaattgcagaaatacctatgccttcaacactgatagctttatgagctaaaagtctagcaacatttctttcctgacctgcagaggttttaagagcatatatggaactattagcatcttccatgaaaaaatcacctatttttaagttaataaaatcatatagttaagttaaaagttattataaaaacataattaaacaagaaacgaatcatgaaataattagattcttataatatctatatctatattgataatagtatttaaagttttcaaaaaattaaattttgaaataaaattaacattacaaattaaattttattataatttcctgagattaaatttgtaaaactgaattaattataatcctattaattcaccgattaatacaattataaacccaacaacaccaataatagcaattccaattgctacaatttttgaaaattccaaatattcctgtttgtccggttttcttgatactttcaatacccttttacaatctttaatagttttatcaaaacgttcttgaacattcatataaataccctttaataaaaaactacagaatttaatcccatagtagtgaattataataaaataatagtaatgaaataatttttaattttatttattaataaagttttctatgaaaataaaaaaaaagaaaaatggaattagaatattccatcaatgaaatcatctaattgatcttcattagaagtagtttcttgagaatcttcaaaatcatcatcagttatagaattactgtctttagattcagaaatacctgaaacaacaatagttgttctaatagtattctccaagctttcatcaatttgagcaccccaaataatgttagcttcaggatctaatttatcagcaacaacttgcacgattttttctgattcatgtaaagtcatgtcagaactacctgcaatattaattaaagcaccagtagcattggaaatatcaatatctaataatgggctgcttaatgcttcatggacagattctaatgccctgtcgccagaatcagattctcccataccaatcatagccataccggaactgcccataatacttttaatatcagcaaagtccaaacttacaagaccacttttagtaatcagttcagtaatacctttaactgccctacctaagatttcatcagaaaccatgaatgctttgtttaaaggaaggtttggtgctacttccaataatttatcatttggaataataattacagtatcagctgctgatttaagtttttccaaaccattttctgcattttcccttcttctaataccttcagctgagaaaggcatagtagctacagcaacagttaatgcacctgcttttttagctaatttagcaatgattggtgctgaaccagtacctgttcctccaccaagtccgcaggttacaaataccatgtctgcaccttcaagttcatctctaagttcatcttctgtttcttcagcacattcttcaccaacagaaggatctccaccagcacctaatccgccgcatgtttgttttcctaagaggatttttttactagactggctataaaataaatcttgagcatcagtgtttacagtaattgttgtagctccttcgattcctatttcatttaacctagaaatagtattattacctgctcccccagcaccaacaacaaaaatattagttttattttgtttaaataattttattaaatcattatcaatatctgaggaaatttttttaggtgctttctcttccattctttcttcggattctttgattgcatcatctataaatttcacgagttaaccccacatactctttaaatatgttaactatttttgtaacaactaatatttaaatgccactactttttaaattttaattaaaaaaaattaaaataaatccatttgacctattattcagccatgaaatggtgtataattatctaaatattttaaaaataactaaaatgcatattaaaattaaaataaaattataaaaaagaaataaacaatattttagcatgataaaaatattaaaaagacagtaataccaattaaattcaaatatatcacttataaatatccaatatatctttttttaattgctcaatttataattaatcaaaataccactcaatacaacataaaataaaatattaacattaataatcaacttttttaatattaatcatgattaaatattaacttattaaaaacagttaagttatacctcctatttttgaaaaaaaggcaaaacaaatctattttacgtcaaaaaattgaaaaaaaataaaattattaaaaaataaaaataaataaaaaaattaaataaaaataaaaagttaattaaaaaataaaaataaatattgaataaaatacaatagttttatatatatctaaacagtatactattaaataatctcaaagaaatattgaaaataaattaattaaaaagaatatttaatgaatattatttaataaaattaaaatatttttatataattacaataatgttcaaatttttattgtgacattattaaagaaaactgtagttttattaaataatatttgataattcatgtatcttcgagattgcaaaaacaaacaaaggtaatttaaatgtttaaatttgataaagaacaaaccgtatttgattttggtggagtaaaaatgggtggacagccaggagaatatcctacagttttgtgtggtactatcttttacggcggacacaacatcgttaatgatgaattaaccggagatttcgacaaagaaaaagcagacaaactccttactgacatgattgaaatgtctgatgtaacagggaatccttgtattgctcaagttttcggacaaactgaagaagctattgtaaaatatcttgaatttgttggagacaactatgaacttccatttcttatagactccacttccggagatgctagagtagccggtgcaagatatgctgatgaagtcggtttaactcaaagagctatctacaattcaatcaacatgtctgcagaaaaatccgaacttgaagcacttaaagaaactgacattgactcttccattatcttaggattcaatccaatgaacagtactgttcagggaaaaatagctatgtgggaagacggagacgacggatcttacgaaaaaggtttacttgaagtagctgaagactgcggaattaccaaatttatgatggatactgctgtaactccattaggacagggtgcaggtattgcaggcagtgccacttttgcagaaaaatccaaatggggatatcctgtaggatcaggtattcacaacatcccgtctgcttgggactggttaagagattacaaaaacgaaagcggaaacaaaaccgcatttactgtttgtgatatcggtgcaaacattcttcaggtaatggtcggaggagactttgttttatttggacctatcgataatgcaacaatctgtttcccagctattgcacaaactgatatgtttatcgcagaagcagctgcagaacttgatactgaatctatcgaatcacacccaataaataatctattataaaattacttatttcacatattccatttaaccattaaccatcatcatattaaaaaaataaaaaataaaaagaagctattggcgaggcatagctataatttcatgaatattcaaatcaaaaacattagtcatgttggcaggagttaaaacaactgcagtgtcaacaccctgtgcacggccaccaatagctatgatttcttcatcaacaggaattaaacccgcatcagcagccataatggagatttcacaagctacttttaccccatgtgaaaacatacgaagagtatctgctatgatatccggaggatttatacctcctaatttattagtgattccgcgaccgaccccactaaatgcatgagaccctataaaagtgtcaacacctttttcttcaagtttgtcaatcatttcatcggagatatccacttcatttggtccgctgaatccggcatgatgacttacattaattatttgtgcatccccttcaatagcatctgctaatttcaaagctgatgcgcctgatgctgaagcaataagaatatatctaatctcatcagattcatccaatctttgtttaacaagagaaattaattcatcagtgtaattttctccttcttttgagtctgtaaaattttataggcttatttgttttttaattttttacagttgaactttcattttgatgaaatttcattctaatttttctttaattttaatataaatgatttaaaaatagtaaaatactttaataagtgaggacaaataatattttatgaccaaacaaaacaaatctgccctcaatagtaatatagacttcatacaacttaaactttatgatttttttgatgaaaaaattgatcaagaaaaaattatttcaaaaagattgaataaaacacctaattttgaaaatactaatcataaactatttttagatgaaaataatacttttaaatatgataatcccatttgtccagtttgtggaagccacaaaataatcaaaaaaggcacaataaagaaaaacaaacaaaatactaatggaaaaacaacagaattcaaagaacagcaatatcaatgcaaaaaatgtggaaaaaaattcggaatatacaataatccattaattggtgaaaataaacaatttttacaagaaataatggataaaattccaggaataatgaaaatagggtaccaatcacttcgtaaaataagtaaatactttgaaatattccttggaatcagaatatctcatcaaacaatcaagaactggtctgacaaaaatcacgaagaaagcatcagcaatgaaaaatttgaatattctggctattatttatatgatgagcaatttttaagacttaatggaactagacactacagattaactttatttgatgcaatactcaatattccagtcacagaacgaatagtacgtcgcagaataccaaaaaacacgaaaaaatttatcttagaatcaacagaaaataaaccattcatttgcctaacaaccgatttattcccaatgtatcgtaatgtagcagatgaaatagaagtaaaacatcaattgtgcatatttcatctgtttcaaacaataaaccataaattaaaagtatattgtagaagaaacaagattaatggaaaacaaagagaccatatttacgaaaatgcacaagaattaaaaaactgtttcagacaaaactcaaaaaaagaagcaatagaacaatttaaacaatatttacaaaaatatacggccataccagttgttttaaaagatttcataagaaaacatatcataaatcacttccacagatacgtagaatatcttgatgatgaaaatatagaaaaaacatcaaataaagtcgaaaattactacagacaaaccaatcctgaaaaaataaagaaaatatacaaaaccaaaaatggaatcctgacatttttagactatcaaatgcaaaattggactgaaaaacacattaaaatcaaataagcctataaaattttacagactccttctttttcaaaatatgttatagatttttccattgaaatcaccttaaataataataaatacaatatattatttatattaaatagttgaaggaattttatgagtaagaatttggaaaatattaaacacataactaatggagactacattgtaataccaattgaaaccggatatattaaacctaatgaaaatttaaattcaatcataaatcctgcaaaagagattatggaagacggagattatttggtaatagctgaaacaccggtttccgtttcacagggcagattagttgatgaatccaactacagcccatcacttaaagccaaatttcttacaacagtctggagcaaatacctttggggatatgtcttcggacccattttaggaattaaaaaaagaaccattaaaaacctgcgaagacttcccaaggaaacttatgctcataaagaggtagtgctgcaattatacggtttgaaacatgcactaaaacctgcatcagaagccggaattgatttaagtaatgctccgggaacttgtgtgtctttacttcctgaaaatccccaaaaagtagccaaacagctgaaagctgaaataggcaaaaatgtttgtgtgatgattatcgacactgatgcaacatataaaaagaatggaaaatattttaccggactgccaatagctattgacggtattgaagccaataaaggcgtaatcggatatgtcaaaggacagttaggagaaaatatgggatcaacaccattgggttgcagtgagaatatcagtgttgaagaaggtttgaaaatagccaatattgctgaagactatcaaaaatcattagctactgaaatgtcaacaatacacagtgtcaaatctgttttgggaactgatgaaagcagtgtaactatagaagctcttgattcaataactcatacacctgctgtaattataagaaagaaataatatttatagtagaaaatacataattaaatcattgattattatattattatttttttaaaatcaaagcatttttaggagaaattaaatgatagacgatcccttagtaaaatccttattaaccaatgttgtggaagatgaaagcaatttacctattgttcaggcattaattgatggtgttgaaacagatgaggcaattgctgaaaaaactgaaattaaattaaacatcgttagaaaaatcctttacaaactttatgatatgggattggctacctacaaaagaagtaaagacccggaaacacaatggtttacttattcctggaaatttgaagaacaggaagtgattaatcatattaaaagcgattcagaagaatatctaaaaatgcttaataaggaactggaaaaagaagaagatacaatgtattttgtatgtcctcaaggacacatcagacttgattttgaaactgctacagaatatgatttcatttgcccggaatgtggtgaagaattagaattctttgataatactaatctaattaaacagataaaagatgatattaaaactgttgaaagcaactacaaatctttcaccaaaaaggttgatgcttaagataacatggaattgaaaattttaaaacaagaagaaacacctgaaaatgtaattgaacattcaaaagcagtctgtaaaaaagccatgaaaatagcggataattttaaagatgccgataaagatcttattaaaaagggagcattattgcatgatattggcagatccaaaactcatggcataacccatgctgttgaaggggccaaaatagttagagaatacggttatcctgaagaggttcaaaatattgtagaaagacatatcggagcaggccttagtgaagatgaagctattaagcttggccttcctaaaaaatcttacattccacaaacaattgaagaaaaaatagttgcacatgcagacaatctaattagcggaaccaaagaagtggacgttgattttgatattgccaaatggaaaagaaaaatagatgaacctgaagaagatattaaacgattaattgaactagataacgaattaataaaagcatttgaggatgaataaatatgaaagtaatttgttcaagtgaagagtcattataccgtccggaagctgtaagatggcgtcaaagaatggagttaatgaaacctctgggagataccgttgttttattgccctgcagtatgaaaaaaccatattcaaattccaagtctcatcaaaaatttagaaaagtaagcagatcatttcaagaactcataataacatcacctttcggaatctgtccaagagaattagaaaatacttttccaatccagtcatatgatgttgcagtaacaggttcatggtctcaggatgaaatagatgagtcaggaaagctacttgagaaatatgtcaaaggcaaaaatgtcatagctaatgtgcatggaggctatgaagaagtctgcagacaatatcttgacgaatgtacatatacatgtaaagacggacgtccaacatccccagattccatttataatttaagaatggaacttaaagaacataaaaggaataatagacgagataaagttttaaatgaacttaaatcaatagctacttaccaatttggaaaagagggaagcaaacttattccagaggatgttaagacaaaaggaagatatcacagaaaaatcatcagcaatggaaaacaacttgctttattaaatcaggacaccggattatacagacttaatttagcaggtggagaaatattaaaagatttgaatattaatgttgttaacattgactttaatttagaaacaaatactgtctttgctccgggaattagaaaagcagatcataacatcatacctaatgatgaagtagttgttgttaaagatgatgaagtcgtaggtgtcggaaaggcaatattaaccggccgtgaaatggaacagtgcacaaacggtatcggtgtcaaaataaaacatagagtgaaaaacaactaaaaactcttattttttaaaaatttaaattaaaaagtcttttaaaattgaaaatgtattataaaatttaggcatatcaaaatatagttattaaatgcttaaatttccttattttattattaaacaagccataaatccaaataactacttataaatataacaaaaccaaatactattaacaagtttaaaaattaggagaaaaaagatatgtcagaagatttagtaaatgatattaaaaatgctgtttcagtaattaatgacccacacatgggtgtaagtattgtagaaatgggtattgtacaagacattatcgtcaataatgatgaagcaaaattaattatcaaaccaacaaaccctggttgtatgagtattgtccgtattgctgctgatgcaaaaactgcagctgaaaatgtagatggcatcaacaaagttgaaattcaagttgaaggccatgctatggcagactcaattaatgaaatgttaaacaaataatcagtgaaaaaactagaataaccgaaaaggttatatatagtaacaatcataagtataagtgttgcttgtatcatagcgacacattatcataggctagtggcacagcttggttagcgcgctcggctgataaccgggaggtcatgggttcgaatcccatctagcctactttaaaactaattttaccaactaacttttacctataatttaaaatactaatttttatatactaattctaactaaaaattacattaatgtacaaaaagttggaatgatgattaaaatgtgggaaaagattaacgaaaaattcaaaaaatatccggcacgtatgaaagtagccgaaaaaatgattgaattaggactgtctctgaacaatgacgggaaaatatattgcggcaatcttaaaataagtgacaaagcattagctattgctgcagatgttgacagacgagctattaaatcaacaattgaaataattcaaaatgatgaagatctatttaatattttcagcaatgttttgcctgctggaactcttttgaaaaacatagctaaaaatttaaatcttggagttattgaaatagaagtcggatcccaaaatgaaggaatactggctgcaattacaaaaataatttcaaaaaaaggtataaacataagacaggcttatgctgaagataacgaacttgaagaaaatccaattctcacagtaattaccgaaaatccaatagataatgatttaataagtgaatttttaaaaataaaaggagtaaatagagtatcaatttactgattcaaatcagccattctggctttttccatttctctatcttcttcttcaagaacttctaaaagttcttcccaagcttctaaagattctttagcagcttcttcagatagtttttctattgcataaccggcatgaataagaacataatcaccaatctcaacatcaggcaagagattaatttttgcttcctgtcttactcctccgaaatctgcaaataaactttctttttctctgttgatttcaacaaccttagcaggtgctgcaatacacatagtttttctccctcttgtaaaattaattcaaaaatataatatattatctataataaattaaacctatatataattatctatgaggttgtataaatgaaaaatattgttatcggatcaggacctgcagggagattagggtctttggaacttggaaaattaggcaaagaagttactttaattgaaaaaaaccatatagctggaacctgcctaaatgaaggctgtatggttatatgtgcattaactgacattaccaaattcattgaaaacaataataagtttaatagctatggattcattaaaagtcagctcgatatttcatatgaaaaaatagtggaaaaaatcaccgaaactcaaaaaatgctcagaaaaataaacgaagaagaaaacaaaggtgctggaaacaatatagtttatggtgaagctgaaataaacggcagtcaagttgaagtaaatggagagtcctttgactgggacaatttattaatagctactggtgcacgtccttttattccggatattcccggcagccaatacggtttaaccaatagggatattttgaaaatagataaagttcctgaaaaattgaatattgtcggcggaggaatcatagctgttgaagtagccaatatttactcaactcttggaagtgaagtcaacataatagccagatcaaaagcactgaaagaaatcgacagcgacattaaagattacatttttaaaaatctcctttctgaaataaatattctagaagaaactgatgttgttgaatgcaagaaaaacaaagtaattaccaataaaaatgaagaattggaaggagttcctttttttgcaacaggaagagtagcaaattcagaaatagtcagggatattgttgagttaaatcctgacaataccatcaaagttaatgaaatgatggaaacaaccaaagaacacgtatatgcagcaggtgatgttactggaggatatcagttgacaccagtagctagaatggagggcataacagctgcaaggaatatggccaactacccaaataaagttgtttaccatgcaattcctcaaacattaagtttgaacacagaagtaagttttgttgaagatgaaaaaaataactgttccgaagaggataaagttgatattggaattcctggaatagcaggacctggagcattctggaaaatattaagcggagatacaggttatacaaaaatatcctttgataaaaaacaaaacaaaattaaaaaaataaactccatctcaccgtcttcagttagtgatattgcatatttatcatatttaatgcgaataaactccccattggatgaatatggagactttttagaaatacatccttcaacagatgcaaattataaaattataaaaagtatgtggttgtaaatttatttaaccacatcaattattttttgagccaaattggatttggtttccaaagattctttagcatacttaacagcattctttttaagttcgtcaaactcatcaaatgccctgaatatattgtcatttaaactgtcaaggtcagattctataatggctcctttaaagacacccgccatattatgatatcttccccattttacttttgttagtgttacaataggaagtttggaagccagtgtttcttcaagcaatacaccgtcatctgttaaaactgccaaatcaatataagttaataagtgactcatccagtcaatataacccaaataaattacatttccatccagatcatccaaatatccttcttttaaaggcaatccaaccaataaaatattatactcatcagagaatttggcaaagttattagctccttttattattcctttaaatattgaagaacctgaagaaaacagtattgtttttttattttcatcaaatttcggagattcttttaatttttcaagagcaatatcaggattaccattgcctactccttcacttaaaggatataaagtgtgatttatatttttcggaaggtgttcaggcagaaaatacttcatttcaggcaatgcataacattgattaagtttaggacatatcttagaatccaaaggagtggagattattgatactcccggtttaccagctaatttagcaccaacagaacctacaatagctcctccaccaataactcctacaacaatatcaacatccagttttttaataaggcttcttgctttaaatgttgcagtcaacattttaaatgctgctttaacagatgaagcttttgttgctgcatggcctccggcctgaggaatttttattttatgccatgttctgccttttttcttaaataataaacctggtgcagactcatccagagctatttcacattgaactcccttggcttcaagaccttcaattatattgtatgctataactgaatctcctccaagtcccctaccagtaattacaattaatgccttcataatattttaactcccgtcaagtcttactttatatgattttttctgttcatgactgccatgagttggagcataaggattataaagaagtcttctaaatcctaattttatcaaagtcggattttccacatcatactgttttgtttttaatatgattcttctgaataaatctcccaatccgccaccagttaaaacatccatgaagaaatctccaaatgtcggatttaaaatgcccaatctttggttgaaaaatactttaagagtgcttcttctaacaaatgctgtaagacatacagtcacaaaagatagtgcaattacccaccagaatcctccgattaaatagaaacaaattcccaatgcaactgcaaatgaatggtttccaacttcccccaacatgatttttccagcaaaatccaatggagaatatgctatacaaacaattatcaataataaaggagtgtaaatagcaggcaattctgaaacttgcggagatccgacaatcagcatacagattatacttacaacagacatgatgactgtaaccatacaggttgatcccggctgcatatcagaaatgttaataggctgtaccagcaatgcaatgaaaattgaagataaacccattccggaatagaatcctgcaatcataacaaaaagcattccaatacctctgaaaagttgaccccactcaataccaattggagaaggagttcttcccaaaacatcatccaaaaatgcaaaaagacccataattaaaactaatgtattatattccggtaagaaaaagaaacacaatataataaatggaactaaacctatagctcgaggaattccaccacgtacatttggatacaagttacccaaataaccttttttaccaaaaaagcgaaataccatatttaaaaccagtgaacctacagctgataaaataaatacaataataaatgcttcaatcatacctgtatacaacatgttaatcacagtttttcattaaaaaatatagtcattttttaatattgttactagttataacttataataattaatattatataaatctttatttaaaaaagaaattaagctatttcatatcttaaaatagctgccatactacccaaacctttaagttgctccccaccttcatgctggctactgataaccattacttcaccattcatattttcaaccatgtccattaaatttcccatatcattaatagctactgcagaatccagtaccaataactgtttaactgcaccaaggtttattgctttaacagtttctttttcaccataagccactttagatgaattcttacctatttcttcaagaagattgttgatggcaaccatttcactggctaccctattttccacagttagtttctcaacagtcccttttttaagaacttcatgaattccaacccttcctccagaacctgtactttcaataattgccttatcagctaaatccttatgcttatttttaatataatcataaaaatcatttttaacaaagcccggtcctgcaactacaatattttgaatatcatggaatttattgactgattcaatgaccttttcataaaactgggcgattgcctttgatctgtttttatccacaatgcgctttcctgaaacagaacctttaatcggaccataatattcaataccgaactgtctcatcaaacctaaagtagctgtgtcatcctccaaaagaacaatgattgcagctaattttttagatgcttcaatagcctgattgagtctttttagtgcccagtttgcccacttttcctttttaatggttattggagtgttaagtttaacttcaactgtatggtgtgaacctaaaggaataagatcttccggaccttttgtaattaccccggtaagccttaattttccggtaaaaatatgaaaagtaatattttcaacatcaattcttaaagtaaatgtttttttgacccctctgtcacttcttaatttatctccagtattgtcctgaatacgtctggtagttttggaagatacactgtctccaacctctacaatatgagacaaatgccacaaatcatcaagagtttctggaactaatgtcacaattccttcttttttatcctgttttacaattttcatatttccacatctaaattatttatatatctgataacttaaattattaatgattgaaatgaaagttggaataataggcggaagtgacggtttgggaaaaaccctcatttactttttaagagatgattttgacgtaatcataagtgcaagagatcacaagaaaggaagaaaaatagctaatgaattaggtatcgaatatatcgaatcaaacacacagctggctgaaatgtgtgatgtcgtaatcgtatctgtccctattcattttacacctgacgttattcgtgaagtggctccatttatgagaaaagaatccctgatggttgatgtaacttccgttaaagaaatcccaagtcagactatgaaggaatcactgcctgatgatattgaatatcttccaacacacccaatattcggtccgagaaccacagaactggacaatcaagtaattgtcttaactccagataaaaaaggaaagtggtttaataaggtctacaattatttggataataaaaatatgagaataatcgaaaccaccgctaaaaaacatgattatatgatgagcattgttcaggttttaactcatttttcatttatttcaactgcatcagctatggagaaactaaaagtagatattggagaaactgaagactttgaaagcccaatctacaatctcatgattgatatgattgcaaggattgtagcgcaaaatccttatttaacatattacatccagtcaatgaacaacaacggtccccaaataagaaatacttttgccgaagctgttaacgaactcagagatgttataaataatggaaatgaagacaaatttgttgatttagctattaaagctactaaaaatatgggagacattagcggagcactgggtagaagtgataaagctatcaattcactaaatcatgaacacagcttactgaaccaatccatcggcaaagaaataggactgaaacatatatactccagaaaaattcatgtcggcattttagaaagggttgacaaaaatacggctattctaaaaaacgggaacaaaactaaaaaattagttgtagcaaacattgaagttttaagtgacagcgaactttatgactggaaagttaaaaatttaaataagaaaactgaatcaataagttgtgttttcccaatacgtgttgataaacatgttattttagatacaataatcaatttggacaatataattgatgctaaaatcactgatgtttaccaaggccctcaaattaaaaaagaggatgtcagtttaacttttgaggttaccggcctttacaaagacagtattgaaaatgccaaatctttattaacaggatttggtggaatcataagataaattagttcgtttgaatgtatacgaaacaaatttattatcacaatactttattaaattacttctttttatgaaataaaataataaagttgttaatttttaaaataaaactttaaaaaatatatattaatttattataaataatttatctcttttttaaataaataatgctcaataattaatttttgattttacacttgaaccgaaagctttatatagtaacacatatcaatatataattgtttctaagaaaagaaacataaaataagcaaaaaaaaaattattatattatttttattatttagtgaatttaaaggaatttatcctaagcatgtagttttttaaaactatatagtgcgccatttaaaaaaaggagatgataccatggcacaaaatgaaattactttaaaagtagctgaagctctttcacaaagagatatcggtcaaggaatcgcaagattagacccaaaaaccatgagcgatctcggaattaatgaaagagaccttatcgaaattactggtgacaaaaaaacagcagcaattgccctaccttcacaaaccgacattggtcttggagtgataagaattgacggattagttcgtaaaaactcaggagcaaccatcggcggagaagtaaccattaaaaaagcacaagttattgaagctaaaaaagttgttcttgcaccaactgaaaacaacattcgtgtacaaggagatgtacgcggattattccaaggaaaagcaatggttcaaggagacattatagggtctcaaatcagaaccagaccaaccagcatgggaatgggatttgacagcatatttagtgatttaatggatttctcaccaatgaaagaaattaaatttgctgtagtgtccaccaaaccggcaggaattgttgtagttggaccaaacaccgaagtggaattacacgaaagtcctgtagatgtatccaacatcgaaggtgtaactaatttagttgatgtaagctatgaagatatcggcggtcttaaagatgaagttaaaaaagttagggaaatgattgaaattcctcttaaaagaccggaactctttgacaaattaggaattgcacctccaaaaggagtgttaatgcacggaccaccaggtacaggaaaaacattactggctaaagcagtagccagtgaaagtgatgctcatttcattgcaataaatgggcctgaaatcatgagtaaatatgttggcggatctgaagaaaacttaagggaatactttgaagaagcagaagaaaatgcaccatcaattatattcattgatgaattagatgctattgctccaaaaagagaagatactcaaggtgaaactgaaagaagaactgtagctcaacttttaaccttaatggatggtcttaaatccagaggacaagttgttgttattggtgcaaccaacaggccggattctcttgatcaagcattaagaagacctggaagattcgaccgtgaaattgaaattggtgttcctgattctgaagaaagggaagaaattcttgaaatccatacaaggaacatgcctcttgcagaggatgtggacttacataaactagccagtacaactcacggatttgtaggagcagacttggaatcattatgtaaagaagcagcaatgagagttgttagaagaattattccggaaatcaaaaacgatgaagaaattccagaagaagttcttaaaaaaatcgttgttacaaacgatgactttaaatcagctttaaaagaaattcaaccttctgcattaagagaagttcttgtacaagtacctaatgttaaatgggatgatgtaggtggacttgacgatgttaaacaagagttaaaagaagctgttgaatggccattaaaacatcctgaaaaattcgaaaaatttggagtaaaaccaccaaaaggaaccttactttacggagttccaggtacaggaaaaacattacttgcaaaagcagtagccagtgaaagtgaagctaacttcatctccatcaaaggtcctgaattactatccaaatgggtaggtgaatctgaacaaggtgtaagggaagtatttagaaaagcaaaacaaactgcacctactgtaatatttttcgatgaaatcgattcaattgcaagtacccgtagtgcaaatgacagcgacagcggagtaaccaaaagagtagtaaatcaattattaactgaaatggacggtttagaagaactcgaagatgttgcaatcattgcagcaaccaacagaccggacatattagatgcaggtttaatgagacctggaagatttgacagacacatcaaagttgatttaccaaacgaagatgcaagattatctatcttcaaagtacatactgaaggtatgccactagctgacgatgtaagtcttgaaaaattagctaaacaaactgacggatatgtcggagcagatattgaagcagtatgtcgtgaagcagcaatgttaactttaagaaacaaccttgatgctgaaaatgtaccttacaaatactttaaagaagctcttgaaaaagtcaaaccatctaacagtcctggcgatcaggttcagtatatctagatagggaagattaaatttcttccctatttttttaaaacaatcgtaatactttttttaaaattaataataaacagtaaatttttaacataatgattaactaatataaaaatcatgagtgaacatattgttgaagcaatcggattaagtaaggtaacaatcaaggacggaaaggtaattgatgttagcgaacctaaactgaattactgtccattatttcatcaccacagaggaatggaaaaaataactaagaaagctatttgggacaatatgcaatttagaatcgatgattttggaatgtgtacatcaaatagacagcttagaatgaaagattttctttcttttggaatttctgaaattttatccacattaattaaggaaaatgtaatagactgtgtagtaatggtttgtgaaggttgcggaacattaatagtaactgaaagtgaattagttcaaggtattggaggaagagtctcaggacttgttaaaactagcccgattcctgaattgtttgaccaattaggcagaaaaaatattttagaacctgaaactgccaaaattgatcagacagaaggaatcaaattagctatcaaacaaggttataaaaacatagctgtaacaataacattagcccaggactgtcttaaaatccgggaacttaaaaaagcacatcctgatgtaaatatttacacatttgtcgtgcatacaagtaacataactaaaaaagaagctagaattctttttgatgaatgtgatgtagcaaccgcctgtgcatccaaatacattagagaaattggagaagctgaaagtttaaaaacagtcggccagtcaattcctatttattctaaaactgaaaatggtaaaaaattcttagaaatgaggctggaaaaaattggcgggaaaaaacctaaaaaagaaaatccaaaaatacctgatccattattataaactaacttatgaggggaaacattgacacaaaaaagtgaagctcaaaaaggcaatatcactccagaaatggaagctgttgctcatgatgaaaatataaacgttaacaaactagctaaattaattgctgatggaagagttgtaattcctaaaaacatcaacggccattcaaaagcctgcggaattggtgatggccttaaaaccaaaatcaatgcaaacatcggttcttcaagtaaaattgatgatattgaattggaagtaaataaagctaaattagctcaggaatacggtgcagatgcactgatggatttgtctaccggatctgatttgacaacatttaggaaaaaaatcatggacgctgtagatataactatcggaacagtgcctatttacgaatctggagtaattacacttaataaaaacaaagaaatcatcgatatggatgccgatgacctttttaaagctattgaaaatcaggctaaagaaggggttgatttcatgactctccactgtggaataaccaaagatttagttgaaaaattagaaaaagctaaaagaatgatgggaattgtaagcagaggcggaactttccttgcatcctggattaaacacaaccagcaggaaaacccattatatgaaaattacgattatcttcttgagctgtcctacgaatatgacattacattatcattaggtgacggattaaggccaggatgcctaagcgatgccagcgacattccgcaaatccaggagctcgtcaatttaggaggccttgttaaaagagctcaggatgcaaatgttcaggtaatggttgaaggaccaggacatatgccattaaaccaaatcaaagcaaatatggaaatacaaaagactatctgttacggagctccattttatgttttaggtcctcttgtaactgacttggcgccgggttatgaccacattacaggagctattggaggagcaatagctgcaagtagtggagctaactttttatgttatgtaacccctgcagaacatttatctttaccttctcttgaagatgttaaagaaggagtgattgcctccaaaatagctgctgaagctgctgatgtttctaaaggacttgactctgcatgggaaagagaacgtgaaatgggaaaagcacgtaaagaatttgattgggaaaaacaattcgaacttgcatttgaccattccaaacctcgcagttacagaaacaaatgtgaacttgacgatgacgaaatgtgtgcaatgtgcggagaatattgtgcagtaaaaatagcaaaaggcgacttttaaatgaaatatcaagaattagtagatgtatattctgccctggaaaatacaactaaaagactggaaaaaacgcaaatcatatctaatttcctattaaaattagacagcactacccttgagcaggtaggtttgctaatattaggcagcatatttcctgcatggagtgataaagaaattggaattggtaataaattagttatgcaggcggttggtgaagctgtaggagttactcctgacaaggttgaagatgcagttcgtgatcagggagacatcggacttgcatgcattagcttatatgctaaaaaatcacagaccacattcttttctcagcctttaacaatagattttgtatttaaaagcttaagaaaactttctgaaaaaagcggagcaagatcaacaaaacgtaaaattgacataattttggaaatgctgtctcaagcttcagccagcgaagcaaaatatttaacccgtactattcttgaagaacttagaattggtgttggagaaggtgttgtaagagatgcaatagctcaggcattcaatattgacaaatcagttgttgaaagggcaatgatgcttacaaatgacttaggtttgatagctgttgttgcaaaagaaaaaggggaaggcggacttaaagagttaaacctgactcctggaactccagtaaaacctatgcttgcacagcttgcacctccgattccagaaatcataaatgaaatgggagtagctatctgtgaaaccaaatacgacggaattcgtcttcaggtacacagacacagtgatgaaataaaaatatttacaagaagacttgaaaacatcacccatgcactgcctgaaatcgtggatttatttaatgaatacctccctcatgaagattatattgtagaaggtgaagtaatagctacaagagacgggaaccccttatctttccagaatattctacatagagtcagaagaaaacacaatattgacgaagctatggaacaggtccctctaaaagttttcctctttgatttgttatactacatagttccgatgattgatgaaccattacttaaaaggagaaaaaaacttgaggaaatcgtcaacaccacaccagatgaaatcaatttaagcaacatggtttatggaactccagatactattaaagaagtggaagatctgtttgaattgtcaatagctcaacatcacgaaggaataatgattaaagatgctggagagccatatattccaggacttcgtggtaaaaaaatgcttaaatataaggcagaacctgaaacattggacatggttgttgttggcggaacatacggtatcggtaaaagaggagattttgtcggctcatatctagtatccctacgtgatgaagacaataatctaaaaacagttgcttatgtggctacaggtcttgatgatgctacactagaatatcttactaaaaaaatgaaagaatacgaactgtctacaaaaggcagagaaattgttgtagaacctaaaatcgtattggaagtggcattcagtgaaatcgttgaaagtcctgaatatgaaaccggatactcattgcgtttccctgttgttaaaaatatcagaaaagacaaaggagtagatgatattgatacagttgaaaggttaatttcaatgtatgaaactcaataatcatctaaagcttttacattttgtattacttttcttgttacagggtatacaacaacttcataagctgttttgaataatgcctgtgccacaatcatagttagaagtgcaaatagaggcattgttcctaaaaatcctattgtaataaatataattgcatccattccttcaccggcaaatgtagatgcaatacatctgaaaaataatttttcctcatttttatattttaaataaaccatcagttttgcattaatcaatgatccgaccagataagctataaaactagctatcagcaatcttaaagtacttcccaaaactgtatggaaagctgcatcagctgtaaaatatgcaggagccggtaaaaacatggttatattataacagattacagctattaaattaatgaaaaatcctaaataaatagccattctggctttctgataaccgtaacactctgcaagtacatcattaacaatatatattattggaaatattataactgcacagggcaagcttacccaatacaattcaaatgttttgcttgcaattatatttgaaacaatcaacgatgcacaaaatatcccaacaagtattgcatataaatctgttttttttaaatcactgttaccaaacatacatatttaaattatatttttgatgtaaaaaaagattttgcaaaacaatattttaaaataaaaacctatcagctatttttaaaataaaaatcaagataaattcatggaaattacagatgacaaattactgaaaatagctcttataacttcattgataggtttaatcggtttaataatatttactccttcaattgaagttaaaaaagtggaaattcaggatataaacagaggcatgattgatgaggaagtcagcattgactgtgttgttagcgacgttaaagcctcagcaagtaaaagcagctattttttaactatcaatgacggaacaggacagatgtctttaataatttttgagagccagttagcccagctggaagataacggaattgctgttgaaagttacaaaggcaagaaagtcagtgttgccggaacagttacagaatacaattcccagctggaacttatcctatcaagcggagatgcaataaaaattgtctaacgcaagcttttaaaataagctgaaaaattaacattatcaatcaagtaaaatcccctgcagaataaagaattttcgacatcattaactttttatttatcaaaaataaaaataactgtaatataaaaaattatgaggcaattaataatgtcagataaaaaaagattattcgggacttttggagttagaagagtagctaatgaagttttaactcctgaatttgcatccagacttgcagcatgttacggatcagtagttcaaggaacagtagctgttggtggagatacaagaacaagcagtcctatgttaatggaagctgtaaaagctggacttttatcttccggttgtgatgttgtagatttaggaattctgcccactcctggagtccagtatggagttcgcaagtattatgacggtggagttatgattaccgcatcacataatcctccaaaatataacggaattaaatttttagatgaattaggtattggaattcctgatgagatggaattggaaattgaaaaattatattttgatgaagaaccgaaaagagctcattggagtgaaattggccaattataccacaatgacaaaattattgatgaatacatcgatgaagcaatcagcaaagtagatgttgaagccattaaaaaagctaatttgaaagttgttgttgactgcggttccggagcaggatcatacactgccccttacctgattagaaaattgggctgtgatgtaactactctaaactgtcaggcagacggatttttcccaggtcgtgaccctgaaccaattgaagaaaacttacaggagctaattaatgttgtaaaacagttaaatgcagatatcggacttgctcatgacggagatgcagacagaaccatctgtattgatgaaaaaggaaactttgtacttggagacaaaacattttcacttgttgaaaaacagatgcttaaagaaaacaacggaggtacaatagttacaactgttgcaacttcacaggcaatttatgatattgctgaagagtacaacggcaaagtaatagctactgctgttggagatttacttgtggcccgtaaattaaaagatgaaaatggtttatttggtggagaagaaaacggtggtttaatcttccctgattttgtttatggaagagatgcagttatgactgtggctaaaatacttgaaacaatagctaaggagaaaaaaccgttatccaaactggttgaagaacttccggtttactatgcaacaaaaacaaaaattgaatgcagtgatgacttgaaagatgaagttatgaacaacatagcggatgaaataaaaaccactactgattttgaacttgataccactgacggtgttaaaatcctaaaagaagacggatgggtaattatcagaccatcaggtactgaaccaatcttcagatgctttgctgaatctgactctcaggaaaaggcagatgcaatgactgagtggggattaagtttaattaaaaaatacaaacattaagaagtattaatttacttccaatatttttttttaactcttttttattgattgatgagggaacatcctccttaagccagtgcctgctgcaggccactttatcaaggagtacgcattgtggaggcattccaagtgttgctgctttccatcctccagatattaaattcaacgggcatgcaactccaacaatagccagatcttttttatcttcatctgttgcattttgaaatgctgaggatttatgggaaaccagatatatctcgcagtcatactcattatttattttagctatttcacattcaggattgcaggctgtgcaaacttcacctaatcttttttcaacagcctgacagtgtttttggtctattttcatacatgttggcaggacaattgcttttctttttcttgattcataatctggtctgaaaattcttcccattatttcagagcaaagcatgtttaaataatatagttctttcggactattgaaaaatatttcctcttgctttgatttaggtatatcttcatattttttcaaataatcatttaaattaaatgtatatgatgataagtatttttgtgcatttttacaaaaccactcccccaaaaccagatacggagaaaaatcaacattttcccattttcttaaatagggaagctgatcattaaaatcacctatatattccaaataatcaattatttgttctaaagaagaaaatttatcacagcacatcttccaatatatgctgacaatcaatccttcaagaattttttcatcatcatcaaagtagttgtgagcaaagtctaaaaattcactggcaaatcttttgacatccctgtaataactgtcattaacttcataaggtgaatccaaactactcatttttatcagcccttacactatcaagcaggaatttatgatactcttcaacttcatcaaacatgatttcaatttctgcttttggaaagtcgtcatatttcagaaatatttcccataacttgaacattgaaaatccaaagtacatttcagccaatttatttggattgcagtcgctaccaattacatttttctgaatcagtatttcaaaaacatcactccagaagtcagtagaccctccaagtatctcccgcaggaaaaattccttaacttcatctatctgatacatctgaacaaaaatcagcttcatgatttttaaaatcttttcttcaaaaatctgctgtttaaacatttcagatccctgatgataaaattcttcaggattttcttcaagtaattttctgatattttcatcatctaacggatttcctttaaaatactcttcaaaatagtttaaaattgacattaaaatatcttttttacttgaataatgattataaattgaactttccttaattccaacttctgaagctattgttctaacggatactgaatcatatccctttttagaaaataaatccaaagccgtgtcaaatattttatcttttgtttgtgttttcatgaatatcccaaaactaacagttgttagttatactattgttttgatagtatataaaactaacagttgttagttaaataattggaaaaaatcctcaggtaaaaatacaattttatatcctcaaataattgagaaagagatgttacaaattatccagacattcctcttttaggaaaaatgcatcttcattatctggagatttaagtaaaactttattgaagctttctacagcttcttcaaattttcccagctccattaaaactactcctttatttaataaaaaatcaatattgtgtttttctaaagaaatagctgtattgaaacattccagagcttcatctaatttacccaaatcaatataagcattacccatacgatttatagaacctgcatccaattcagaatcatcaaaacatacttcaagagccctgtcaaaagatttaatagcttcttccaatttgcccatatcagacaataaatttcctcttgagttccatacttcaggattttcactatctattaaaatcagatggtcgtaaacatccaaagcttcatcaaatttacctaaaacttctaaaataaatcctctccaatataaaacaattgaactgttcggatttatggccagtgcaatatcactaactttcagagcatcatccagttttccggagttaagtaaagctatagccttattatttaatatatattcattatgaggttctatttttaaagccttatcataacaaaatattgcctgatcaaagtggcccagccttgatagattatctccctgtttatttaatagataaacatcatcaggatcaattcttaaagcagcatcataacacattgtagatttatcaaatttaccgctgtcaaaaagaatatctgctctttgtgttatcatagccttttcatcaattttatcccctttccagtcatttacatctaatttttcaaagtaaatgatttgaaatagttcagaatcctcaattttgccagcatacatttttttgaaatccttaaccatttccacagcgctttcaaatccttcttttctggcaagttcatcattatctttcaaatcagaaaaaggaattgtttgcacatccaatactttagcttcaaaaattttctttttttctttagaaaccaaattccaataacaataaagtctgtcgccttttttaagaggagttttccaaagcttacgtattgtcattgtcttttttccagtgattatatcaatatcctgacttgaaaatgataagattggcattttttttctcctcccagcaaatttatattatttcttctccaaattctgcagattttacttttacaacaccgtcaaaataaggttttacgtattctgcaagttttcttaaatcatgaggatttggaacttccacttcctccaatgcagggtctaaaacattcctattcctgaattgttgaatggtataaacttcagcttcaatatccattaccaaattataaatatcctttttagtatgtaatgtcgggacataagttgttctggcttccaggtgaaccccatatttgtttataagattcattgatttgtgaacctgagaaccgacattggatcctgtaactttcctgtatttttcaaaaggtgctttaacatccaaagaaatgaaatccaaaatattcagttttaaaatgttctcaagtttatcgggataaattccactggtatccaatttggttttgagacctaatttatgcacatattttagtatttcaataactgcatcactttgaaccagcggttcccctccagatattacaactgcatcaataaaatcagcagcatcatttatttcttttttaatttcttcaaaacttaattgggtgttgtcatctaaaagttcagcattatgacaataacggcaagcaagaggacattttgacatgaaaataactaaagacatatttccatgaaattcaacagaagaaattacagttccgcctacatacattaggataatacctcttttacaatgtctatgaattttttatcctcttctaaagtacagatacttatcctaatccaatattcatccaatcctttaaatgatgtgcagtcccttacaataacaccttttttcataagttcaaatgcaaattcagatgctgtaaatcctgtgtcttttatgccaattaacatgaaattagatttagacgggaaaacattcaatgaatcgatttttgacagttcattataaagatattccctgctttcaatacctttttcaatagatgtttcaatgtagttcttatccctcaaagtattaagagcagctacataagacaatcttgttagagaaaataccggtttaattctgtgcatatattcaataatctcactgcaagctaaaccataacccattctcattccagccaatcccattactttagacatggttctgataatgaaaatattgtcaaattcattaatcaaatccttatttgtaacttcagcatactcaaagtaggcttcatctacaacaatcagaacatcaggatttccagaggctatatccctaatatccttttcatcaattaaagtacctgtaggattatttggtgtgcataagaaaatcatttttgttttattgtttatagaatttaaaattgaatctgtatccaatttgttttcttccaaattccatttagcataaaccggacgagcaccgtattgctgcaataaatactcataatacatgtaagaaggtagaggtacaataaactcatcaccttcgtcaataaatgttttagctaaaacatcaatgatttcatcagcaccatcaccaccaataataacctgagattgtttaaccccagaataattggctaattcttgttgaagctcgtttaaaactgattctggatatctgtttatgtttttacattcttttccgatagcttcaatagctttagcagatgggccaaatggattttcattagatcctaatttaattatatcatctttatttaagttgaattcactagctatctcatcctgagatttacctggaacataggaatccatttcactaactattgcccttggtttcattttttaaccttatttatattgttttgaaagttttttgtaattatctgcattttcttgaatatgttcaatttgttcaggagtaacttcctttattagtttgccaggaactcctaaaattagactgccttcagggaattctttaccttcacttacaacagctccagcccctacaatagaatttttaccaatgtgtgctccatttaacacagttgcattcattccaattagtacattgtcttccaaagtacatccatgaacaacagcaccatgacctacagatacattatccccaattgttatcgggaaatcttcagtacaatgtaatacacagttatcctgtacattagagttgttacctattttaatagaatccacatctcctctaacaacagctccgtgccaaattgatacatcttcacctaattcaacatcaccgagtacttgtgcacctggacatattacaacagagtcttttttattttccataatatcaccatttaattaatttttttctttttcttttgaataatatgagtttgtttttccaatactcttgtatcggaaggcaaatcttcgtataacagcacacctgatccgatagtggagttatggcctacttttacacctggagaaaaacttgagttaatacccgtctttacagaatcaccgataatagctcccaatttacgtcttccgctgtctattttctgatttttaattttagttttaatggttgcattatcaaaacgcaaattagctatatttgttcctgctgctatattgcagttagaacctataacagagtcacctacataacttaaatgactaacatttgtattttccataataattgagtttttaatctcaacagcatttccaacatgaacattatcaccaaagtaagtatttccacgaatataggagttaggacctatatcacagtttttaccaatatatacatttccttcaatgtaaacaccagccttaataacacttccctcatccaaaaatacttcaccatgaataactgctccagcttccactgttcctttaatttctgttttaagcttgccaattaattcttcatttacttcaattaattcccatggcctgccaacatcaatccaatctttagaagttttatgtccgataactgttttattatcttcaatttgtaaagatactgaatcagtaatttcatattctcccctttcagagatttctgtttcacggattttatcgaaaatatccttattaaatatgtaaattccagcattgaccaaattacttggtgcctcttcacgttttggcttttctacaatgtttttaatatttccgttttcaatttcaacaacaccaaatgctgaaggatcttccacttcagttaaaagcattaaagtatcaggtgacaaataattgtacttcttaattatttcatgaataatctcatcatcaagtataatatctccatttaaaacaataatactatcatcaataaaatcttcaccatatgaaatagcattagctgttcctaaaaagtctttttgagttttataagaaatattgactccgaaatcacttccgtctccaaagtaattcctaacaatttcttctttataacgtacaataagcaaaatatcagttataccattatctcttaaagactcgatattgtactgaataattggttttccagctactggcaacattgttttaggttttgtgagggttaatggcctcattctagaaccttcaccagcacttaaaattatagctttcaatttcattaccccataagttattacttataaactattataatatgttaagtttatacttattaattaatttttttaattgaaaaaaagaagattaaaaaaaacatgcagtaatccgctgcatgaaaaagaatttaaatattttcttttatgattttaacacatgtttctttaatggcttgagcttttgtgctgtctttagactctaaagttattctaatataatcttcagttcctgaaggccttactaaaacccagctatcatcattgaaagttaatctgactccgtcaatagaattaatttccttaatatcatcaaaactgtcttttaataaatcttccatattttccataacggctgttttggcttctttagaacagattattttttcacgaatatttgggtaagacggaatctctaagagcaattcggacaatttgcctttgtttgatacaagttcagccatccttaaacctgaaagtatgccgtcaggacacatacaaaaatcaggatgcagccaggttccggaaggttcccctccaaatgcagcatctttttctattatgacttcagctacatttacatctccgactttagttcttaaaacattaccttttacagattcatccatacataaacctgcatctacagtagtgactatgtctccgtcaaattctttagacattaatgcaagtaaagagtcgaatggggaaatatcaccattttcatcaattgtaatcattctgtctgcatctccgtcgtgtgcaattccaaggtctgcaccaatggctactacagttttcatcagattttgcaggttttctgcattcggttcaggatttcttcctgggaaaaaaccgtccggctgagaattaagagttgttacctcacagcccgcttttctaaataccaaaggagatatttcacttcctgcccctgaagcacaatcaatgacaacctttaaacctggcttaatatttaccatacctaccagatcatcaatatatcttcctttaatttcctcattaactcttaagctacctactttatcccagcttactgaagtgtaagattcatttgagtagatttcttcaattttagcttcctgagctgaagtgtatgccattccgttagcattccaaattttaattccattgtactgtgaaggattatgtgatgcagtcagcattactccagcatcagcacctaatttatcagtagcataacctaccaaaggagttggaaccattcctattttaattacatctactccgctttcaagcaaacctgcacaaatagcctggtcaagcatcacattagtagttcttgtatcataacctaaaactaccgttccctcattacccaaataacaagctaatgatttaccgacatttaatgcaagttcacatgtaacttcagaatttattttcccccgaattccagaagttccgaacagttttttaacagccattgaatcaactcttttaagctccaaacttatgagcatagttcattaaatccatcatgatgttcataacgtctgctcctctaattctgcaaagccctccttttgcaacagctacttcagagtattcacaaacatcatccactcttacttcaggtcctgtaataataaccggcacaggatctcctgagtggtttaaaacagaaattggagttgaatgatcagcagtcaagaaaatataaacatcttcaagttttttaagttcactcataacaaccctgtcaactttttcaatgaagtcacgtttttcaacagcctgcccgtcatgacctgcttcatctgccccatcaatatttatcaggaaaaagtcatggtctgaatttttaacctggtcaataattgtgtctctgatattttccaaattggtgtcaattccaccagtaacatcttccatttcaataatatccataccggcaaatcttcctattcccataataagaccagtttcagcaatacatgcagaattaacttcatatttgtcatttaaagcttctacaaccggaacttcacctgcaccacgtggaattataatatttgcaggaggttcattgttttctattctttccaaattaacaggatggtctttaatcatttcataagatttaactaccaatttatttaaaatatctgcagtttttttagcttcaactgaatcatctaaaggtataacttctttaggtttgtttccttccactttaggatcagcatcacttactttatcagatagaccttcacctcttaatactaaaactgctctgtgaccagttgattccttaaaaataattttaatatcaggataatcttccaaaaccattgtatttaacacttcaacgatttcatgagttccctctctgattcttcctgcacgtctgtcagtaactataccattttcatcagctgttgagaaattacacctaaatgcaatatctccaggaataacatctactccaacaccagccgcttcaaaagggcctcttcctgtgtatacttcgtaagggtcataacctaaaatagacaaatgagcagtgtcactaccaggtataattcccggagctattgaatccataattccagttataccatttttagccatttcatccatattcggagtattggctgcttggagaggggtttgattatcaaattctttaagtggacggtcccccataccatccataactaaaactattcccttcataatgtcaccttaatataatacttttaaatatatttttcaatagttataaaattatttaaaaaaatcagattttagaaacctattaaaggtttaattaaaactttaattaaatttgcaacaaaaaacagcacaagtatcttaacccaggtacgtttatccttaaaaatctcatcaccatacctgcgtttataatatactgcaataattactgcaataagtgttgaaacagcaatatcaaaattaaactctactacagacatgatttactatctgttttaacttattaaaataattaattaaacaagtaaaataccgattaaagctccggtaatagtagctataagatttacatgttcatttgtaagcaaatcttttctttcaaagactgctccaaggatactgtccataaaacaacctaatgttccaggaataactgctaaaataatagctaaaacagaatcattaataattccaagcaaataagcacaaataccaacaatagctgcaccaatcatacctgcaacagttcccaaaacagatactgcgccgtcagttccaggttcaacctttttaaaagtagtaattaatctaggctgatgcaatactcctatttcactggctaaagtatctgctgttgcagtagctattgccccaataaatcctccgacaaatgataagtaataacctccaaatgcagccatcataactgctacaataccatttgaaataacatttttagaagttcttctaccttcaaattcccctaaagattttttataggattttgagaattttgtagccgccaaacttaaaataaggaatattaaaattaataataaccagttaaatcctgctgagaaaataatgataactcccataataatcataacaactgatccaagagcgtctaaggattttcttttgtatgttaagaatcccaataaaaacaggattagaacataaccccaattaatcattattaacttttcaaccatattatcaacacaataatatttctaaaggataatataaaaagctacctaatttaaccatataattaatataatatattaaccataatttattctatgagaacattatataaaataattatcgtactggctatcttatttgtaagttttgaaattgaaattgcaattccaggaagaggaagtttcatttatgctttaattaccttaataataattgcaggaatcattaactacaccatttcaatttacaatgacttagtaactgaaagaaacagggtaaaaaattcctggagtaaaattgatgttcagttaaaaagaagaaccgacctaattccaaatcttgtggaagttgttaaaggttatgcaaaacacgaacataacacatttactcaggtaagtcaggccagagcttcattaatgaatgcaagaaatatagaagacatacaaaaatcaaattcccagctatcccgaagtcttgttaatttatttgcaatagctgaaaagtatcctgaactaaaagccaattcaaactttttggatttgcaaagacaaataagcgacagtgaagataaaatagccatttatagagaaagcttcaataattatgttttagtctacaacaacagctgtgaacaatttccaagcaatttagttgcacagttattcggatttaaaactgcaaactttattgaaattcctgaagatgaaaaaactgtaccgaatgtggagttttaatttattatttttttacaatgaaatataacattgtgatataatgaaatgaaaaaaataagtaaaagtatttagtttaatactttacttttgataatttccactcttttaagagggtagatttttttagcattgtgataaacttcagatgctaatttaccgttaacaacaagttttattaattcatcgaaagatttttctgctgcagtttcagctaataaatcattgataacttgtctcatgtatttttgttgggaagatttagctcttctggtagttactgcaagtacatgaagtttaactttacgatcatctttagttttaacaacagaagaagcatcgattctactggttcctcttctaatcatacttcttacataatcagtagtagttttgtgaccagtaaatttggtgtttgcaacatctcctgctacattatcaatttcaaacctgagtttgatgtattgtttggaaaagtcaccagacaattccctcatagtaacttctactcccctaccgatgagataatcagggtctcttgctggagtttctccaatttctttgtcttcaaagtttactggtgttttaatagtataccaagatttttctttccatgtgtcacgtactctacgtcttgcttttgcttttgccattatatcaaccttttatagtttttccgtaaattttattatcgttaaaaatatagctatcgctatagtaaatttaaaaatagtccaccaaataccgtacctgttaaattaaacacaatacagaatataaaataagattataattgattatagttttataatccgttaatcgactactgtgagttttactcacttattttaaagaacaatacattataaagttttaaattattaaaatccgcccttaaaggttattattacttcttttcttcatgatatataaagcttgttaaatgactaaacatttattccatataatttataaccttagttattacaaactaaacaaaaagaatgattataatatcattttaaaatagtaaaaacacattaaaacaaaataaaaatatgatttcataacactagttggaaaataaggagtattaaaactccttattccatactaggcaaatatttctggtctgaagcatagctggacccgattaattttccgctagacgtattgtactgtctaaaaccaccatcagaataagttacttcacgataatagctgccgtcatctgcctgataattatattttaccacttcacttacaacataaactcctgaattcggcttagtgttgtcacttgtgtttgcagttgtattattggttagattttcagcagtgcagttagtagacacagtatcgtcttcatcatcatggatatcatcagcaaaagcaattgcaaatgctataatgcatgccccgacaataattgcacagattattataatcaaatctttagattccattaaagcaacctccaattgattttttaaaaagcccacatggggaatcgaaccccagacctattgattacgagtcaatcgttctaccttctgaactatataggcttaactattatatttgtaattaagtaatatacaaacattcctataaaataacacacaacatcccaccagtcagaaacacttccaggtcttaaaaaaatagctatgtactcacctaaaaaagatagaaatattgtaattaaagtcagatattttaaggatgtcacctgcatatttgacctgtataatgaaatgctgtttattaaagcgaaaaataatggcacagccagcagatcattgagataattattgaaaaatggaattcccaaattcttcaaaaccagctgattcaagccataaacagctaatacaacaaccaatattacaatatttgttttattttccatattatccgcaaatagaaaatattaccagtgcaataagcactcccaaaacaatagtacataagtcttccataataataatatcgtgactaccatatataaaacttgttaaaaaaataaaaagagaaaatcagctattcatgaaattgtagtgatcaatatatctttgtaaaacttcctcaacaggaccttcatcactaaccagcttaattcctgcatcctctgccttaattttggatttgaatccgtattttgtagaaattataacatcacagtcattgcattcttgaataacatcaccgccctgatgtttggcgtccttatcaatagccaattttcttgtttcaacaaaatcaaagtcattgtcaactacatcataaataactaatgatactgcttttcctaaatgcaaatcaacaatatctccattggaagatgcaagtgcaattctcattttaatcaactaattttttaattatattggcaacattctgaccaaataacttaatagtggctattccttcactgtcatctaaagctgtaccttcaggacctgcaaataccatgttccagtaagtacttccggctattatcatattgttaatcgggaaaaacattgtcatttcctgtaaggttaaagtctgtcctccacgccttgcaacagcaatcggacctccaaccatccattctaaaaatttgtcgtttcctcttgaaactttacctatcctttgaagagcagccattatgtctcctcttgcagttccaaagtaaactggtgctgcaggaataaatccgtcagcctgtctgattttttcaatgatttcatccaaaccgtcatttaaaacacaatttcctgtttttgcacatccgttacatgcaacacatgactgtatctgttttcctcttaaggatatgatttcagcttcaacaccatttttctcaatttcttcagcacaaacttccagaacatcctgagtgttactgttagctcgaggactggaatttaataatataacttttgccataacatcaacctaaataaaattttgttaaataaataataaatctttttgaaaaaagaatttaaacttcagcaccatttaaagcatggcgacaaggacaatcaaaatcgtcgtctaaattcctgatgatttcataaatcaattcaagcaaatctgattctttagccttaaccatttcaaatacttcatcaatggtcaagttatcttcagaaatgcctgatgcataatttgaaactatacaaatggaattgtaacaaattgccctttcacgagccaatgttacttcaggaactccagtcatacctaccaaatcccctccaagaagtttgaacattttgatttcagcaggtgtttcaaatctgggtccctgtgtacacacatatgttccgccagtaataacttccccacagtcagccattatatcccttagacgactgcaataaggttcagttacatctacatgaacaacatggtcttcaaagtatgtcttatccctgttttctgtaaaatctaaaaagtcatcgggaatgacaaatgatccaggaggcatttccagattcatagacccaacagaattggtagctattatctgtgtaacacctacattcctaagtgcatcaatattagctctgaaattgattttatgtggagggatactgtgtcctgcagcatgtcttggaataaaagctactgttttattgaatatatccaaaatagaaacttcaacttccccatagtctgttttgactaactttttttcaacactgtctgccttctgagttatttcataaactccgctgccgccaataattccaatcatcttatcttatccttttgtaacagctaacggttttacttttgcaacaagtttagctattcctgtactgtcagatattttaactacactgtccacatctttgtatgccccaggtgcctcttcagctattacattttcagttgtagctctgatttttactccgtttgcagccaaagtgtttttgatttcttcaggtttgtagtcttttttagcctgtgaccttgataaaactcttccggcaccatgtgcagtggatccgaatgtttcttccattgctgtttgtgttccatgcaatacataggatgctgttcccattgttccaggaatcaataccggctgaccaacttccctgtatttttcaggaatttcttcacttccaggtccgaatgcacgggtagctccttttctgtgtaccaccagtttaatgtcattgcctttgaatttgtgtgtttcctgtttagcaatgttgtgagctacatcataaacaatgtccatttccatatctttagcggattttcctaaaatgtcttcaaaggtttcccttatccaatgagtcatcatctgtctgtttgcccatgcataattagctgcagcatacatagcttttaagtagtcctgagcttcccttgaatcaaatggtgcacaggccagttgtctgtctgcaagatctatttggtgatttttataagctttatccattactcttaaataatcagaacatacctgatgtccgcagcctcttgaaccgctgtgaatcattattacaaccattcctttttcaagtccgtatacaccagccacttcatcattatatatttcatcaacaacctgaatttctaaaaagtgatttccagaacctaaagaaccaagttgaggtattccccttcttttagctttgtcactgactttagctgagtctgcttctttgattcttccgttttcttctaaaacttccaaatcttctttccacccgtagccattttctacagcccattcagctccgaaatttaaaacatcatctatttcattttctttaagcttgatttttcctttgcttcctacaccagacggaatgtttttaaacaatgcttcaattaattcatcaagcttgtcttcaatgtctgcttgtttaagattggtttttattaatctgactccacagttaatgtcaaaacctactcctccaggagagacaattccatttttttcattgaatgctgccaccccacctattggaaatccatatccgaaatgaatgtcaggcagaccgattgcatatctgtgaacacctggaagacatgcaatatttacaatctggtcaatagccccatcttccaaagcttcaaaactttcatcatcaagatacaatcttccagaagctctcatttttttattaacgcttcctggaacttcgtatacgttatctctaacttttttaatgttatctttaatactcataaaaatcacaaactattttataatatttataataggacaataaataattttttggtagaaaacagaatgaaattaataaaaaaattactccaaaaaataaaatcggcaacaaaaaacctcttttttacagtctaaaaaaaaacaagttaaatgaggccataaacctcaccggcaaattgagaaaaataaaatctcttaaagattaattgtttatttacaaaagctttattaagaaaatttttattttctaaataaagcagatattcctgcaaccaacagcagcaatgctccaagaacaccaaagaaagtagatcccagcagaaccaagattgcagaaacaataaacaggaatcctccaacatcactatctttaaatacatgaatagatgcaaaaatacctaaaaatgatccaagagtagctataagtcctaaaaaggatgttgctccaaatccaaaacttccaatcaataaaataaatgaactagaaaccaaacttacaagtgcccctaagccacctacaattagttcaaatattcttgaaactgattttcttctttgcatatttaattatttaactataattcattatatatgttttcataaatcaacaattgctgaaagttttacagcattcccctcaacaatattcattttgtgaaatgttattgccttaacttcatcgccgcggtaatgtttatcccaattaatatcttcgccttcaattgttgcatttaagtgatatccgtcatctattttatcaatcatgactttaaattctgaaaataacatgaattctatttcatgcaaaaataaaagttcctctaaaaaatcatataataatgaaactttgtcttccgaggttatttcaaatgatttggaagttattggatttatattatctgttttggaaattatattaaataatgccaatcctgcattttcaaaagcttcgtttaagttgtttccatatgcataaaatccaatatctgcagttacatcaaaaaattcaaattttttcatagtttttttcctaaaatattacttttcaaatggggtgtctctctttctttatattacactttcaaacaatattaatttagcgatgtgatagaaatgttaaaaaattcagataccacaataaaagctgatttaagaaagaaaagttctataatggatgaaatagaatatagtaactataatattcaagcttgcatggtgatacttgttataatgatggtattgcttttatcaataatctctgttgtaactgcgcaaaatcccaatttagtataattggttttttctgattatatgctaccaaacccttggcgcagaaaaagcattagatcaaaacaggttgacccatgcaaaaatctaatgttacagagatgattaatatgaaatttgattcagatatgaagttttgtcagtcatgtgcaatgcccatgactgaagaattatacggcagcaacaaagacggcagtaaaaacgaagattactgcatttactgctatgaaaatggtgaatttacagcagatatatctatggaagaaatgattgatttttgtgttccgaaaactgtcgaaaatacagatatggatgaaaaaacagctagaaaaatgttaaatgaagcatttccacaacttaaaagatggaaatgaatttcataatttgaaatcacatgggttaaaacgtaaaataatttctctggaatttcctcttgatccttttcctgtgaattttgtatcaactaatcttaaaaactccaatttttcaagggttctgttaaaggtagcataacttacattttctttttctttaaacagttcagataattctccagctgtgaaaatcttatctgaatctgaaattatttttaataatgccttttcggtgtcatttaatgattttaaagtttctgagatttgcactgaaactaaagaatcaactgctttttggaaatgttcttcagtgatttctctagaggcatcagcctcagcaatattaccgcaagagcgtaaaagattgatacctactctcaaatcacctacatcataggtatgcatagctaccaattccaatatttcatcacccattactcccgggaaaaatcctgcatttaccctgtctcttaatatatcttcaatttctgagtaagtatatggctgaaatgtaatgtcctgaggtatgaaaaccgtgtttacgtttttatcaaaggcatatctgaattcaagatcagacaatattgcaaaaattccggttttaacaccaggatattcttcatatgctcttaacaaatcataaaatactttattagctgccttactttggaacaaataattgacatcatccaatgcaacgattaatgcttttttatctgattgaagtttatgcatgatctggtcataaattcttgaaaatggaactcctgtttccggaggaatatggccaaacaactttttgtatatttgtgaaaatattccaaaacgtgttgtatgaagctgacagtttatataaacacaaacaactttttctgtagtcttttcaactaattcaaatacttttctgatagctgttgtttttccggttgcacatgaacctaaaacaacggaatttgatggttgacctccacttatagccggtctgattgccattgccatagcttccatttgcctgtccctataattataatttggaggcacataatctggatcaaaagcatttatattttgaaaaagactttcatcatgcattaaaatatcttcaattcccatacttatcatttatatttaaactattataaaaaaattattatgactttaaattaataattttaacgtcctcattatcgtcaatccactttgtaaacaattctgcatacttcaatttttttgttttgatttcatcagcctttgcagtctcttctgcaatattcggtcttgaatatttggttacaacatctccaaaatccattcctgccaatgtcaattcactggctccaagtgcaatagctaaaaacattgccctgtccccgtctgtaaatcctccaaaattatagaggtttccatgtgactgagcttgtgttgttcctaaaacattatcgaaaaatggagtgtaatttcgtactgcatccatgttatttccatgaccgtgaataactaaacttgcaccatgtgcatttgcatataaaatatcatttattttaccgtccaaatcagtagctattatgtccggaactattttttcttcaaccagagctgttgttgccccgtctgcagctattaaaacataatctatcaaatcatagttttcttttatttttttaatatgctcttttagagaaggacctgctccaaatactatgaatttagtggaaaaatctactttttcatgcaaatcctccagtgttaaacagccttgctcaaaaagaatgtcatccaatacctgggcagttttttcatcatcttttctttcaaatccgaaatcatccaatattttcctatagtaagtttcccaaagaccaaaatccattttaaaacacctttacatatgaatttagttgcaaattattaatattttttattccttattaacaactctaatgtccttacctgtaaaatatctgtacaaatcatgaaactgccttacaacaaaacctgtacatgcagccgagattattgtacctgcacttacacttcccaaaacatcacctaaaaatatccagcataaaataactgttattatcaccattgatgaatcaatgcatattttaactgatgagaatttcctatctgcagctatggctattgcctctataagaccttctccaggaagaggtgcaatatttgcaggcatcattattaaaatccctacagctataagaactatgcttaatgcaagcattaaaaatttgcccattaatgaaaggttctgaatcggtgccattacccccaatgaaaaatcgacaaagtatccgaataaaaaagcactaacaagctgaagaagtcttttcggatgatacttgtctttcaaaattggtttttgtataaaaataactaccagataaaataaaactgatgaaagccccacatcaatatttgcaattaaagctattgcataaggaattgaattgattggagtaactcccaattcagatttgattgaaacccctactgcaaaagacagtatgcatacaccgattatataatatattattcttttaattaactcttttgtaattttaattctttcatacccctaattttctttattaactactgtaattgactttccggttattttttcatacaattctgtaagatatcttataataattccaatgaatattgctgcaagaattgtacctatattcacacttccaaaaatatccgatgtaaagagtccgcaaatgattaaagataacacaaccattgatgtatcaaaacatactttgactttggaaaatcgtttattatatgccaaagatatggcctccacaactccttcacccggaagaggagcaatgtttgcaggcatataatattaaaataccgacagctattaaaaacatacttacaatcagcagtgtaaagttaacatccaaaggcaggcccggcatcggagataaaatccacagtgaaagatctgtaaaatacccgaacataactgtattgattaattgcaaaagcctttttgctttaaatctcttttttaaaattggtatttgcaaaaatacaagaattgcattaaaaataattgttgtaattccaatatttacacctgaagccagtgtcaaagagtagggaattgagctgattggtgtaactcccaaaccagactttattgaaaggcccactccaagtgacattacaaataatcctccaacaaacaagataattcgtttaatccacattaaaatacctcacatctgtttaaaatctattgtttttccggtcaaatagctgttaagtttatggatatatttcaaaacagttccaacaaaaacagctgaaagaattgttccaatacctatgctgcccccaattactcctaaaaatacaaagcaaagcactacagaaataacaagcaggctaacatcataaacaaccttggtttttgagaaaggcatattaaatgcaatggccaatgcctgagttaccccgtcaacagatacaggaataatgtttgtaggcacatagaaaaataatcccaaagccacactgaatatgcttagaaatgtcagcagcagctcagagaggatactggtcggatccggaataaatcccatcagcccaactgaaaaagttgtgaaatatccgaagagcacccccacaaagacctgcaggaagtgtttaatcttaaagtcctttcccaacagtatcagttctatcaaaactaaaactgcatgaaatataattgtagctttacctatttcaattccccaaatcaaatttaaagtatatggaattgaactgaccggcgttgctcccaaattagattttattgaaaaacctatccccaaagttatgaaccataatcccaaaagatagttaaatacccttttaaaagtcaatttgtcatttccaaaaaaatccatgttatattatatgtactacacaatatttaaaaactataaaaataagacatttatatagctttatcataagctaaatcataaaatttatttttacatacggaggaaattttaaatggatgaaattttattaatgcttccaggtccaacaacagtacacccaagagtacttaacgctatgtctcaagctgttgtaaatcatagaggagctaaatatggggaaatcttaactgaaaccagtgaattaatgtctgatgttttccaaacctctaaccaatcctatttattaactggatctggaactgcagcaatggaagcagctataagtaatgtagtaaattccggagaaaaaatcttaaatgtcgtaggaggaaaattcggagaacgtttcatgaaaatagctaatgctcatggaattaccaccgaagaattagcagtagaatggggaactgcagtaactcctgaagctattaaagctgctcttgatgctgatgaggatattaaagcagtatctgttgttcataatgaaacctcaactggtgtagcagcacctattgaagcaatcggtaaagtaatgaaagactacgatgcactctacattgtagatacagtatcttcccttggaggagactatgttgatgtagacaaattcggaatcgatgtatgtattacaggatcccaaaaatgtattgcagcaccacctggaatggctgccattacattaagtgacgatgcatgggctgctgcagacaaagtagactcccacactttctacttagatatgcaggctgctaaaaaaagtggagacaaaaatccgccacaaactccatacactccttctgtatctctaacttatgctatgaacgaagcattaaaaatggttatggaagaaggattagaaaacagagttgcacgtcaccacaaagctgctaaagctagcgtagctgcttcaaaagcattaggtttagaattattcgcagatgaaaaagtatcctcagctactgtaactgcagttaaaatgcctgaaggcgtaactgatgcagaattcagaggaactacccgtgacaaatacggagtggaattagctggtggacaagaccacttaaaaggaaacatattcagaataggacatatgggaaatatttcctacaaagaattggtacaaacctttgcagctatcggaatgaccttaaaaggcctcggtgcaattgaagatgctggtgccggagtagcatccattacagaatcatacttatgattctgcttttttttcttttttaaatagcttttatcaattataaaataaaaaccttatttttataaaatcattacttgaaaaagctatatatgaaaatagattatttacaaaccaaatcatcatccaaataatttaatagtttgataaatttctttttgcatttacttaattcaggacccataaataactattttaaaaaaaatgattaattaaaaataaaaattaagtaattcatcattaataaaaaacaattagaaacacttaatataaacatgttataaactgtataatatctatttaatgaatagattaataacatgtgaaaaaaattactttgaaaggaggtcaaaaatgtcaaaattttgtttaaaatgtggtgctgaaaataaagatgaagcacagttctgcgaaaaatgcggatatgaatggaatactcaaacaaaagcacaaaaccataaaaatggaataatagataaattattctacaaaattgataaaaaaactatgcaacgaagagtttcaaagggaaaaactatactcatgataatgattatactgtttatattactaatcatcatagggtcaatgagtcctagcactcctcaaacaaatccaaaaataacagatttaagtatacaaagtgaaggttatggtgcttattcagtcagtggaacattaaccccagataaggattatgattatttagaaatggtagttgtgttttatgacgatagtggagcagtaattgataaaagccccttagtttggaatatgaatgatatacaaaaagaccaaatagttaaaataaatggtaatgcttatgtaaatggtgactcaacaccatcaaaagcagaagtatatattcttgatagtgcattcggaggaaacgatttatcagatgcaatatataaccaaacaataacaatataaggtgaaaaaatgaaattttgtgtttcttgtggaactgaaaatgatgacaatgctacattctgtataaaatgcggatacaattttgatggaaaatctgaaacttcaactaaagaaataactgcaaatgaaacatcaagaaccttagaactagttttaggaattattggtgcaatttttggtttgcttggtggcgtgtttgcaataatgttatcatcatttggaggaaccgaaatatttgctttaggaatatctgcacttttagcatccatagtagggattgtaggatcagtatatgtgaaaaataatgcaaaaactggtggaataatattaattatttcagcaatatggttattaataagtatttcagcatatggaatactcggattcatattattaggtattgccggactaattgcattaataagaaaataaatgaagacaattgtcttcatatttatttttaaataatcttattttattaattagatagttaaaatatatttaaaaaatttaaagtaaaaatatttgcaacattactcttaaatacaacttaatttaacttataattccaattttttaaatttaatttactaaacaaacaattaaattaaaaattttaaaaaacactaaaacaaaatacaataattaatttttttatatcttcaaaactgcattatttctttttttgattttgtgaaattttatcgaatatactcgataaattttaaaaaatagtaaaaatttcttccatactcgataaaaaccaagcattaaataatatcattttttaaaaattcaattatattcatgtgttttattccagtgtttgaaaaatccaaattatccatacttaaaacatatttttcataatcatctccgattgcccttagggaaccgaattcccttttaactgtttctttacctgacaacaaataagtaacctgaatataaatctttctatctgctttattacagacaaaatccacttccttaccatttatatctccaacttttacttcataaccccttctaagcaattcaatataaacaatattttccagtatctggcctgtattttccatatccttaccaataatagcctggttaaatccatgatcaaccaaataatactttccattggtttttaatacttttttaccttttaaattttcttttttagcttcatgaatgaagcacgcattttgagaaaaagacagataatttaaaaccgtatctgcagatacttttaagttttcatgctttaaatatttggatattccgttagctgaaaccgactgcccgatatttgagattatgaatgttaaaatcctgtttaaaatttcagcatttcttaaattatgtctggaaataatgtcttttaaaagtatggtgctgtaaatatcttccaaatatgaaaatttatcaatgtcctgcacctgctgtaaagaaggcattcccccgtattttacatattcattaaacaactgcaattctttatttttgatatctatactgtttatttcttttttatattgtaaaaactctttaaatgaaaatggataaacatctatatggaaatatcttcctgcaattaatgtggccaattctccagagagcagttcagaattagaaccagttatataaatatcacaatcaaaatctaccctatatgaattgatgcttttttcccagcccataatattctggatttcatcaaacagcagatatagtttacctgaagtgttttttattaaattattgacgcacacatccaattccatgaagttttggattttattgtatttttgagattcaaatgatattaaaaatatgttttctttggaaataccctgttcaataagttcttcttttatactgtgcaacagataggtcttaccacttcttctaactcctgtaatgattttaattggttctgtattaattaaccttctgattttttccagatataactccctttttatcatttgaaaacacctgttttaagttatatttttaaaatatataaattttatcgactatactcgataaattttaaaaaatagcaaaaatttcttttatactcgataaaaatcaagatttcaaaattacattaaaatcattattttattgatttaagaatgtaaaattgtttttagaaaaaactgaccaatttataaactataaaaaccaatgagatattggatatccaataaaagcaacagggggttttaatcatcaactatcacatactggacataacattaaaagaaatagcgaatacctcaataaatgaactgttagaatttatgaacatcgattatgaaattgtagaatcagccaaaacagaattcagcgaattaaaaaataaaagatatcatctggactacgtaggtaaaacaaaagacaaaatttatatccatatagaatttcaagcaagatttccaacaaaaaaggaattgcaaagaatcttcgcttatgtcgcattactacatgaatacaccggctgttttgttgaaacctacatcatttgtgttcaagcaataccacacgaccagattatccatcagtacagtaaagacaatgtttttaaaattaacatcatgtccttaaaaaacattgacggaaataaaaaaataaatagtataagtaaaaaaatagaaaacaacgaaaaactaacaccaacagaaatacttgctttgaaattaatgccgtttacaagctataaggaaccaacagaagaaataacattgaaaactgctcaattaaccaataaaataacaacattaaccatagacgaacttaacaacatcaagtacattcaacaggcagtatgttccaaagtaataaaaaaagaacaccaacaaccaataatggaggaaataaaaatgagaaacacactatacgaccaagccagaaaagaaggaataaaagaaggaaaaacagaaggaataaaagaaggaataaacgagggaagaaaagaaggaagaaatgagggaaaaaatgaaatgaaaaatgaaataacaaacgaaataacaacactaattcaaaaaggaaaactaccccaagacacattaaaccaaatacattccttaaaaatgtaaaaaaacaccagcaatcaataatagaggaaataaaaatgagaaacacactatacgaccaagccagaaaagaaggaataaaagaaggaataaaagaaggaataaaagaaggaaaaacagaaggaataaatataggagaaaataagaaaaaaacagaaataaaaaacgaaataacaacactaattcaaaaaggaaaactaccccaagacacattaaaccaaatacattccttaaaaatgtaaaaataattcataaaataggcttgataataactaaattattaagcctgaaattttttttaaataaacaaaatatttaatatttgataattaatattataattaactaaaaaaaatggatgtgtcaaaatatggctgaaaatattaaaacaagtgtagaagaattacgtaaacttatcagtattgaaaatgttgtcggaaaacctattgatgcaggagaccaatttttaattccagtaatgagaatgggagtaggttttggagcctgtgaaaacatactgggcaatgacggaaacgatactgtaggtgcaggtgcaggtgttgaacctgtttccatggtaatcattccaaaaaatgccaaaagcggagaaggagttaaagttgttaacttaactaaaggaaccgaaaccaacaaagcattgtctgatttaggactgattgtttctgaccttgttaaaaattacttctcaaaatcttcagatgactacgatgaatctgaatatattgaacctgagtttacaactaccgaagacgaacaataaacttaaaaaagggatattttgaacaccatatacatcctaggaatgattttacttataatcatcctaattcttattatttttttatatatgggtcttagaatatcacttagctttgaaaaaaccggaagcaaactttcagctattattaaaataaatatttttaaaaaaataactgtttataattcttcaaaagaaaaagaaacctcaaaagacgaagataatgaaaaagagtctaaaaatttaatgaaacctcttaaaaatgctctgccttacatttcagattttttaaaaaaaaccgtcaaatccctcaaggtatcaaaattagaaaatcatctgaaatttggactggccagttatgcagacactgcacagtatataggatatatctgggctgttaacggatttattaaaacattatatcctgtttctaaagtaagtgcagaacctgtttttggagatcctgtaattgattttaaaggatgcttggatgttgacattaatcttttaaagctgattttgcctgttgtcaatttaatttccaaaaaagaaatcaggattttaattaaaaccttcagaggtgataaaaatgaaaaatgatttttcaggatttgcaaaacaccaaaaggaaaagcttgacaaatacttcaaaaaggatgaagaattaacctttaaaaaaatagctgttggtgatgatgacttttattttatctataaatcaaaagcagttatcttaaaagataaaatagccagttatgaactgataccagtcggatttatccataaccaggatgaggaatactattactattcatttgacggcaactgcctgggatatgaagatattgtaaaaaaatttgttgaagagtgccttatttaggaaggggaatatcttcaaaccttacagcaacatctacaatatcataatcatccacatcctggagatcttcaagtttttctgccctttttgcttttaatccgtatgcttcagctacttttacaaagtcaggattttttaaatctatctgatagggttccatatcatatttattaacttcatgctgccttataatgccgtattgtgagttgtttattataaaaattaaaatattcaagccatattcttttattgtagccagttcctgaatattcatctggaaatctccgtctccgttgattacaattatttttttatcaggatttgcaactgcagctccgatagctcccggaattccgtaacccattggtccaagtgctgactgaaacagcagctggccaaagtcagaggattttttaagcagagttacccatgtaatatgacttccggcatcaccgattataatattgtccttatactgatttagaatttcattaatagccacctgaggtcttaacggaagtgttttatcccccaaaccttcaacagctattttgttgtcaatttccaacagttcatctagccagtctgcttttttaaagtctacttcatataagaagttttcaacacttccctgaatcggataatttcctttaagatgctttttattaatatttacatgaatcagcttatcttcaatttcatccaaagcaacaaatgtcctttcagaagctcttgcacctaaagctatgatacagtctgaattttttatggcataatttgctctgggagttcctctggtacctgccattcccagatttaaaggattgctttcagctatgattccttttgaattaaaagtagttgctaccggaattccattactttcagctatcagttttaaaacttttctttgtgatattgctccagaacccaatacaaagagcggttttttagatttgtttattaattcctgggcttttttaacatttgacaggtcattttcacacaaataacataaatcaaagtcctgaaactcctcgcttaacaggacatcatttgacaagtttatatgaaccgggccttttgggtcgtgcctaattttataaatagctgcccttagtgcatataccgcttcagttccgtttaagggattgaatgtttcgtcaacaatatttctaaaaatttcagatgtcggaagtgactggaaaacatcctcatttctcaaatcagtgggattgtctcctgtcaaaaccagaagaggcacattgtccttatatgctcctgccagagccattgtaaaattaagtgctcccggtgctgcagtagctacacatgcacttaatttatgggatgatttgtaatatgcatctgccgcatgcatagctgcctgttcgtgtcttaccagaatatgatttattttggagtctttaagagccttataaaacggcagaatctgttctcccggaagtccgaaaatattttccagaccttcctcttcaaggattttaactaaataagcagctacattcattattattcctcttcctgataagatccgctgtattgcccggagccttcaacttcaaaaacaactccctgagctattctgtccccttttttgattttgtattcataatctccgtgattataaatcataaacattaaagttccgaaaaaaccagggtctccaacagctgtctgaactgagacaaaagacctcagtaatgtggatcttggcagatataacattgaatagcccttcggaattttgattttcctgtcaattgaagcaagataagcagtatgaggttttaaagtgtaaacaggcccttccaattctttaatttcaggaaggtttttttcattgtcaatcaaagacccctcactttcctgaatataaattttatctaaagccaaatcaattcctgaaggctgaaccaaatctttaaaatccggaaacagtttaacaagttcattttcaccaagcataataatcacttaatagatagtttattatatctgattaataaattttaaaaacagggaggaaaaaattatgcctgtaataacaatagccggaaatgacacaatcagtgttgaagataaaagagaaatggtaaaaaaagtaagtgaaatagtagctgacagttacggattgccaatagaggcaataacagtacttgttcaagcttatccgaaagaaagcataggagtagctggtgaattattaagtgatagggaataaatttccttatcatttaatcataatattcataccatccgctgccatcttctgtataatgaacttcccgttcaccactgggaacttcatccatactatgcatctgcttatgaggtctttcatccaaataccattcagtatccgcatccatagggtcgctactataatcaatttcatagtagctttaatctatagtcccaacattgtttgttatgttaactactggaggattcttattttcttgcatattaattgataaaaacatataagcaattgacaatgaaagtacaagcaccataaccacaattaatatattaattttcttattaattcacctatatcttgttctcaaaatagtcatacagctcatctttaactggaatatggagattatatttaatattgacaatcggcaggtctccgtctttgcttttgatagttgtctggataaaatcaaatggttcgacctgacccatatagtagaaatccttaccttcatcatcacttttcttaatgaagagatgtatctttaaattagttttctgataatttttaatagcaactacttctttactatctaatttaagcctacttctagtcatccagctgaaaacatccctatttacaaactcatctagatactttgtactatctgaaatgtcttcttttttatcataagttacaaaaatagggcaggtattgtgttttaccctatatccatataatgtggaactgtcatcatttggccagtttaacagtctacaaacatcccttcttgaatacttggcatataatgttaaattttcaccttcaacttgagcattatattctgttttatatttaagcaatccataattaattacatccaaaatatgttttctgtaagtttcatgagataaatattttttaaaatcatttgaaatttgaaattcattcataaaagataattcaggaaaatcttttttatcttttttactgaaatcaagatttaaaacatcgattgcactttcaattgattttacatcattttgaatatcatattctgtttttaataattgttcaattgattcaactgagaaataaccattataaattaaagattttaaaatcagcaactcatgaggtctttttccactggctaagtttttggatatgaattttaaagatgaaatttcctcttctgagagatattcgtcataatctttatctgccttttttaaaaatgaataatagcaatccattgcagtatgatttaagattaataaaggatccatttctccattttcatagaaatccaaaagcattggaattctgcctaacttaaacttcagattattgtatttttctttaaaaagagctattcttgaaaatgaagtgttgtttatagaattataaatcctctttttagaaacttcatcaaaactgattgaagaagctccaggaattactttattaccctccatcagataacggcgaatattatccttatcataggatctgtcacctgaaagagctatcggaatcatgaaattgtttttataatttccgataaaatccagtataacaacatagtctttgtttttaaatttcctaaggcctcttcccaattgctgaataaatataattggagactgtgttggccttacaagtaaaacctgattaatttcaggaatatctaccccttcattaaaaatatcaactgtaaaaatgtattccaacttgtttttagcctcatcattagtcagtctgtaaattgcatcctcccttgtctgctgtgaatcatcacctgttaagacaattgccggatggcctcttttattgaaagcttttgaaagttcatttgcttcctttttcctgctgcaaaataccaaagctttaattctctcaccagaatatccgtaataggctgatttttcaagtaaataatttaccctgtcatctgaaaccaactgattgaattctgttgaatcatcaacagtttctccatcaatttccaaatcagatattccaaaataatgaaaaggacataacaaatcctcttctaaagcatctttaagtctgatttcacatgccagattatggtcaaagagttcataaatatcaataccgtcaggcctctcaggtgaagcagtcattcccaaacagaattcaggttcaaaataatccatgattttttgataggaataagcacctgctttatggacctcatcaatcacaatataatcaaattcatcttttttaaacttggtataaacatcatctttagacaatgtctgaattgttgagaataaaaagttggaatcatagtctttagaattaccagtcagcaatccgaaatcttttgtatttttaaaaacatttttataagcattaatagcctgtttggcgatttgttctctgtgaactacaaaaagaaattttttaggattgaaatcctgaacagcaaaagcagaagcataagttttaccagtacccgttgcggataccagaagtgcctttgattcgccactttgaattaaagaccttaaactttccataaaaccaacctgcatagaatttgggaccaaatcctcagagctgagttttttgtagttttcttttagctttgtaaagttcttttgagaatcatataacttttcataagccggaagaacatcttccagattgtttgcttcatcccacaagttgttaaattcagataataaattattcaacacttcaccgtcatgtaaagaggtaaattcaacattccactccttgttaacagttaaagcgtttaaagtcaaattagaactgcctacaatacctttgtagatattgccttttctaaaaacataacctttagtatgaaaaccgttcttttcctgagcatacagcttaacttcaatgttatctaaagactgaagcttttttaaagctttaggatctgtaaaattaagataatcagttgtaagaatcttacctttaatacctctttgttcaagttccagaaaatcctgtaaaagaggagtcaaaccacctaaagtaataaaagcagagcttatgaaaaattcatcgcaattctgcagttcatccttaatggaatttaaaaccttatgattaaagttgtttgaaaggaatttaggtttgaaatcatttgcaggattataagtttcattgataaaagcagttttagctccctctaaaatatcattctgattatccataaaaatcacatgttttcttttagataattaactgcatcaatatctgccggaagccaatttaaagtgtttaattcttcttttgtaatccatttaccatcattatgctctaaaagttcgattgaaccttccttaattgaacacataaaacaggacatgaataaataaaagttaggatactgatactcaatatctatggcaaatttatcaacactaatttcaatgtttaattcttctttaatttcacgaactagggcctgctctttggtttcacctgattcgatttttcctcccggaaactcccacatgtttataaactcgccatatcctcttttagtagctaaaattttgttttctttttgaataatagctgccactacttttatttctttcatgttttttacacctgaattaaatgtccaattcccctaattttttaataattctatcatcttcatttaattttaataatataagtcttaatttttcaatgaattcatctcccccctccatatattcagtttctaaaatatccaaacccccatttgcatattcctcagcaaatttataaatttcaggagtatcttcagacaatatttcaataccatcactagatttagttattgctaatgcatttattaaagcaggcaaatctttaccaaaattttctttatttataaatagttgtctagattcaataggtaacctactaccctgagaataaccataagctaatgctaatgcaaatatatcttttgaatgaaatttattctcctttaaaggaccattactctctaacaatttgttatatattttagaagtgtctttttcacgagacaatctatttgaaactgttttatctttattaaccatgtttaacaatctccgttttattttcataaggttttaattcatattcatcagcaatattttgcaacatatttgccctaacatcatcagtgtattgactatccgtgaataagaatattatctgtttatcagaagtatactcatgtaatcctgaaataaattcaatacgtttacttttatctaatttttccaaaggagcatcaataattaaaggaatttcaaaaccactaagactatgtaatgccatcataaaagacaaagccaataaattctcctcaccatcggataaatccccaggagtaattttctgaccagtactttttgttattacaattttataatcatctttaattgtaacatccctatatttatcatatgcccaattgatactcgtaaattgttttctagttttatcattgactttctcacgaatatgtttctgaacattattatttaaatctgaaagaatagtaattgcttcttcacaaaatttaattttattattcaaaatctttaattcaccctctaattctccagcctcactccttttacgtttaagtttttctatatctttttttaaggtattgatatctgcacttaaagatttattccttttacgcaaatcttcaatgatttttttatttttttgagattgacgttcatattctctaacatcttcaatatcaaactcagccaattcatcggaaatttgattaatttgaatattaatctcattaatattctcttcattttgttttatagacctccttaaagattctatttttggaagatctttcagtttagttaaaactttcttaagatcataataatcttcgtaaaatacttcctgttttattttactagtattatttaatctttttttaagttcagttacacactcaggatggtcttctagtttaacaccacaaatacaaaatccatcttccaaaatatcattcaataaatctctttcaatttgaggaggtgcagtttttttcttccgtgcatcatcagcaatattaattgaatcaactaattcatcaaacaacaccgcaattgggaataattctaaaatcaatttttcataatttttacgatcttctttaatattttgtttaagttttttttccattgattctttattttttcttttttgggttaactcgttaacataacctgaatcaacttgtttcaatttttcaacacatttattaacatttcgaatagcaatatcaattttattatgattatctttaatttcagattctttatgttgttgttcctgcattttttcattgattagtttattataatttacactacctttaggctttttcttgttaaatctcttattaattgaatcagatgttttaaccaaatgatcataaactttatcaattaaacccacttgagaaatttgctctatagatgtttttaaactcaattcagattcatttttaaaataattggacaaagtagctccattaaaaaagaaatattggaacatttctttagggattttattattaattgcattttgtgcaacaccatcctccaaaatatctttatctgtttcatcaacaatcaaatggtccgcaaatgcatccccccattttccattaccccatttttgaaaagataacgatctataaattgaaaaatatttctttttttcatcttcaaatgaataaaatctaattttaacttcaactttaacttcatttatactattttcatttgattctaattctttagctgctctaagattatacaatggttctgatttgtttcttacatcatgaagctcctccccatacaaacaccaagttaatgcattaaccaatgaagttttaccactcccattatctgccaaaattatagttaaattttccaaatcattaaacccaaaatcaattttctgtgttccataaaatggcctaaaattagttatttcaatagaatctaagtacattattaatcattcccccataacattttcaatcatgttttcataacttgctttataatgcatcttttcaggatttcttaattcatataatattgcagaaatgaaaaaattttttaaattttcatcaaaatcagcttccctaatataatcaattatttctaaatttattttagtcatgtgatttcctcccatttttttaagaatttttggctacattctgaagaattatctgccaagtcagcatattcatcataacgtttctgttcgtttttaaaaattgttttaacagaattcgattcacctttaagttttggaaaaattattaaatcgtaaatattagcttttgatttgcccggactttttcttaatactcttccccttctttgaatatgttgtctagaatttaatgtacttgccattaaaaatgctgtttgagtagatggaacatccactccttcatccaaacatttaatagcaactaaagactggtagtaacccttagaaaacaattctaaaatgcggtctctttcagatttaccattaatttttttagtgctttcttcaccagtaaatttatgattggaaatatcaaattcatccaaaatattctgaactttaggcaattgtttgccagtacaataaataattaagtccttaatatcttcttgatccttcaaaaaagtatgtaaatgagcaaatttatcttcagcattattaattacatctcttctcttaataagtaatgtatttaaccgtttttcatccaacaatgtttttttctttttttgtaaaataatgctaattttataagtataatctttatataactccatttcttcattatttaaatcaacaaaaataggatggtaattgtaacgagttaaaaaccctttttgaatagcattttccaaatcataatcatatattatgccattaaaataatcatagaccaaatcagttctttcaaaatcatcttcaatttcaggagttgcacttaaacctaatctatgattatatttattcaacaaactcttcctatactcaaaggaacctatgccatgaacttcatctacaattactaaactatccccctcaaaaaaatcaattttttttctaaacttttcactagcaaatgttttaaatgtggtaaaaactacaacctgattatttgaattaaaagaagactccaaatccccaattaaacccaataattcagaagaccatttattattatctccagatgcaataagaatacttccattaaaaccaaattctttcaaattactttcccattgacttattaaatgtttttgaggacatacaatgatagttaaaagattattttttttatttcgtaaataatcccaacaggataatgcagtgaatgtttttcccgtacctgtagccatgctaaagataccgcgataattattatttatccaattttcaacagcttcttcttgataatcacgcaattttggtttagagtctaattttaaattaaaaagttcatctttagaattgggagctatttcaattaacttcttttttgttgcatcaggaacatcaaacagctccaaagatgggtcgttaccctcccaaaaattttcaaaatcttttttatcattttccataaattccggatttttccaacttttaaatacttttaatgattcaatattatttttccatccgaaagcagtttcatttacagacccatcaaataatattgaatcatccaattcatcatacattatcccaattttagaatgtatcattccagattcataaaaaccatcctttttacgattaaccccaattttaatttccaaataattattagccaccatccatcccaatactttaacatgattctttactatttcatcttcaatagaatcataatcttttaaaaaattaatatcaataatatttttcaaatcatcagaattgttaatagattccaaatcagcaacattcaatttagcgccgcaaataaggcgcatatgcccattattttttataaatttatcaatacctcttgcagcaatcgccaaactagtggaattaaaaaatccagatatacggtcatattttattgcctcagataataccaaattataaaaattatttacaatatcatcatgtgcagaattataacttggactcacctccgaatcaatatctttaaataccatataaataccacataaataaattagaaagaaaacaatattccttactcgaatcaatttttcaaattgaaacaatttaatattattttattaactattacaatatatagtttactaaataaattttaagcacataaaaataaattttacaaataatatgaacaaaatactaattaaaacaaaaataaattaatttttaaaatatttaataaaaattttttataaagataaacaaacaaaaaagtaattctataaacacaagtttaacacatgtttgaatttgaatacaaactcccacaacattcaaacaatattaactaaaaataacttacaatatgaaaaacatccaatattttcccaattttaataaaaaaatatttaataaaaaatattgatccaaaaaatgtttgtctttaaaatacctcaaaattaacatcattgtttaaaaaaaattttaaataggattaacaccaaaacattattaaaaataattatttggtgaaatttttatggcttttgaagattggataacaaaggatgttaaaaatgttttattagtcgaacctaactttcctatccctaataaaagtagaaaccatgctaattttttaccaataggcttattgaagatagcagcatatcttagaaacaaatcaataaacataaaattagtaagacatgacaaagaaaatttaaaacaaacaacactatttccaaaaaagaatcaagaatttaaacctgatttaatatgtgtaacttctatttttacttattggtcaaaatatgttaaaaatacagtatcttactataaatcattatataaaaatatcccagtaatagttggtggaatatatgcctcattaatgccagaacattgtaaaaattatacaaaatgtgatgatgttattttaggacccatatatgaagcagaaaaattataccccgcatatgatcttgttgatgtggattaccaaatagttcacacaagtagaggttgtgtaagacaatgtaaattctgtggaacatacatcatagaacctgaatggaaatgtaaaaaaagcataaaaaaagaaataaaaaagaaaaaaataattttttacgataataatcttctagctaacccctatattaaaaacatattaaatgaattaattgaactaaaacaaaaccatgaaattagttatgtagaatcccaatctggatttgatggtagaatattacgaaaacatccggaaatagctaaaatgttaaaaaaagcaggatttaaaaatccaaaaattgcatgggattataatctaaaacaagctccaaaaataaaagaacaaatagatttattaatatccggaggatttaaagcaaaagaaatctccatatttatgatatataattatgatttagattacaatgaaatggaaaaaaaaagagtgcaatgtgctaaatggggagttcaaataactgattgtcgttacagaccgttagatcaaacatttgacgaatacagtccctataaaacaaaaggacaaactaataaagattactacatccatccaaattggacagataaagaaattcgtaaatttagaagaaatataaggcgtcataatatatgtatgcgtcacgaggtagattaccattcctcaattcttgaacgaaaaaaaatacctcaagaattagctcaaaaatatagagaaatggattataacgaagttaaacaatatttgcccgacgcttggacccctgttaaatcacatgaccttaatgaaaaagattattttaaaataagtgatactttaacacatattaaaaaacctgaaaaaactcaaaaaaatcaaacattactaaatcacgattattgtcctccaaaacaaaatattattcaaataaattatttaaccacttacaataaaacaaactcccaaatagtagaaaataaaaataaaaaagataacattgatgaatgcataaaatatattattaatacaaaacaaaaaaatgaaattgaaattccatacagaataaatgctaaataaaaataattttaaaaaaaaagataggaaaatgcttaattttagttacataagctgtataaataattatgttattaaattataataaccaacaaacaactacaaaaataaaattaaagcgagaaaaatcctttctcacttaaacaataactttttcaaacagcccttcgtcttcagcagtaatcatgacaatcttatcattgtcaacatatgtgaaaaagtacagttcactttccttatcaaattcaaaccagcccttatgaccttttatggttttttcaacctcggaaggttccttaagactgttaaaatctacactacccccgtcataaaaaacagttacacttaacatgttgtaattactgtcaaaataggtatgatcaaatgttttaaaaccgttttcatccacttcaccatttttagccatggacatgtcttctgtatatccatcaggaatggcgaactttattccgtcaacttcaatattttgcacagcagctaccgaagcgattccaatagctaaaacagcaaatactcccaaagcaatcaaaatttttctagaaaccatgaaaaacatccaataaatattaatttataaaaggaaattaatataattacctatattctcctaaacaaaataagctgattttaaaaatattctaaacaaattaaaaacacaagctataaaagcaactaaatatgaaattaaaagtatggacatttttgacgaatatattgtcggaaacctcagctccatcaactggtgttttgaaaatacccattttattcagaggcttgatgacaacggaatctcaagagactatattgtagacacagtattgaatgaagagcctttaagatatgaacctagcggaaatcaccagtatgaagttatttttccggctccgaaaactaagaaatactctgaaatcaaggttgtttttgcctgtgacaacaacacgataaatttggtaacggtaatgcccaatgccactacaaacagacaaaagaacacctacaaatcacagaattataaaagtctggaaaaaaagaaacagaaagcctattccaaaagaaagaaactttattaaaagtgtgttttaaggagtataaaacccctttaaaacacgtgagaaggttttaaacgaatcaaaaaaataaatttttttgttgatatattagaatatgatttaaaaaaaaccatattacaccttactatttgtcattaacagttatttataatcttcgaattttgtcagcataacacttgctattaaaatgctgagtgtaataacaacatcaacagccagttccagaaatccccctgttttaatcaggtcaataattccgaatgtccaaactatgaaaattacacatgggagtatatatttaatgattgcaacccatagttttccaacatgcattacagaatccttgtttacaacttcaattaaatcatcaattcctaaaatccatccaaatataatacactgcaatgcgattaaaaacaatattccgaactggttcaaaaatccgtcaactatttccacaagatagctggagattccgcatgtgaaaaacattgaaatcacaaatccgacaccacataatatactggctgattttttacgggtaaatccaaacttatcacatacagaattaagtaacggctctaaaaatcccagagcagaagttattcctgcaaataatatagccaggaaaaacagaggtcccaatatcttacctgctatacccattgtattgaatattgtcggaaatacaataaatacaagacctgtaccctgtctgattaggctttcaatcggaacgcctgatgttactgacatgaaacccaatatggaaaagactccaaatgcagtgaatatctcaaaacctgagtttgaactaactacaatcagcacattattgattaattttgaatcttcaggtaaataacttgcatatgtaagtgcaatagccattcccaaacttaatgaaaatataatctgtgaaaatgcagcaagccatatgtttacatcaaaaagcactgaccagtcaggagtcagcagtgtttcaattcccaaattatggccaggcaatgtcagggaaaatattacaatagctgccattataacaaacaataatggaatcagcactttggatactttgcctattcctgagttcagctctttttttgaaataaaccatatcatcacccatacaataaccagtcccgccactgtcggaagtatcagatgtgaccagtcagaaattgtagagtctccaccaacatagtttaagaaaaatcctgcaggatcagccccccatgccagaaacggacttgctccaagataaactatatcccatgcaagaataaccatataatatgttacaacaccaaatgccagaagacctaaaatccatcctattacttcaaacctcggtcttatcttgtggagcagatttgaaaatgatgttttgaatttgaaccccaaaccatattccaaaataagaaagggaattcccagaagcccaatagctacaaaataaggaataaaaaaggatcctccaccattggagtacagcacatagctgaaacgccatatattacctaatccaacagcagccccaatcattgacattaaaaacgcaagagaagaattccactcgcttttattatcatgattcattggtatcacctgttaaattaaaatacaatttaccggtaccctccggtgttatttccaaatcatcacattgaggatacaatgaattaagtaaactggttccctcatcaggtcccataaagtaaggcaggtatcctgaaataatcacaggataaactgtacactctccagtatcattgacaaagtctattttgactatatatgcaatgtgagttgctgaatttgacatgtcaaatatgaagtttcccagactgtagaatataggtttgccgttatacatttcaattccctgtgttacatgaggatgtgaacctaaaacagcatctgccccataatctattacttcatgagccatcttttcctgatcaggatttggtgaatgggagtattcatttccaaagtggaaataaacaattacaacatctgaaccatttgcctttgcatcctgaatttgacattttgcaacatcactgtcatatgcggaataacctggattagaaccattagcctgaggcattacatcagtactatattctttaaagttgtttgaatccatataattgattatagtaatatttcttccgtttatatcgctgcttgcagtttggcgagcctgagattcattatttcctgcgccgatatgagtgatgcctgcatcatccaaagactttaaggtatctttcataccgtcagtgccgtaatcaaataaatggttgttagccagtgctgcaacggtattgttgttggctttagctaatggaacataggaaggatcgcatttaagcggaacatcaccttttacagcacacccagaagttgttgcagcattttcaaagttaatcaacagcaaatccgcacttcccgttacattttccacatgtctgaaaggactttcatccaaacttaatactccagccatattacgtgcaaacatcacatcacccgttacaacaacagaagcatttcccttaggtgtttctattattgaattgttgctggtgaatgtggctgcaccagctatcaaaaccaacactgccaaaataataattaaaattaatgttatttttttaagcttcattaatgtttacctcttctccgctttcagaaaagagctgattcagcatccagtcagcatcatattccttaatgtcatcatatccctgacccattcccaaaaagagaataggttttttgataacataaccaatagataatgatgctcctcctttactgtcagcatctgctttagttaaaataacaccgtcaaggtcaatagcttcattaaatttggaagcctgctgggttgcatcattacctgttagggcatcccctacaaagacaaccaaatcaggttttgcaactctcttaatctttttcatttcatccataagattggtgttggtctgcatcctacctgcagtatcaattaaaaccagctctttaccttgagcttttgcatgttcaactgcatcaaatgcaacagctgcaggatctgaacccttctggtgtttgataagcttaactccaaccttgtctgcatggtaattaacctgttcaatagcacctgctctgaaagtatctgcagcagctattacaggagtataaccttttttaagataataattagctaatttaccgatggttgttgttttacctgttccgttaataccgacaaacattacaacaagaggttcgccctgtgcttttttggcttcaatcatttcagtcattgacttgcccggaatatcaataatttcagctacagcatttcttagtgcattgtaggtatattcagtaatgtcattgcttcttttgattttacggccaaccagatcatctttaacagaatccactactgcactagctacttccatagccacgtccccttccaaaagacccatttcaagttcccataaaatatcttcaaggtgtttttctgaaatggttttggcagtaataaatgaaaacattccgcttgattcttcatcttcatcattttcttcagaagaatcattatctttatttctgctccagaaacgggattttttctcttctgttttttcatcggcatcttctgattcttcagtgtcttcctctttatttctgctccagaaatgagattttttaggttcttcttcctcttgaatctcttcagctgattcttcttcctcctgaggctcttccttattatcactggattttttaccaaaactccagaaaccagatttttcatctttatcatcagaggtttcatcatctgaagtgtcagtttcttgaatactttcaacttcctgaggaatttccgctacatcacttttagaatcctcttcttcttttttatctttcctgccaaatgaaaaaaaggagaattttttaccggattcctcttcaagattgttttcttcctgtgcttcttcaataagctcttcttctaatttatcactagttcgtgaaaacttctttttcaaagattcaaacaaattttacacaaccttatggtttaattagaaaataatatgttttttataatatttaaaaaataagcaaaatatggaaaaataaattaaataaaaaaagtaaaaaaaggaagttatatctagtttaatccggtagctgacatgtttccttgagcaacagcagctaactgttctgcctgagcagataaagatccgataatgtcagacacctgttgcatattagctaacattttatctaaactgtcttcaagatcttttttctgtcttgcaatagtttctcttgctccgtcaacatcttttttaacagctattccagaaccaatacttacaataacttcatcggtgtttttaagttcacctttaatgaaagaaccagcacctacaggtacgaaagcttcaacagaatctttaccttccaaatcatccaaagtgttggttaatgcatcaacttcagcaatggaagctctgactaattcaatttgttgctgaattaagtctccttgctgtttgtatacatttatttcattaagtaattgattaaatttttgctgaccttccatagtaacacccttataaaatttcttttaaaattgggtctacaacatcttcaggtgcgatttcagcaatatctttaatagaaatttggtttctgtttaaaccatgtttacttccaaaacgttcataaattttttcttctaaatcagctacattggtagctttgtattctttagtaaatttatgatatgaatcgcccattacaaaagtacctttaactctgtaaatttttgttatcatattaactcctcaggatattatttataaatcgtctaaaaagcctaatgcttcttcaactctagccatttcaggacctgtactttctttagctacaatagctccacttgaatttgcaagagagcatgccccaactaaagaaatacctctgcctacagtaccaatatctccttcaacaccaaatacatcacgagcaaagtctacttcagtttcagtagcatttttatccattaaaaatcctttgttggtaactgtaatcagtgaaccgataatatcgcttccgaccatggaagttgattcaacatttacatctaaagtatcttcaatgactttaactgcctcatcagataaaaacggacttacaatagcaccagtatcattagctgcaacaatattacctactgcagtataatttccgggaattgtagctacatttaaacctaattcttcaaactgtttaacttctctatctaatacatgtggggaaacaacaataccgtttgaattagctacagctaaagatccaataaggttacatccggaaatagaagattttacagcatcaacttctagtgtttcttcaatcagcttaaccttttcgtcaagaagattgtaaggaacaacagccaaatcatcagttgctaaaataaatactcctatattaggattatctacaatgtttattcttcttaacatattgttacctcacgtagtattgaagtagtattatatagctattctgctaaagtagcttctactacgccatcatcatctttaactgcttttacagtaattttagaaggtattttttggatacctcttgcccaaatttcatgattaatagattcatcgagctttacttcttcagctttcatgtgtttgaataagaagttttgtacttctctgatagctctaggagctctaatagtccttttgactttttttgcgtttctaagtggaattgtataaactctttccatgaaaaatcccccttataatttaagactgtttcttctccaatgtctaggtttaggtctgtatctaagtttacggttagtcttagcataagcccagattggaattcttctgttttgtttatttgcttttgccattctcaattttttagctaatggtttatttctactcattttctcaccttataataataattattttttatacccagtaacacgagtttgataatgctcagggaaaatatccaatgaatttcctcctttttcatcaattaaagtccttatttcaacctcataatcagagctgttatccttattgcttttttcatgagatatttcaaataaattagatgtgattaatttaattgtcttgtgaccaaaactatccaaattaatatactgaacatcttttctatcttcaagacttttaatttgatttatattaagtttaggagttctatcatcccttctagttccatcggctataatatcatacatttcagaaatctcttcaacaacactttcatgaaggaattttattccgtcattgggaaatccgtcttccataatcatgtcacaggttttgtctaaaagttcaaaatccaaatcaagaaccctatgattaaacccaagagatttggctgaaaggcttgctggaatataagaatcgtaaacaccgaaattggcagtgcacaattcaacatcaagaccaagtcttttaagcataacacccataaaagaactgtcttttcctccactgtataatacacaagctttcattaatattatttccttgtaattttaatttctcttttctgaccagctatttgtctcaagagtacttttaactgttcatcagttactttacctcttaaactgccggcctgagcagattgaattaactgaatttcaatttgattaacaagctctggcttagtcaatttaaggttagctaatctggaacgtgcttcagtagtcaaaatttgagctattaaagctttcttttgctcctcaaattgtctttgtgcttcttgctgttgcatttgttgttgtgcttgttgttgcatttgaccttgtgcagcagcttgtctggcttctaattccgccattcttttgcggcgaatttcatcaagatcactcatatcaaactctccgaataatttaattaatattttgcaagattaggaatatccttaatgatttcagcagaaattttatctaagaatgatcttcctgctggagtaacaactcttccacctacaactttttcaacatatcctgcatcttctaattggtgtagcgcgtttcttacgatagctccactaccttttctgaatacttcaggagttactccacggtcttttttaccaccgtagaaagttcttaagctcataactcctacaggtccgtccatgtacactcttctgatgatagatgcacatctggtataccaccagtcgacatcttcaggttttctttctttgtgaacaccggtttttacaaaattggaccatgcaggggaattgattttatcattgtttttaaattcttctgcgacttttttaattaataaatctgcaggtacatcaaatacagtagtcatattaattctccaatatttaattttaaataattgtcctcataatcaactgtaaatttaagacctaataaaaatagggcctgtaactctaaatttaagcaatgttttctaaggcttttttttataaatgacagcgacatttcctctaacatctataagtttagatctggttttctggacaatgtcagctatataatcatctttatttttagcgatattttttgcaaatttaagtttaacaatttcattagctttaagttggcgtttgatttcttcaatgacattgtcattaacaccagccttaccaatattcattgtcatagcggaaagagctctattcatcatttctttttttgattgactcatatctagctctccttttattttttttctccttatgataaggaattttcataacatgcccacactcgccacataaaatgttaacttcttcgttaaccagccggactgtagcgttgtgaccagggtagagaaacttattacaccttttacaataccttcttgcccatttatcgggaattttggtattgtacttggtagataatttcttagctaatacaacataacggttacttctttccgggtgcctttcgaattccatctcagcacgctcaaaaagaatattcatacgttcaatagctatttcaatcatccattttggtctttttcctctactcaaagatatcctcctcataattataataataactattaaattaggatataatattcaaaaattgaattaaaatgatttgcgcatattaaaacaaaaaccatagttaaaataaccttaggttaatatgaatattaggaataaatttgtttttctatatttataaaggttgtgttaaaaacaagtgttatatatacacatattagaaattcattataaaaaaagatttccacatcatctaaaattaaatagtaaaacattaaaatattaatatataggtgaaaactatggcatttttagataaagtaatcggacatggtgatgtaagtgaagagatggacaaagactatgtatcagaattcttttttgatgatgaagaagtaattcagtcataccaattcataagagaccaaataattttaaccaactatggaatctacgaagtagacgttcagggattaagcggtaaaaaagtagaagtcaaatttttcccaaaagacacaatcaaaaccatttcttttgaaactgcaggaaccttagactttgatgtagatattaaaatcggagtgacaaacaatactgttgttaatgtggacggagcagcttacagtgaaccattatcatttaaagtaccttcaagtcaagctgcagaagcaaaagaagttgtacgtttagtaaaagaacattatttattttaaataatgttttaactttttttatcacaaataatacaatattttaaatgaaaaaaaaaacaatataaaaattaaacagccattaccgctctttttaaatgttttttactgcgttccaaattaaccaaatcatagctcgaacacattatataaactgttgctccagttacaattaaacctgagagccagtacagtcggactaatttataaatgccccggacagctcaaaacaaactaaataaaaagaaatattatttcaattataaaaataaactgaaccgcaaaagtttcatcatccaatcagccagtccataaaatcaatcacaccaaatggaaagtcttttttatcaaaaataacatctaccaccaggttaattgtctcatcaatagacaaatcacttacatctatttcacagacatcttcaccatatgcctcgtatgcttcagctccacatacgtcaagtgcctctgcttcaaggttttcacgaattttagaatcagaatatttgcgcccagccagcctttcttccaaaatacttggatgaactcttaaaattattactttatcagcaccattacacaaatgagacaaatgcccttccacaataagtaatttatctgaatcaaaattatcaataatttctcccaaaactacatctaattcaggtatgtcaattattttataaccctttttattatcgattcccaaaactaaatcattactaatagccaattcattaactctaactaaattagcacccaatcttttagaaagttcactagctaatgtagtttttccaacacatggagttccacttataaaaataacttgattcatattacccacaattatttcttaagaataatccttaaaacatcctcatcttccaaaacatgatcaggacctaccttctgacccgggaatttaactgatgttccccatattttagcatgacggaagtttttcacaaattccttgtgcaatttgtcacaggcatcaatgactgttgaaccctttttaataactaaaggatcgttcatatctgcttttcttccttgcggtttaagataaacacgaacaaggtttaaattttcaaagattgtttccttaagattatctatatttaattttttatctgcagaaattggtataaattcaggaagctgttttttcatctcttcaagataagcttcatctacaagatccactttatttaatagaatcaacattggaacatatgatttatttctatcaagaacatcaataaactgatccattgttacatcatctctaaaaagtacgtctgcatttgcataccatactcatttatgatagacctgattgttttttcatccaaatgtgtaagcggaactgttgaagacacatgaacaccaccagttcttctcctgtttacagttacatcaggaggcctttcatttggtctgataccaatatttcttaattcttttaaaataacatccaaatgctgcggatttaaaacatccaaaacaaccacaatcagttctgctgttctggctacagataaaatttcccttcctctacctttaccagtacttgctccggtaataatcccaggaatgtcaaaaacttgtattttagcgtttttatactccataacccctggaacaatgtccaaagtagtaaactgataagctcccaccttactttcagcattagtaagttcatttaagagggtagatttaccaacagaaggaaatccaacaagaacaacagtagcatcaccagatttctttacatgaaatccctgaccttttgttccggaactacttctttgaatagactcctctttcaatttagaaagtttagctttaagtttaccaatatggtgagaagtagccttgttatatggtgtcttttgaatttcatcctcaatatcttttattttctcctctattcccattaaatcaccatattattaattaaaaaaagagattaggattaaaatatcctaatcaaaattaagccctgtccggactagtagtaccaatatttccatcagtagcaccagatgcagcaggtgtactagttccgccagcagccgtgttgttataatttacttgccataatgaaactccattttccatatgaaccatggagaatacattctgacccataccacctaaaaggtacaatctggtaaacattgaatcagccaatttattatgcattataataggtgtgtaaacattattttcacccatcaggaataatgtataattggaatcgctaggagctccagctattgattcatttttcactaattgattaccttcaattaccatgatacgggatacattcaatggattaaattctgatccgtttattttaagtaaagaaccgttatttgaatatactgcttcagtatgaccagtagtagtgttgtttccagtacctctagtaataactgcatcatattccaaaccggattcattaattaaagctaatctgccagtagatccaggttcaacagttacttgctgggaaggcacgtaataattgaagtttgtggaattctgcttatcaaagtcccacgcaccaaagtaactccaccagccagctttttgcaacatatctgaacttgctacaaagataaccggtcttggattatcaggatgagtaagcggaataatagtattagcctgctcagtagttaaaccatatgtattaattaatgcatttttagcatcctgtgcgtttttcggcaggatatcaattaaaatatcagttgctttacccggactgccagtataatctgttaatgtattagtagcattttcaccggaagttcccaacattctaaatattcctgcagacaaatccatattatccgtcgtcatcgcctgacctagccagaatgccctactgttaccactttgactacctccatcaaagattacctgtctgtcagcagcaatctcaaagaggtaaccgaagtcccaccaggatgcaacaacagtattatcagcagtattttcattaatccataccattgaatcccacatagcatcactagtaccaggcactacctgattagcagtctgataagcaccacaaacagtaggtgttatcaatgcaagagcaatagcaataatagcaacatacttcttaacaggtactttagtagatgcagacttactggatttcagtccgtatatggttattccaccagctatagcaattaacaggaataatataataccgaatataggtactgtaactgctgctaatgggtatgatgcaaagaatcctgttaccaatataactgccattaacattttgtcattatcaagtttagttttgacatagtcagaagcatatcctacaaatatacctgccattaaaccgaatggcaatacaatagtggtaatgaaccttgaacctctacttactgcaagtgctgtaattactacccatactataaatagagtagcaaacattaagttcaaacgtttagcttcagttacttcattatctttggcaaatttacttacgctacctaaagatattttaaatttacggtcatcatcaatttttttagaagatgccaatctttgggatttaggcggttttttagttgtgtttccgtcttgtttaacatttctataatcatatatcctttttgcaaagataaataataccgttaaaccagcgaagaatacgaaaattccaccaataccgtttattacaccattggaattagcaagcaagaatgaatccatacctgctccaagcatacttggcatttgcaattccgcaacagaaataagtacattagggaatccacctacaacagttgaagttgattgcaaggacaataaaccagttaaactgccaaatattccaagtacaccgtctactcctttaaatgctgcaagaccgataaatccaataacacctaaaataacaatggacattaaatccttctggtgtacgaaccaagcagccttacttgggtataactctctttcactatcaccaatgttaaatacataacataatattaagtacacaactgaaaagatacccataagacctacataaaagatgtatcctgtccatgattgggagaaaagaccaatagatacaatagacaatattgcaaagacaacttttgcaataagatttttagacctcaagctctccataaagaacattatgaagaataatgagaagatatagtagaacatatctgtatcaaaaaatccagggaatgtgtgtgcaaaatagtttggtgcaagcacaattatcaatgtagctgttattgcacccaaatcattagtcagacgtctagcaaagataaatgcaggaacaactgcaagagatgctacaatagcaccggtccagaatgcaacttcctgaacagtgtaatcaccgaagaactggtttgctatattgtagaaaaatgacgttacccatacaatagctaactcataattaatcttatctccatctggggaattcctatgcatatcccagtttgaaccatcgactagttcatctcctacataaccgtgatcaacgaaattttcagtcaaccttaagttataatatgaatccatttcactaaaataaggaagacctgaagcatcttcatattctgccttcaaatcaccggtaggcaaaatattaaggtccgctgcaggagctcttaatgcaaaaacaacagctaacagaatcaaaataatgattgctgatttacttattgttaatattgtttttttattcatcaaaatcctcgatattattcaattaacataaaaatagttacatcaactgaatttattatttaaaaaacttatttgaaatttataagaatgttaaagaaataaaaatatttttgggcaaaaccatcaatacttttattaatttatatctattatttttaacattattaaagattatgcatttaaaaaaaaattagaaaaaataaagtctattggactttatcttttaactcatctaaagaacaggtaaagcgacattttggaaatcctctgcaaccaacaaattctccataccttccggaccttttaatcagttctttaccacaactaggacacacaccaactactttcatctcacgaggcttagtattctctttaccacagttagggtcaagacatgcatgctgacgtggcttaccaaaggaaataataggtaatccacatgttttacaggttttctttaagaaatttgctcctttaggaacagagtaagttgctttacagtcaggataattagaacatcccacaaaagtgcttttatttttaggagagtattttttaaccagatttccgccgcatttacattttccaacaatattgctttcctgataggcatcataaatctgtgaaccgattttaactttgtttttatcaatatctcccaaaataaccttaacttccttttcaccttcagctacaacactttcacgggtggctttatcattgtctatgccttcaagtttattttcaaagtcacgggtcagctcttcacttgttaagttagaacagtactcgcttaaagtgtcgattatgttctcaccaagctgattaacctcaattttgtttccagttatatattttctgtcatataacttatcaataatatctgcacgggtagctttggttccaagttctcttttttcaagttccttaattaaagaagcctgattatatcttgcaggaggtttggtttctttttcttctgatacaatctccttgacgatgatggaatctccttccttaacatcaggaaattcctcattatctattttcttaaatggatagtgttccagccatcctttatgggtaacccttctgcgtctaaacttgaatttttcaccgccaatgtccaaagtggtactcattgtttcaaaggtagctgcttcgaaaaatactgaaataaacctgtaaacaatcagttcataaatttttaactcatccttgtccaatttatcaggtaaaatacctgtcggatgaatagcagggtgagcagcatcttcctttttaccttcattaggttttaatttagccggaagagctgaaatatgtgttctgaattcggaatttttggacagctgtaaaaatatgcttttgaaatccaggctttcaggcaacttttgggatgaagtacgtggataagatgtatatcctgcagtataaaggctttgagcaatagtctgagtttttttaggtgaaaaaccaaagacattataagcttcagactgcaaaccacctaaattaaatggaacaggaggttttgtagtggaattggaatatttgattttatcgacagctgcatcactattttcacagtttgaaaaaatctcttcagcccttgttttatcgaatatttttccatctacatgatccgcttcaatttcaccgtcaagtaaagctttaattaaccagtaaggtttaggtacaaattttttaatctctttttcacggtcaaccaaaatagacaaagtcggagtttgaactcttcctgcagataactttaaaaatctttttttggctgcgcttacagatttcattaaagcctttgatatgtttacaccaaaataaaagtccagaatatgtctggctacaccgctgtctacctgatgtctgtcaataggtattctattttcatatgcttccacaatatcctttttagttaaagtggaaaacttcattcttgaagatttttttaaagcatcatcgccacacccatattttaatgcatgatatccgattaaagttccttcaatatcataatcgcatgcatgaatgtagctgtcagcatctttagcatattttttaatagcccttacataatccttggtatagttcttatattttttgtcaatctcaaataatggtgcccaatgcaaatcaaaatagactttatccttgggattatccggagttaaagaatataagtgtccgacagcagacaatactgttatatccttaccgtctctttccaatgtccaatatttaacttttttattaaatacgttctttttagctttagaagacaatgctttagctattttttctgcagattttggtttttcgcaaattattacttcattcattgtacctgtaccgtttttaaatttttaaattataaaaatttgtaaattactgatttaatatttaaaataattaatcctataaaaatatttctattgaaagattttagtttatatgaagtatttttaaaaataagataaaatcaatgcaaaaatatgaaaattaaaaataattataaatcttctttgtaaaaactgtaaaattcagcacagtaatcgcaaataggatatttgtcatagcgatagtaggcaagttcggacttattcatgtcaaatttcttgccgcataaaaaacaggtttcaattttttcttcatcagacatgatattaccttaaaaaaagaaataaataaaaattaaagtaatttcagtaaattacttaattaatattgtatttttgtaaaagtaagagctcttcagtagataattttccaccgtgtttgaatttatcgaagatttcttcagctctttctttttcttcacgatttttgttaccgtttgatgaggaagatttgttactagcagatcttctttttctaggtctgttggaacctaattttttattgataacatgaatatcgcttaaaatggatttgaactcttcatgttttgcagaagcatttttacgagcttcgatgaattttttgtgagcttcatcagctgcagttctgatatcatcagtttttctgaagaatttgagcatttcttcgtgagctgcttgagctttttcagaaaagtcaataactttttcgtgttcttcttcagataattttttaagctcttgtgcttcacctttaacggattcatcttcatgaatttccattaactgttttcttaaatcgtttgcatttttaacaagttgattttcttttttaatatctaaaacacgagtttcaatgattttatcaatctttttaatctcattttctattttaattttgtcacgtttaccagaagaccattctaagtttctaattttgttgttagcttcgttacgtgcttttttagcttcttcaacttttttgttgatttcgttacgttcatttctgaattcaatagctttgtttaagttttcttttaatgatgcgtttaattcatcacgaattttacgttgttctttagctatcctgttgaattcttctctttcttcagtaactttagctatttcagcttctttttcatctttttgttttcttacaccttccatggtgtcagctaaaacaaaatcagattcaggaagaccgtcttttttaggtttttcagcttcttcagtagattcttcagcatcttctgcttcttctacttgttcagtttcgtcattttcaacaacatcagtggataattgattaataatttcatctaagactttggttaagtctttttcatctactacaacatcagctttttctttaacagaatcttttgcattgaaagcaattccaatacctgctgattcgatcatggaaatgtcgttagctccatctccaactgcaacaacttcttctaaagaagtgtcattaccttcaatatgttcttttaatacgtccaatttagaaccagatactaaaggtccagttacttcaccagtcaatttaccgtcttcaacagtgaaactattagtgtatgcattttcaataccgagtttgtctttaacggtttgtgcaacaacatcaaaactgccactaataatagctacatctaatccttcttcttttaaacgtgcgatggtatcttcagcaccattcattaatggaagttcatcagcaactttttgaatatcttcaatggaagttccttcaagaagtttaactctatctttaatagaagtttcaaagtcgatttcaccttgcatagctttttcagtaatttcagctatttcatcttcaacatttgctaatttccctatctcatcaattgcttctccatcaataataacgttatctaagtcaaatactacaagtttaatcaatcataccaccaattatattaaatctagctcacttaatctatcgtaagctctttcgacacctaatttagcgtcgctacgtgttttagctccagtacaaacaactttaccggaaccgaataataataaaacaactttagggtcagataacctgtatactaaacccggaaattgttcaggttcgtattcagtatcttcaagttctaaagctactgcttctaaatttaatgtggattctaagtttgcagaagccacaatgttttgaattttaatttcgaattcatgaggaatttcagtatcaatagtcctcattaaatcaacagtctttttaatagctaactttgagtcatctatagacttagccccagtacaaacaagcttaccagagctgaaaattaatgctgctgttttaggatctttaagtttaaaaactaatcctggaaactgttcacgattaaaattaaccccttctaaagcttcggaaacttcagttaaaactatatcttttcctatgcttgcagaagccacaatgttttctatttttatatcaacatcggtcaatttaaaacctccaattaattattaaaatgagtacagtaaagatttaaaatcattaaatttttactaattaaatattttatttaaatagtatataaacttatgtttatttataaagtaaaaacaaaaatatgtaataaacatattttttaattaacttcaaaaaatattaataattatattaaggtctgatagaaatgatagaagttgaagtaaaagccaaaattgataattttgaagatatgagaaaaaaattaaatgatctgggagctattaaaactaaagaagaatttcaggaagatatttattttaacagcccaatagtagattttgccaaaacagatgaagcccttagaataagaacaacaaaacagggcgatgaaaaacacattttcataacatataaaggggctaaaattgattctgaaagtaaaacacgtgaagaaatagagttcggaattgaagatagcaaaaaatgtgcaaaaacattcgaacatataggatttaaaaaagtcagaactgtgcgtaaaaaccgtgaatattatgcttataaaaattttgaaataagtttggatgatattgaaggtttagacccatatatggaaattgaaataggtcttgaagacggaaacgattacaaagaatctcagaacagcatttttgaagtgtttaaacaacttgggattacagatggttttgagagaacctcatatctggaacttttagaaactttataatataacataatacaatattattaaattaataaaataatttaagagaagtgattatttgcaatattatatcagtcattataataaagaaccggaattaaattttcctgatgaaattacagtttatgatacaactttaagagacggtgaacaaaccccaggagtttgttttagtcctgaagaaaagttagaaattgctaaaaaattagatgaagttaaaattaaacaaattgaagcaggttttcctatagtttccaaaaaagaacaggaatcagtgaaagccataacttcagaaggccttaatgctcaaatcatttctttatctagaacaaaaaaagaagacattgatgctgctcttgattgtgatgttgacggtgttattacatttatgggaacttcagacatccatttagaacacaaaatgcacatcggacgtcaggaagcactgaatacatgtatgaacgctattgaatatgctaaagatcacggattatttgttgcattttctgcagaagacgcaaccagaactgatttggatttcttaaaaagaatatacaacaaggctgaaagctatggagcagacagagtacacatagcagacactaccggtgctataactccgcagggaattacttacctggtaaaagaacttaaaaaagatgtaaatatagatattgctctacattgtcacaatgatttcggtctggcagttataaattccatatccggagtactggcaggagctaatggaatttccacaacagtaaacggtatcggagaacgtgcaggaaacgcatctcttgaagaagtaattatgtctcttaaattattatacggtaaagatttaggatttaaaaccaaacatattaaagaactttccgaacttgtatcaaaagctagcggattgcctgttccctataacaaacctgtagtaggaaacaacgtattcagacacgaatccggaattcatgttgatgcagttattgaagagccgttatgttatgaaccatatattccagaactggtaggacaaaaaagacagcttgtattaggtaaacattcaggctgcagagcagtcagagccaaattaaatgaatgtgaccttgatgtaagcgacgatacccttattgaaattgttaaaaaagttaaaaaaagcagagaagaaggaacatacattaacgatgatgtattcaaagaaattgtaaaaagttgtaactataaaaaagaataggtgacggttttgaatattacagaaaaaatattatcagctaaagcaaaaaaagaggttacacccggagaaattattgaaattccggttgatttagctatgtctcatgacggaacatcaccaccagctataaaaacctttgaaaaagtagctaccaaagtctgggacaatgaaaaaattgcaattgtatttgaccataatgttcctgcaaatacaatcggatctgcagaattccagaaagtatgcagagacttcataaaaaaacagaaaattactaaaaattacatacatggtgacggaatatgccaccaggtacttcctgaaaaaggactggtagaacctggaaaagttattgtaggtgctgactcacacacatgtacttatggtgcatatggagcattttcaacaggaatgggtgctactgatttagctatggtttatgctacaggtaaaacatggtttatggttcctgaagctattaaaatggaagtcagcggagagttaaattcatacactgctccaaaagacatcattttaaaaatcatcggtgaagtgggaatagctggagctacctacaaaactgcagaattctgcggagaaaccatcgaaaaaatgggagtagaaggcagagctacaatatgtaacatggctattgaaatgggagctaaaaacggaataatggaaccgaataaagaagttatccaatatgtttcccaaagaaccggaaaaaaagaaagtgaattgaatattgttaaatccgatgaagatgcacagtattcagaagaaatgcactttgacataactgatatggaacctcaaatagcctgccctaatgatgtagacaatgttaaagacatctccaaagttgaaggcacagctgttgaccaatgcttaatcggttcttgtacaaacggcagattatctgatttgaaagatgcttatgaaatcttaaaagataatgaaattaataatgatactagattactaattcttccagcatcagctgaaatttacaaacaggcaatccatgaaggatacattgatgcatttatagatgcgggagctattatatgcaatccaggatgcggaccatgtcttggaggacatatgggagttttatctgaaggtgaaacctgcctatccacaacaaacaggaatttcaaaggaagaatgggggatccgaaatcctcagtatatctggctaattcaaaggttgttgctgcttcagctattgaaggagttattacaaatcctaaagatttatagtgaaaaaatgactattgaaaaaaacgaagcaaacaaacgtctgattgaaaaaataaatcaggtagaagaaggatatacaaaagacttttcaaatactcaaaaaattctgctgacaacagacggatcaattacagctattttagatgtgctgtacggtaaaattacattaagtaccttagaacagcactttgatacagcagaccgtgaaatcagcgaattaatccatgttgatgaaggtgcacaaatcaattaccgggaagttataatgcataaagacgatgaaaatctaatttatgcactgtcatacattccattggaacgtttaaccgatgagatttgttgcgatttggttagagcagacataccaatcggaagaattttaaaaaattaccagattgaatcaagaagggaagtaaataaaatctatattgaaaaacctaatgaaaggttaaaagatttatttaacacgaaagaagatatgcttgccagagaatatgtaattatccataaaaacaatgtattgatgtggattaaagaagtattcccagtcagtaaatttacaaatatttaaacaggtgataaaatgggtgttaaactaaaagacataatccagccggaacagattgattttaaagatttgaaaggaagagcaatctctatagatgcatttaataccctttaccagttcctgtctacaatcagacaaagagacggaagacccttaagtgacagcaatggaaatataacctctcatttaagcggaattttatatagaaactcctcaatgattgaaaaagacataaaaccgatttatgtatttgacggaacaccatcctatcttaaacaggaaaccattgaccaaagaagacagacaagagaagaatctgaaaaaaaatggaaagaagcactggctaaacaggatactcaggaagccagaaaatatgcaatgagatcttccaaattatctccatacattatagaatcctccaaaaagctgctgacaatgatgggaataccatacattgaagcatatggtgaaggagaagcacaagcagcttaccttgttgaaaatggagatgcatgggcagtagcttcacaggattatgactgtctcttattcggagccaaaagggttgtaagaaaccttgccatcaattccaacttgggagatctggaatattacaatttaaaaagagttttagatgaactggacataaatagagaacagcttattgatatgggaatactaatcggaactgattttagtgaaggcttaaaaggagtaggtgcaaaaacagctcttaaactagctaaaaaaggagaacttgaaaataaattagccaaacttcaggaagaatcatcacatgacatctctgaagtcagagaaatattcctaaaccataatgtaaataccaattataaaatcagatggaaaaaaccggctaaaaatgatattattgactttttatgtgaagaacacggtttttcacaggacagagtttcaaaagcctgtgataaattaaaaaatttaaattcaagtcagaaaagccttgaagactggttctaataagggggaaactccggaccaaatacttttttggcataatcaacagccagtgcaacctgattataataatttttcagcatttccttttcaaaatactccctgtccggtgctctgacaattaaattaagaagcttttcataggtttcaacagctgattttttattgaaattatatttttcttctttttctgcagacagcttttcaacacaaggaaattccaatgttttgcaaacagtgtcagttgaaaaatatgtcatgcgaattaatggagaaacagaacttaccagcacatgatttcccaaatttattaatggaggaattcctgttttagtgtaacgttccatagaagttaatctgtcaaaatgcgccagatcgtaacagtgaagttcagtataaaaatcaggttcaaaatactcaatcagatccaaaatcttcaaaccgatttctgatttataatattcctttttaattgtagaaatatatggagttttatcaaaattgtaaaaataaaactgtccttttgaaaaatcatcaatattcaaacgtttaataaattttaaagaagttttaccttcattgccatggactccacctataaataacttagttggaccttcaccattgtcaacatatctgaaataagacatattatccaaataaaaaaaagaaaaaatcaaagaagaaaacttaagttccttctttccagctgcacatatactctttttggcggtcagataaagtatcaatttcaatatccatagcttttagttttaaattagctacttcataatcaatgtcatcaggagctttagttacaccgacttccaaatcgttgtttaaaatgtattttgcagataatgcctgaacagcaaaactcatgtccatgatttctgcagggtgtccttgtcccctggctgcagataagtttactaatcttccgtctgcaagcagatatatttttctgccgtctttcatggtaaacatttcaatactttctcttacttcacgaacactggttgattgagcttccaagtcacgtctattaatttccacattaaaatgaccggagttacataacatacagccgtctttcatgtatttgaagtcatcaccatgaataatattgatattaccagttacagtaatgattaaatcagcttcttttacagcatctctaattttcattactctgtaaccatccattcttgcttcaagtgctctgattggatcgatttcagttacaataacattagctccaagaccttgtgcccttaaagctattccacgaccgcaccatccatatccacatacaacaacagatttaccagctattaacatattggtggttcccataattgcatcaaaactggattggcctgtaccatatctgttatcaaacaaatatttggtataagcatcatttacagctacaacagggaattttaaagccccatctttatgcatagcttccaatctgtgaacaccagtagtagtttcttcacatgctcctttaatatgttttaaaacatcagttctttcattgtgaagaaccataatcatatctgcaccgtcatcaatgattacatcaggtttgtgatcaagaaccatgttgatagtctgataatattcttcatcatcctgatctctccaaccgtagatgttcaaacctaaatcagcagctccggccactgcatcatcatgagtggataacggattacatccagtcatagctacttcagctccacctgcctgcaaagttaaacctaaattaatagttttaggttctaaatgtaggcaagacccaatagtgattcctttgaaaggttgagtttcttcatattcttttttgatgtgttcaagaactggcatgtgtctttgaacccattcaatttttcttataccttctttagcaagagacatatctttaactttactcataatatcccctataaaaattaaataatattataatatatcatttgagggttattaaatattattattcataaataattttaaaaatatataatgcaacaaaatatttcaaattaactacatccattattaattaattattataaaaataaacaatgtttaattacaatcagccaaacttaaattataatcaaaaataagaaaaacaaaaagtataaatgtaatgagaatttaatataataaatgtctgatgccggggtggctcagctggttagagcgcacggctcatagggtaattaagcagtgctctgactaattcctgggataccgtgaggccgcgggttcgaatcccgctcccggcatcttcaatccccggaatattttttataaactatttttttaggaaatttttaattttacaagctgattttatcgctgatttcaaaaaggagaatctgagttactttaaacatcactaatcaaaactattttataactcattaataaatatatcaagtgttaagatttgaggatttattaaaatgcaatatacagaacttggaaaaaccaaagaaaatgtttcaattcttggtttcggagctatgcgattaccgacaaaaggttccaatgacaatatcgatgaaaatacagctagtgaaattcttagctatggaattgataatggaattaaccttattgatacagcttatccttatcacagtgccggaatcgacggtaacggaaacagcgaagttttcataggaaactttttaaaagaaaacagctacagagatgatgttttaatctctacaaaatctccatcatggttaatggaggaaaagggagattttgaatattatcttgacaaacagcttgaaaaactcaaaacagacagtattgatatttatttactccatgctcttacaaaggatgattggaataaagtccgcaaacttagagttttggattttcttgatgacagtttaagcagcggcaaaataaaacatgtagggttttcatcacatactgaaattgatacatttgtagacattcttgacgcatatcccaaatgggaagttgtcctgacacaaatgaattaccttgatgaatactaccagacaggagtaatgggtcttgatgaactaaaacggctgaatatcggaagcatgattatggaaccactgcgcggaggcagattagttcagaacattcctccagaagtccaaaaactttgggactgtgctgaagttaaaagaactcctgtcgagtgggctttagaatatttatggaatagagacgatgttgactgtgttttaagtggtatgaactccttagaacaggttaaacaaaatattcaaatagcttcaaatgttaaagaaattagcgaaagcgaccaggatctaattagagaagttgccagaacatacaagacgctgaccggaaatgagtgcaccagttgcggatattgtatgccatgtccagaaggtgttgatatcatcaattgttttaacgaatacaatatcggcaaaatgctgaataatccaaaaggaagtgcaatgcaatattttagtctgattgatgaagactgcagagcagacagctgtattgactgtggagactgtgaatttgtttgtcctcaaatgctagatattccacaggaacttgaaaaagtagataattatttcggtagagaatttaatcatttttaaggtgaaaaaatgccaacaagatatataggtgacggatattgggaactgataagccgtcaaatgagtattgtaactagaagtcaacaggaaagatttaaagaagctaaaatagcagttattggctgtggaggaataggtggtcagactattgaaatgttagccagaatgggagttggccagcttaatttagttgatgaggacgcatttgatttatccaatttaaacagacaaacattagccagcattaaagaactaggcctttccaaaagcaaagtaaccaaagaaaaagtcagactgattaatccttatgttaaagttaactgctttgaagaaactgtaactaaagaaaatgttgataaaataatcggtgagtgcgatattgttattgatgctcttgataatgtcaaaacaagagtaattgtttccagagcagctgaaaataagaaaatcccatttattcatggagccattcatggaactttaggtcagattacagtattttcagcagataaagatataaactatgaaacaatgtttaatctcccatcaaaagataaagatttaactgaagatgtattggatgacttatcaagtgttacatcaggtgtccctccagttattgggcctactccaaatttaatcggatgtcttgaagctatggaagcttttaaaataacgacaggagttggcaaagttacccaagccccggaaattttaacttttgatttgttggatttaacttcatttaatgtaaatgaaatttaaacaacattactttttcttattttttatttatttgagtctgtaaaattttataggcttatttgattttaatgtgtttttcagtccaattttgcatttgatagtctaaaaatgtcaggattccatttttggttttgtatattttctttattttttcaggattggtttgtctgtagtaattttcgactttatttgatgttttttctatattttcatcatcaagatattctacgtatctgtggaagtgatttatgatatgttttcttatgaaatcttttaaaacaactggtatggccgtatatttttgtaaatattgtttaaattgttctattgcttctttttttgagttttgtctgaaacagttttttaattcttgtgcattttcgtaaatatggtctctttgttttccattaatcttgtttcttctacaatatacttttaatttatggtttattgtttgaaacagatgaaatatgcacaattgatgttttacttctatttcatctgctacattacgatacattgggaataaatcggttgttaggcaaatgaatggtttattttctgttgattctaagataaattttttcgtgttttttggtattctgcgacgtactattcgttctgtgactggaatattgagtattgcatcaaataaagttaatctgtagtgtctagttccattaagtcttaaaaattgctcatcatataaataatagccagaatattcaaatttttcattgctgatgctttcttcgtgatttttgtcagaccagttcttgattgtttgatgagatattctgattccaaggaatatttcaaagtatttacttattttacgaagtgattggtaccctattttcattattcctggaattttatccattatttcttgtaaaaattgtttattttcaccaattaatggattattgtatattccgaatttttttccacattttttgcattgatattgctgttctttgaattctgttgtttttccattagtattttgtttgtttttctttattgtgccttttttgattattttgtggcttccacaaactggacaaatgggattatcatatttaaaagtattattttcatctaaaaatagtttatgattagtattttcaaaattaggtgttttattcaatctttttgaaataattttttcttgatcaattttttcatcaaaaaaatcataaagtttaagttgtatgaagtctatattactattgagggcagatttgttttgtttggtcataaaatattatttgtcctcacttattaaagtattttactatttttaaatcatttatattaaaattaaagaaaaattagaatgaaatttcatcaaaatgaaagttcaactgtaaaaaattaaaaaacaaataagcctataaaattttacagactcaaatttattaaattctctttcaaagtttttattaggatatgaataaatcttttcataggtatacttaattccataaataaacagaaaattagctatatataactcttcataacttcttacaatttcattatttagtgtttccctctgtttatttttaaaccgtctttttaatgttgaaaaatctactccttcctgccaatctaacaaatccccttcatatttaatatcatcctcagatggagggacatttatataaaaactgaaaaattcaattaactttttacttatatcctcatttttcaatgcttttttagttagatatcttttaataatacgtttaagagcagaagtatcaggtctagaatattgattatactgcgttaaaatatcttttccaactttatgaaatgttttaatatcaataggttccgcaattctttctttcaaatcatcaacagatgcattggaaaaggaaattgctaaaatttcactaggatcaacatctcttttttcagttaaatatttaactttaccttgaattgtaaaagttttaccacttccagcacctgcaataacttttactgcatcttcatcaacgacaatagcttctctttgttgagaatctaatgattttccatccaaatcatcaaataaatcagagttatcctttaattcctgatttatataccgttcattagcttgtttagtgtccgtttcaaaagtttcaggtttattataaaatttttcaaaaaatttttcatcttctgaagaaatgtattctgcataatcttctttaaattttttaactttagagattgcatttttatgccaaagcaacaatttctgtttccaattatgggaaaaataattatcaggagcataatccccaattttagcaaattttttaacaacagaatttaaataataacttacattccatttaattaccaaatcatcaatattatcatagtttctgatagcaccatccattaactcaaatttatcctcgctgaaaatatgttttttaacacagtactggttaactttagttaaattagaataaattttctgaatacctgttttatacttttccttttcctcattttttataaaataaaatgggttaaccttattcaaagatgctccccataaaataatttcataattatctttaaagaaaaactcaacattcaatttagtaattatatcatcataattattataatcctcaataaattcacagataatatctaaatcaagatttgatggaaatacattattatgaaaatcaactatttcatttaatttattataacagtcttcagatgcttttaaagtgtctttttcttcctcagatatataagaagtaatagttttagattttatacttatgaaattattaatatcatttaaattattagaaaaccatgtctgataattaattctttgaactatattctcgaaattttcatatatttcaatgaattccaatgttaaatttttcctatattgtttaatatttggattttgattaaaaacatccctaatctttaaaagaatatcataaatataattaacctcttttttacaattatccctgttcttatcagaaatttcatgttttttagttccttttgtaaacagaataaattcattaatttcttttaaatgtttattaaaaaaagaagctattctcaaattacaaatttcattatctaaattgtcatattcttcaatgaaatttaaaaattcatttttttgagaatcagtaattttatcatcaaatgaatcaataatccttttagaaataacacaataattagaaaacaaatctttttgtttttctaaatactcagaagaattactttcaaaattcctcgcatttatttcatttaaaatttgtttaatcttaaatttacaattcttatcagcaattatatcctctaaattttcaaaattataaacaaaagaagacacaaccccattctgaagtaaaaaaggacaataattttgaaattcaacaattttattataaaaaccctcagttttcctttttaactcctcaacatcatcatccaaaacaagattagaaatttccccagatatttcattattaaaatcaattaagttatttctattagaatctaaccaactattaaccttaagtttataaattttactatcaatagaagaataaacatccttaaactcattaatcttaaccttttcagattctaacaaatcatcactaacacgtgaaacaaaagaatcgcatttatcaaagaaaactttaaaatcttccttctgcttttccaaaacaccaacagaatcacctaaaacaaaaccagaaacagaaccgaaaaaatctttaatatcaaaacgattattcaaataagaaacaatagccccaataccctcataattagacctaaattcatcaaccaactcccaatcacaaatatccaacaaatccaaatccaaatcaagacaatcctcatacaaatgcctataatcatccttaattaactcaacatcaatatgatcagtaatctcagactcccttaaagcattaaacctaacaaaatcatctttgttctcattcaaccacttcttaagctgtttcctcttaatctgctgaattttaccatctaaagaatcataataatctataaaatcaattaatatttcttcattctttttagataaccattttgaaaaattggcaattgcatcttttgaataaatataagcttttttaaatttcaattgctgatttacaaaatcatctaactcacaaacctgctcaattttattaattttaatcaaatatgaatttaacttataatgaaaattaatttcatcaatatacactgcaatatgtgaaaaattaaaaataaaatcatcaagatctattttattatcatcagttataaactcccgaacattaataactttttcattcaaatcagcatattttttctcaaaactctttttatcgtctatttttatactggtagagttttttaaactattaaaataaactaaattattccaattatcatcaacatatatggcatcatcaagtttattatccaataattcataatcattttttatacaatcatacttaaatgataaattattttcaaatttatgcaaaatttctgatttgaaatgttcaatattgttaaaattagcggttttactgttaattttaaaataacaattagattcttcaacaatatatggaaatttcgtataatattttataaaatcctttaacagatttctatattggttgctaatatcaataccattatccaaaatacagtttacattaacaagtaaccttttaaaattaaagcataattctttaaatttaaaattatctataaactctttaggaaatttagtttcataattttttatagattccaacctgctaaaattatctttaatccaattttcagattgaaccaattttattttactgtttaattttttataagcctttttgaaattgtttaaattatttctgttaagttcaatcttattttttaaataataaaatgactcattatcttcaagcatttcaatagctaaattataaagctctttatgattttctttttcttttagaagctcatcaagattattggaccttgaaatttcagaagataattttattattaaatttaacttttggtccatatcataattattgtttaaatcatctacattctggttaaagttatcgaaatttgaaataaaattagatataacttcctcttgggactcattaaaaacatctgaattatttaaagcataatctttaattggtttaattaaatcataactatctttaaactggtttttataagataatttatctttagaaatacgttcattaggaattgaaactgaaaaaaaatcatttaacttttctaaattaaatttaatactgttaaatgtatcaatacaatattcattattctttttagggataatatcatctaattcatcataaattcttttaaatgtataacaagactttctttgattgatgggcaaattaaactttttttcttcaaaataatcagttaatttacaaatcatttcataaataggtttattttcttttttaatagctgaaatatccaaaaccaaattttcaaaagaactctgatatttacttataaaaccagctattttactttcattatttaataaaaattcatttaaatcttttttatcatttttagacaaccctttaccgaaagttcctgaaaatgaatttttaagtttttgaaatgatgtaaaatcagtaaaaatatcctcattaatattagttccacagtatgaacaaatttcttcattatttaaaactttagaacatattggacactctacaaccatttattatccctcaatatcaaataatcaaaatatatgtattcaattacatttatttttcttatttaatgtatataagtaatttgaaagttattaatatatttcttacaaaaaaaagtaaatctaattaaaaataaaaaaataaagtttttaataatttatttccacattttaggataaatatctgttttcataaaaactttagaaacattaacagcaaatcctgattccaaatctaaaatctcatcactgctaaataaagaattacctgaagcaaccagttcacctttaagtgtttcaatagctactatggaatttttttgaatattgtcagacagataagctattcccccactggccaagttggcaccgtgacatattgcatcaactgcagaatctttaataactacttttggcaggtaatctgcagctcgctccatcggcataatagcttttcttaaaaatgactcgtcaccatcttctttgtagaaatgatatgcatcagtaacatcctgaagagtggataaatggttatcctctgtaaatgaacctacctgtgttcttctaagctctgccatgtgtgcaccaacaccaattgcttcacctatattatggcagtaagttctaacgtaagttccagcttcacagcctattctaaataagacatccctaccattaatttcatagatagtggaataataaacattacgtgatcttaattcacgtttaactgctgatttaaccggaggaagttggaaaattttacctgtaaactcattaaacacttcacgaattttatcctcatcaacttcatgatgaaaagtcattacacaaacatattctttaggagctgttaaaagaagttgaatagctcttgttgcatctccaagtcctacaggcaaaacacctgtaacttttggatccaaagttccgccgtgtcctgatttctccaaatttaaaatacgttttacccatgaatcaatttcatgagaagttggtcctgacggtttatctaaattaataacaccatgagaaatataatctgaaatttcacgttcttcaggagcacatccatattcaggatttgtaaaacttttggattttgtaagaaagtctttcatgaaaaatcactaaaaatcaataaataaaaaaaataagtaaataaaaataagtaatgaataatttaattaattatccatttataaatcagctaaagctgctttaatagagtcagcatcaccagaaacatctacagaatctgcagttggttctaaatgagcaatgttacatcttctatttttaacagattcaccgattacttcaacgaagttttcgtcgatgatttctacgattgcacatttttcgccagcttctctaccagcggttttaacacaaactcttcctacttcaattgctgccattatatcacctttaatgttgttagaataatttttgttatactttcagggtcaaaactgtcagtattaatcattaagtcataaatatctaaattactaatatctatgttatgaatatctaaatatcttaaagcttcactttcttcacgaattttaatttcttctttagccacatcaacagatttagattctctttgactaatcctttgagcacgaacatcaagaggtgccattaaccaaagttttaaatcagcttcaacaaaataagctgatagtcttccttccaatattaaattctctgaagatttagcaagttcagcttgtcttttatcaatttctttatcgatattatcattactttcagcaaactcactgaattcaagaacagacatgcctttttcttcagccatagccctaaaaatagagcctgaagaaacaaaaggaatacctaatttctcagacaacagctctgcagttgttgtggttccagttccagccagtccaccaacagtaattatcattattttctagcctcgtttttgaaatgtttacgagcacagcttgagcataaatacccaccatatggacggttaggtcttttatgggattttgctaatttattaatttcatatggacgtccacgtggaactccatgtaataatttaccacattcagcacaaacatgcttagatggttttttctttttgtatcttaaaacattttctccgccaggagtgtttttataaactcttttatatgatcttgacctatatctgtttgcaggcatttaatcacctaaattaattttaaataataaatttaataattgtgtaatagcgtattcaaaatagaatattatactatattgttttcattattaataaatacataggttaaggattaattaaaatccttgtttgaaacctaaaaatttccttaatatttgactcataccaaaggtacatatgaaataccagaataaccatccaatattatatccgacagaatgtcctccatacataaaactaccaataaaatgccaaatcggagctaatgatacataaaatgcacccggtggcatagagataactaaaccactaattggagaagctctcatccaaaagaatattaaaataattgggataaaagtaacaatcatcggtttgaaagaattagtcatcatcttactttgattttgcataatttcagcttgttgagcttgaagtttagctaatttctttccatcaccagatttttgagcttccctaacttctttttggtagtctttcattttctgttgtatttcattcatttcgtcttggtcaactaataatttattagctattgtagttattaatgaaacaatgaatgcaataactaaaacagtcaatgctggattttgaggatttggatctaaagcaagcaacggactgaatattgcatttagtgcctcaaataccatgttaaatatgtcaatcatgaaattcctctatttatttaaaacatccactaattttgaaactgtagaaggtaaatgattatcgtgattttcaataatttttacagtagcaccagttaatgtagcataagccatagatgctgccctgttcatttcttgatgtaattgaatatcttttgctctttcaatatctctagaacgagtatcatcatttaatcttctgtaaataatttcatcaggattagcttcaatcataacaaaaagattaggttgcaattcatttaaaacccaaattggaagacctggtaaaaatccggatggagtattaatagtacaatgagtatctacaataacattttcactttcagatctttctttaattctttttgctgctttttcttgaatttctttttgaacatctggagataattttcttaaagcatccctatcatcaacaattttttcttcaattgcgatttcagtcattatatctccataatttaaatgaacataatctacttcttcaagtgctttattaagcaaagtggtacttccagaacctggaatacctgttaatactaccaatttcaatttaatcccccattttaaaaagattaatgaagaagaataattattctcctcctaaaaatttcctaagtactggatttgctgacatgagttgttcttcagccatttcctcatatattttatgtataataccaacagtaagcaatacaccagtacctccacctaatgctccagttaagtctgcacaaaatgcaattataccaacataaagaccacttataatggtaagtgccggaatgtattttttcaatattttatataattgacgtttactgcttctgaaacctggtatctgaataccagacttgtaaagttgttctgaaattttcttagcatttaatccactaatttcaacccaaagatatgagaataaaactgcacaaagtaagaagaaaaatgcatagacaattacacgaacaggatcagttaccaataaactaacatcattcggtgtagataaatataatgcaataccgcttacagccttaccgttaacaatttcacccaaaattgggaaaccaattttttggaagacacttgcaagaagtgaaacgtttacaagcaatgcactggttaaaataacaggcatgttacttgcatatacaaattttaatggatatttaccaacagaacctctaattcttccatgtccccttactgaaccatgagaaataggaatttccactctcatagattcaccatatacaacaacaaagaatacagctgctgttgcaattaatggaattaatactgaaaagtcaatagaacttgaccagaaggattggataaatgcaggaattgctccaccataaacaccgccaggtccaggtatgaaactgaatgtacctacaataatggcttcacaaacaccagctgcaataaataaaccaataccactaccaaatccccatttggatataacttcatcaagataaattatcaatattgctccaataacaagttgaaggaataatacaccaagatatgaattatcaattggtactaaactacctgtcaataccaatacaccagcttcaaacattgtgaagacgatggataatattttttgtgtggcctgatactgtgacttatcctcaggagaagacaaatccaaatctaacaacttggaaccaactaataattgcaatacaattgaagcagttacaataggtccaattcctaatgttaaaattgaaccgaaacttcccgccataactgctcttaactgagcaaactggtccactgctgcagaactcaaaccatataatggtatttcagttaatataaagtataataccaaaataagagcagtccatttaagtttttcattaaaatcttcatgatgaacaggagattttacttctggtaaaaacctaaataatggctctaaaacttttaatgatgacattttattcctctaataaaaaagaaaagaaaaaaagaaactataattcgatagcttctcctcccatttcttcaattttttcaatagctgaagcagaaaattgaggtgctgaaataatgaaagatttagttattttacctttagctaaaactttatcataacctaattcagtaacatcaataacaatggaatctccatctttagatgctttaccgctttcaattaaattatcagcttgttcttccaagtaacttaaattaactggatttacttttttaatcattttttgaggtcttttgaatccatgtttaccataatggtctgggtcaaattttgcagtccaagtccaatgttgtttggaagctcctgcattacctctaccacctttgttacctgcacctctacgttttttggtacagcctccaccgttggatctagaacctctgagtttattaattttacgttttgatctaatcatcttatacacctaaagcattctttctgcaagatctttaatattttctcccctgtaacctaaggatcctccttctttaacagaaagacggatgtcttcgtatccttttcttggagggtgtaaacggaatacaggtttaatatctaagtccattaatttaacttcgccagcaattacagctttagctaattcatcaatatttttgtaatcggaattttcagctacatattcatcagtaactttgttgttaccagtgaatttacctcttttagcaataatttcagctaaaagatctgcatcaatttcaccccaagtgatgtaatccttagctttttgaagcataccgttgtaacttggagtatcttcaactaaaactgcatggctaattctgttaagtcttaacatgtctaaagtatcagcgatgtttttaataacaccagtagttcctctaactcttataactaaaaacatatttaatcaccgtctaatatttaactcccattttcttaaggtcagcttcactagctttaacagcacttaaagtttttaaagcatcgaatatagcattagcaaagtttacagtagtttgggtttgaccgaaagattgagaccatacatctttaataccagcaagatttaagatagttttaccgacgtctccaactactaaacctactccagcaggtgcaggcataagggaaacacttacactacttgctttaccttgtactttgaaaggtacagtgtgttctttaccacaaacacaaccccaatctccacaacctcttcttactttaataaggttgtatttagcattgtcaacagcttttctgatagctggacctacctctttagcttttccttgacctaatccaacataaccgtttttgttacctacagcaacaattactctgaagttaactttcctaccagatttgtgcattctttgaactaagttaacatccattacttcttcttctaaatctggaactaaagcatctacaatttctaattccattataggaagacctttttcaaagatttcatcaatatctgtaatggttccttctttaactaatttacccattttagttttaggttcccattcatctatattaaaactcatagttattcctctgcctcatcgatattctttttggtttcttcaaagtttttaggtaaatctgctggttgaagacctctttctaaatactttgagaataattttgcaatttcatcatcatctaaagactcagcatagtttgctacatgttctccattaatacgggattcatctggtaaaacagcttcaccataagggatatctaaacctgcatctacagcacctttaagagctgcaaatactttagatcctttaatagcagattttaaaccaatgtctaaaattgcagagtcaacacctttagctaatgctcttttagcacaaaggtaaccagttaaatatactgcagaagtattacttgccccacctaagtaaccgtaattagctaattgtttacttactgcagatgctaaggtaatatctccttcaggagcataatcaataacttgaacagttgcatgagcattagaaagtcttacaactaaacgagatttgtcataatcgactaatttcatcctagctgcgtaatcagtttttccttctcttctccttctaaatggtactttataatttgatccttgagccacgtttattcctcctatttaattaaatcatggtcacgagcatatgttttcatgtaagatttacttctgaaagcaccacccttagccattttatataatttacggtatgtagtagcatcaatttcgtttgcatcacgcatttctttaaggtcttttcttaaagctctaattgtagtcatccattcttgttttttaggattacgagcttttttagctccttttacactacctctacctttcctttttccttttttcttttgttctgctaattttttagacctgtagctactaatacctttttgaggtttagctttaatagctccattatttattaactgctttacaccttccctagtaattgccatggatacttcttccattctttcaggatcaatccatacacgattgagtcctactttaagtatactagcagctaatcttttttgagttgtaagattcatatatataatcctccattttcagcatagctgataaatttagataaaaatctaaattccctttaaatcagaaaaatcaattcaaaaaacccggaattgattcaacttgaataaatgtgaatataatatttatttatttaaaactttaatacctaattctgatgctttttctaacatcaagtcttttttccttttaccgatagaagcgcttattcttgcagcgtcagtagctgggtttaagtcttctaattccgccatattatgaacaagaacatcattataacctgaaggatgtaagtccctaacagctctaggagttctataaccgatagcaggcatatcaggttttcctgcttcgtatcttctcattttactggttttacccctaggacgtctccatttgattccaagttttttataacgagcatattcttgtcttttaaatcttttattagccatttaatcaccaattccctattctttgctaattaaatatattccatcttggaatactctaggatctcttcctttaattttagttgcttgttccaagttagccatggtttgaccaacatgttccttattgataccagtaattgttacctcatcacctttaactactactttagcactacctactactttagcagttcttggatgtctttccccgaggaaattgtcaattactacaacgtctttgtttactttcacagtcattggaaagtgagcaaatacgattttcatatgatattcaaaaccgtcagtaacaccagtaatcatattactaatgtgagcttttgtggttccaatcattgctttatctttttttcttgggaatgaagtttctaaaacaacattgttttcaacttcagtaatatccacgttaggatatgtaaattttctggagtcttctccattaggtccttttacagtgacctcattattattaattataacttcaacgccttcagggatttcaatttcttcccttatagctgcagctactaccattttatcacctaatacatgtaagccaacaaacgtccgccaattcctctttcttttgcctcataatgagtcataattccttcaggagttgtaacgattaaaataccaaagttttttgctggcaaatatcttttttcaaatttctcaaattcatcttttttaacagcgtgacgaggtttgataacaccacacttgttaatgttaccttctaattctactttgaattgacctgctctgttatcatcaatatattcaaaattaccaatgtaattttctttttgcattgtgcttaaaacttctccaattaatttggatgcaggtgaaataacacaagagtcttttacttgtaattcgttatttctaatattagttaaagcatcagcaagtggatccatgagactcatattaaaacacctctaattatattttttaaaacctattttaggagctatttccctaaaacattgtctgcataagctaagaccgtacctgctaatcatagcagagtggtctccacaacgagtacatttttttgcagcttttccatattttcttggcaaaatatcaccttaacatttattcagtcacgtaattgacattaaaattatcttccatgtatttcatagtttcttctttagaaattctatgttttgctggaactttcttttgttggattcttcttttagcaatcctgtaacctggtttttcaaaagtaacagatacattcataccaaaaataccaatatcaggattatatttcatacctggaatatcaatatgttctttaataccgaaggaaagatttccttgagcatcaaattgagtaggtttgatatttttattaattccttctaaaaccatttcaatagctttatcagctttttccccacgtaaagttaatttacatgcgattggttgacgttttctaataccaaattcagggttggtaactttagaaaatgttttaactggagtttgatcgaacatttgttctaaaagggtaatagcacgggataatttttcacctgcttcaccgacaccaatgctgacagtagctttagaaatttgtacttcgttcattgggttcatttattaacctccaataaagatattgctggtgcatcttcaccaactacaaatgcataatcttttaaagttaaaaattcatctttagcactattttcaataataatagtgttcggattagaagattcgtttacaataatttcagaaactgtacctaattcaccagtgtgtttaccaccagtaatgagtacacaagcaccttcttttaattcgaaaacttcattgatttcgtgatcaggtacttttaagtcaataacatctcctacattgtaatcattttcatcaataattacgtttttaccatcatgaaggtttacttggatttttccacctttaatagtagatttattaactattttacataatttagaatcgttttcttcaattttatttaattgtaatcttccttttttatctaaaagcactctataaacttcaccagtttttgggatttcaataatatccatgaaaccaactgggaatttataatctttaattactcttccatctacaagaacattacctgagttgatgattcttttagcttccctagaattatcagctaattttaaaatatctctaataactaaagttaaagataaagaattctcaatagaatgtgaacctgctgaaggtttgacagtccaggtatcttctttaggatgaataggccaagtttttggtgctttgtatgtttttaaatgttttctagatcccattttagccattttaattgtctcctgttacatttttaattcttctatcgtcatccatatctgcatcaataatcattacgttagatggatctactggaaggaaaactgcagttccgtcaggttttgataaagttacttcttcaatagttattttgtatgaaccatagtccacacctaaaactgcaccttcatgtcctttaaaatctccacggagaacttgaactttgtctcctttcctaataggtaaagaccttttaccaatatctgctcttaagtctttacttaaagtagcgctcatgtgttttccacgtgcatgagcaggagcattgtaaagagcttttctttgttttcttggttgttttgacattttttcacctatactaaaatacttgctgcactacctacactaggccatctgtcagctgcttctttagcaacaggacctcttacttcagatccttttaagattccttccggagtgatgataactgctgcattatcttcaaatttaacacgaagtccgtcagcacgcatgtattcctttttttgtctgattacaacagcgtttacaacttctcttctcatgtcagcagttccttttttaacagaagcaacaactaaatctccaacaccagcaacatctaatctccttcttacacctttgaaaccttttacagatataatttggatttcacgtgcaccagtattgtccacacattggagagtagctccaattggtaatgctttagatacatttgatgttaatgctttcataacaattactctccttttacttcaactaaaacaaaatgtttagttttacttaatggtctgcattctgcaacttttacagaatctccaacattcacacttaaacaatctggtttgtgaacgttaattttggatttccttttttcatatctttcatatttttttatgaatttatagtaactacgttcgacactaatggtcctttctgctttgttactcactacaattccttcaagaacttgacctcttaaaggtaaagttccatgaaatgggcagttaggatcatcgcatgtagtttctggttcttgaacattaagcccaaccatattatcaccgtatttatatttttttaaatcttttttttattctatcttcaggacgaattgacaaaatattaccattaatttcaactttctctccagttggaagttcgaatacaaatattgaacccttttttggaattattttttcaacattatcgtcaacttcaattttaatggtattctttgtctcatcaataacagttccttttaatctaagagactcgttagatacactagtaacacttacacttaatcctataaactcatgatggactaaattatttaccgtaatcatatttgcatctcttaaaaaactgtaatcagcaaaaaattataaaatttttattgaaatgtatcgaagagatgaattaccttcttctttttttattattttttttagattcacgaatttctattgtatctgatgaaaaacccatgtcagataaaacttctttgactcttactttatgacccccttgaagttctatttgaccgtttttagaagtacctccacaagcacattttgccttgagagtttttgtaagttctttaatatcaatatcgtgttcatctataccttcgataatagtcatgagttttccgaatcttctccttactgtaaatactttaacagtttgaacttcacgtgcaatttcttcacacacacaaagttcttccggaagcccacagacatcacagatttttgacatttaattctccttctgtttttcattcaatattgtaagaacacgagcaattgttcttttcaattctctaatttttcctgggttttcaattaccccagcagctgcacttttagaaacatttttggataattcagctctgagttcaactaatttatcttgaatctcatcaacttccatgtcccaaatttctttacttcttaaaatcgccattgttccaactcttttgaaataattaaatttttaataatttaactatcctcttttgcttcttcagcagattcctcttcaacaatctcttctaattcatcgaggtcttctacttcttccacaatttcttcttccacgatttcttcgctgtcgtcaagttcttcaacttcaactacttcatcgtcttcaataatttccatttttggaggaagaatctcaactgaatcaggtaatacagtttctggaggcatgattcttacatatataccaagtacacctggttttaattgaactgtagcaaatccttcttcaactaatctgattgatggttcaccacattttttgatgtaaccttcaacaaatttagctacagcagatcttgaacctctgattttaccagaaatagtaacttctacaccttgagctccagcgcccatgattctacgaatggtagagtaagcaactcttctgaaatgcatacctctttgtaacatgttagctattttataagccatgatttttgggttgagttcaggaacacttacttctttaacttcaatttgaggattgtctaaaccgaagtcatttttaagagtgttggtaatagcccttacgttttttccacctctaccaattaccataccaggcctttctgcataaacaacaaccatagtacctaaaggtgtaatttgaacatccataccaccgtatcctgctctttcaagttctttttctaagtattcatcaattctggttcttttaaggccctcagtgacgaaatctttttctatcattagttagcctcctgtaatactatttggatatgagtagttggagtgttgaatggggtcatcctaccgaatgctcttggaataactccaggaagtacaactcctctgtgactggagatatgttcaatgaataagttttcagtgtccatacctttgtattcagcattagcttcagcattttctaaaacttttaatacttgttctgctgcttttacagggtatctacctgctgcccatccttcttgtccttttctgtgaccaacttgtctgttgtgtcttttgaaaggaacagattttttcatatcaataacatcttccaaataatttttagctttagttacttccattcctcttattgcattgcaaatttcaacacagtgttttggagaaatcttaagagattttgccatagcacgtgcagtttttgcttcattagtttctttattataagcatatttattagccatgatctaatctccctatttaagtggtacaaacatagatgatcttgtagctcccatacctgggtctccatgttgaactttttgtcttgttggtgcaaattcaccaaagtaacaaccgatcatttccggttcgattgtaacttcaacaaagttttgaccattgtaaattccgaaagttgttccgaccatttcaggtaaaacaatcatatctctacaatgggtcctgattacaacaggcctgccatctttgctgccttctttatttaactttctcattttatccaaaacaatttgttgtcttggtaaaaatcctctttttaaagaccttctttgtcttgcagggaataattccattacttcctctaaagacatgtcttgtaattcttcaagagtataacctttatatttaaatatttttcttgccaatgaaacaccctctatctatctttttaatcctgttcttttagctgcaattgaaccaacttttcttcctggtggtgcatgtcttgaaacagtagttggacgaccaggatgttgcctgttacctcccccgtgagggtgatcaacagcgttcatagctactcctcttacggtcatgaacttcttacctttagctttgtaagcatgccatctgttaccagctttaaggaatggtttttcttttcttcctcctccagctacaacaccgatacttgcacggcatcttgggttgaggtattttaattcaccagatggtaattctacaacagattgattagcatcatgagtaattaaagaagcataagttccagatgatcttacaaaacgacctccgtctccaggagtattttcaatatcataaataggagttccttctggaatttcagcaagaggtaaagtattaccaaatttaataggagcagaaataccacattcaatttcatcatcgatttgaatgctttcaggtgctaagataaatttcttttcaccattttcaaatttcacttctgcaattggagcagttcttgctgggtcatgtacaatatcagtaacgattcctttaatactaccttctttttctaatgcatcgtaagatctgtatctgattttatctttaaaacgatgagaagcaacacggtgagcaggagttcctcttcctcttctttgaattattaatcgttttcccattataattcctccttagaatactcctattttgacagcaagttcttctgccatttcttcttcaacaagtttaataaatgctactttattaccacgaggagtgatatgagtagttactctagctactttttcttcgtataactcttcaaaagcccttttaatttgacctttgttagcgtcacgttttacaacaaaagtaatctcattgtttttatcgattaaattcatggttttttcagtaacatgaggtttaataataattgagtatgaatccataataatcaccttatttatccaaaattattggaataaacctcctaatttttcaacagctgatttagtgaaaatagtgagtcttcctgggtgagtacctggtgctaataattctgcatttaagttttcaacagttactacatctacaccagcatggtttcttgcacctaatttgataccgttatcttcaccgactactaaaagaggtccttttacttttttgtattttcttcctctagttttacccctacccgctcttattcttttaccttctttagcacgggtaatgtcgtcgtaaactcctaagttttggaaaatttcacgagtttgtttagtagtttttacagaacaaatatcatcttcaacaataataggtacttgttcaaggtctcctaatctgtgacctctgttttcaacaagttctttatttgcagtagctgctacagcagacctgattgcaaatcttctttcttttatgttgattttttcgtgatgatttttttcagctcttgtaggatgtgcacgtctaccaccaacagccattggtacgaatgctgctttggaaccgtttttgatcctaggtactctagctgtacctctaccagatccccaaccttttgcagaagttcttttacctgcttcagggtcattaccccatggttgtactctagcggtttgtgctgaaataacagccctttttattaaatcaggcctgtattcttcattaaaaatagctggaagttcaatttcttctttaacttccccttccattgaataaacatttgctttcatgattagaccccttgtttagattttgtacttatgtagtttatttgaggcatgtcctcagatttgttattaggcctaataggttgtcttaaaataaccaatcttttagatggacctggtaatgaaccttttactaaaacatagtcgtttttaacaagaccatattttacaaatccaccgtccggattaatttgatcaacttcatcagcagatgcgatttttaagatttttttattgaactcagttcttttatggtatcccatttgacctgcttgtgctacggtccacatggttcttgatggagtccaaggtccaatagaacctacgtgtcttcctttacctgctcttacagctttaccatattgaattctgattccccatcttttaactacaccttggaatccttttcctttagtagttgcaattgcatctacaaattgaccttcgtttaagatgtcactagcttttacttcattacctaataattctaatgcagtatttaatttttcttcaggatttgctcctccaataccacattcaaatatgtctggttttttcttaggtacgctagttacttttggattagtatggactaaaactttaatatcttcagttttgtctaatacaccttgtatttttgcaatagcttcagatttattgtattctttaggaagagaaattttccttgagagttcttcatctaaattatctgcaagtacttcggtgatcacttttaatccacgagaagttttttcgtatgctctaattcccattactacgactggaggtacttccaatacggttactggagtgaaaacatccataccattagttggagagtttttgtcagaatcagtcactaaagcgtgagtcataccgactttataacctgcgaggccgagtaattttggttcgtcattttgtggccaagattttatcctaggggtttctttagctgctcttttccttggactaaaagcaacagacccttttcttggctggtgatgtcttaccatttattttacctccttaactaatattttcctttattttattatattcaaatttttaaacaatagctataaatagctattttcagatttggacaatattacaccaagtataatattatccgagtaataaataaccgcaataatatcacagttaaataaacattaaagtttaatatattcttttgagcgaaattaattgaaacataattaagcgctcgtttaatgtataaactattctgcgctaagtaatttttaggagagtcctaaaaacatcaatgtataaaaagttgagcaaattatctattagccatgtataaaaactaataatatataaagagaattaaaatctcaaaatgttgaataaagaaagtgtagcgacaactgcctcttcagttctgacagtttcagttccttggttaggtacagtatttaatttaatatgttcccaattaccactagaaacatcttccggaattgaagaatatgggccaccaaacaaaatagcaatatttttaaattcatctactttaagttttaattcatcaaaaatagaatcaatataatccccatatcttgtagtttcaacaataaaatctggtttaattaattttaagctatttttaagactcttattagaagatattacattatatccccagtaaatgtcatctggtttatcaggtgtgactattacttctttcttagcaatttttgtaatcttaaagttaaaaattttcttaacagtaagttgctctttgcagaatgcaagtttatccatacctatatccacaaaagttcctttcttatttcttttaacagtaaatccctgtctatagtcgcccacgtctggttgactatttactggatgatgaggagctctaagtggtggaagaatacctacatgcttaagttcaggtcttataggaaatgcacttttcctcaaatactgaggagtgttcatataatttaaaacttcagcaatgaattctccatcttcttccccattttcatttttaatatagtcatcattataaataacaacattatcaatctgaaatactgctaaagctctgcctaaaattcccactttaaaagtacgaactttaagatctttagattcagacagaaaagaattcggaataaatacagatagctcatctttatacattattttaatattagtaaaataaagtatataaagatttccctacatttacatagctatcactaatagacttatacattttataaatattatatcaattataatatccgtagccatcttattatgctaccaacttttatactcataaggaatatattaatataatatatagattatgtagtatataaaggtattgtttttctatttaaaataagtaaaatttaaagaaaagctcgaattactattacttcaacatttgcagattcccttgtatgaaattcataaattttaggaataggaaaattatatctgaaaatatgagtaatttccaaatcatttttttcaaaatagctaattaaaaactcttcagttgacgccatgtgaaatgaatacaaaacttttggagacagttcaatagccttactgataaattttaaatcagcacctttttttgcatttttttgtgatccgaatggaggattttgaaaaatagtatcaacatcaaagtcattttccaaatcacaaatatcactgcatataaaattaacatccccgcaataactgctggccagatcagttgaatccttatcaatatccacaccaatagctgaagctgcacctaataatttagatgcaattgcaaatattcctgttccgcagcctaaatccattacttttttatctgcgatatcccctaaagaatatgcattccacagcaaatctgctgcaataatggcaggtgtagaatactgttccaggtctactttcggatttggatgctttggaaccttttgtatggccatttccaaatgtttctttttagtaattttcttcatctaaacaacatatttaattattatttcttatataattatattattaataaaaattaaaaagaggtttcgaatgtttgaaaagatattaattgcaaatagaggagaaattgcaataagagttatgcgtgcctgtcgtgagcttgatatccaaagcgtagctatatactctgatgcagatacaacatctctttatacaaactatgctgatgaaagctatcctttaggtaacccttctccagccaagtcttatttaaatatagaaaaaatcatagatattgcacttgaatccggatcagatgctattcacccaggatatggatttttagctgaaaaccctaaatttggtgaagcatgtgaaaaaaatggaattaaacttataggacctacaggtgatgtaatccatcaaatgggagataaaataacttcaaaagctcttatgaaaaaagctggagttcctgttattgaaggtactcctgaaggagttagtgacattgaggaagctaaagaaatagccagacaaattggatatcctgtaattgtaaaagcttctgcaggtggtgggggaattggtatgcgtgctgtttatgaagaagatgaattagtacgtgcaattgaatctacccagtctgttgcttctacaaactttggagactcaactgtatttattgaaaaataccttgaaaaacctagacacatcgaatttcagttattggctgatgaacatggaaatgttattcatgtagcagacagggaatgttccatccaaagaagacatcaaaagttacttgaagaagctccttctccaattatgactgaagagcttagggctgaaatgggagcaagtgcagtaaaagctgcagaatatatcggctataccagtgcaggtactgttgaattcctgtacgacaacggccaatattacttccttgaaatgaacacacgtattcaggtagaacacccaattacagaacttgttaccaatactgatttgattaaagaacaaataaaaatagctaatggtgatgaactcagttacgaacaaaaggacatacaagtatcaggtcatgcaatagaatgtcgtattaatgcagaagacccgttaaatgactttgcacctaaccctggtaaaattaccggttacaggtctcctggaggacctggtgtacgtttagacagtggagtttatatgaattataccattcctactttctatgattcaatgatttcaaaattagtaacctggggaagaaccagagacgactccatagccagaatgaaaagagcattaagcgaatacattattttaggagttaaaactacaattccattccataaagctatcttaagaaatcctaactttatcagcggtgacttaaacactcactttattgaccaatacaaaaacggtattgaaagtgaaatggttaatgtaattgcagaagatttggaaaatgtaaataaaatgaaatccactttcatgccaagtaaaaaaatagctgcaatttctgctgctgttggatcttacttaaatactgctaaaaaccaacaaatgaataaaaaataaatttggggatttacaaatgcaaaatgaaatagtaaagctattaaaaaaagagggaaaattatctgaaaaaactattgatgaattaagcaatattgaaattagtgatttttccgatttagttagagaacttggaaaagaagaaactaagtatattaaaagggacaaaatctcaaaaaatctaaataccaaatacattggtaaagatatgtatatatttaatgaagtaatgtccacaaacacaatagctaaatttttatcaatgaacggcgttggaaacggggcagttgtaatttctgaaaagcaaacaaaagctagaggacgatcaggtaaaaattgggaatctcctcttggtggtgtttggttgtcaattatattgaatccaaatgtaacccactcaaaaatcccattaattacccttgcaactggtgtagctgttgaaaatacattaaaaagaataggcattgaaaatgctgaaataaaatggcctaatgacattttaattcaggataaaaaagtgtgcggaatactaaccgaagctataaccagctttaacactattgaaagtgtcatcattggtgttggaattgatgcaaacataaatactgaaaacttccctcaggaattgcaggaaaacatgacaacattaaatgaggaaataggtgaaaaagttgatgaaaaccttctaattaggttattcttagaagaatttgaaaaaatcagcgaacagttcataaatgaagaatacgaaactatcttaaaagaatggagaaaaaactcctataccatcggaaaaatcgtagaagtgcatgaaccatttagcaaaccttatgacggttatgttttaggcatcagcagagacggatcattagttgtggaaaaaattgacggaactttagaaaaagtaatatctggagaatgtataattaagaagtaaatacaatctccctgcatttatcttcatttgtaactacttcctgtagcttattaaatgaagattctatttttttatttaaatcatttaaatctaaattaaatgcatcttttgtagacaaatcaaatcttattgttgtagatgcaccaggcattgaaactgggggaattgtaataattccatgctcttttaataatataaatgcaaaaataaatgccaaatcatcatcagataaattatgtgaaactttgatttcattagctaaatcatgagatgaaatcatgacccctgtcggagtttcactaaaagcattaaaattcttatttaataatttaaacagctcttcttttcttgaaaatcctctaattaaattttcaccattgaaatttttaataccattaaccatagctaaaatagctggcggttgtgcttcaagaccaaactggttagctttaactttaattttatcaactaaatctttacgaccagccatcaatcctcctctaggacctggcattaatttatcagtacttgtaattgtaatatctgcacctaaatcacaggcttttttctggttaaatacaacagttctaagtctggctcctgatgcatcatcgaccatgaccggaatattttgttcgtgagccatttcaatgacttttttgaaaatatcttcatcaattactttatggtccattgttgagcctgttacaacaactaaagaagtattttcaggtatttcaaatttatcaaaatcatcagtttcaaaataattagctttaactaattcacaacttcttggaatagacggatgagccggcaattgggcaaggtagtgaactacattggaaccttcatcaactaatgaaagaatagtggccaatatacctgaagaagttctgttaagtggaagaattttttctccacctaaatgtttttttccaacttcctgaatttcatcctcaaaaatagccggtccgacataagtttcaagtaagcttaattgggatgatgaagcaataaatcctccagataaacctgttaaatcatataattcattacgacctttagtttcaatgatgttttttataatagataaagcattttctctttttttaacttcatctaaagaattgttaactatcatctaatcagagtcgaattctaatgtaaagtctttgaaagcttcaacaaatgcttttaaatctttttcaggtactggcatttgaacaaactgttcgttttcaggttcctcataggaatattccgcatcagtaattttaccttcaggtgttgtccacaaaattaagctgtcacttaattcttcaggttttttgttagggaaaaatatttctacagaagctcctaactgtacaaaaaacttttctttttcttcatcacttttatttacttttttgatttttcttactcttgatttcaattttttttcagcaagttcatttatatctggcatttataacacatcctgaaactttatttatatataatctaaattatagttaaaattcacatattatataagcattcttatttgatttaaaaatcagtcatataaactgttgccttcactatccatagctactataagcggtccaaaatctttaactttcaaattccacatagcttccggcattcctaaatccagccagtcaacactttcaatttcttcaactgcatcaacataaagtgctgcacatccaccagtagctacaacatacaatgcattgtttttaactaaagctttccttactgtatcatccattcctcccttacctattactattttaggccccatatcaataacatcactttgataaggattcattctcatggaagtggttggacctacagctaccattttatatccgttttcatcttcagatataattggtcctgcatgaaatattgctgcaccttcaatatccaacggagcaccctgttccagaattcttttatgtgcttggtctcttgcagtgataatatttccagttaatgtaattacatctccaatttttaagtcagttaaatcttcgtttttaaccggcactttaatatttttttccatttggtcaccttgtaaattattataaatatataaaatttttagcttttataaatttaatgggtagacaccaatgctcttttcaaaactttggtgatttaaaattttctgataaaaattagtttaaaatttttaatcctgtttaaaaaacttaaaataatcggaattaatgacttattatgtttcgaatcagttttttaagaaaaaattttctagtttttcttcatttattttataattatcaataatttttccatcttccatatgcaaaatatgggaacacacttccattattaattcaaaatcatgggtgatgataaatgaagtaacacctaatttttgaagataaactaaattttcgctaactttcatcatattcttcaaatcaagcccacttgtcggttcatcaaaaatcagaaattccttacctgaagcaatagcagatgcaatggcaactctttgcttttcaccgccggacaatgccatagggtgcatttcttttagatgaatcagatttaagtttgttaaaatttcctcagcaacacagatattttcatcatccatactcagcaatacttcatccagtacactttcagtgaataattgatgattaacatcctgcatcaccatatatgtctttttaagcaggtcctttcttttcaaatgattatctccccaaataatttcccctttgcaggactttttaagtccacatagacaatttgcaaaagtagattttccagcaccattttttccaatgactgcaattatttcattttttgggattttaacttcatcaatatttaatacctgatttttgccatatttaaaattaaaatttttaagttcaatcatttcatgattatttgaataatactcactatgattaacaaccaattttttcaaatttaattgtcttaaaccgtaatccctatggtcaatatgtctgaactggtccatagaccattcattagtaatttgccctttttccataaatataactctatcaacaacattacttaaaaagaacagtttatgttcagctacaataaccgtttttccggattctttccatttcttaataatatcttccaaatcccaactagattccgaatctaaatttgatgaaggttcatcaagaacaaatatgtcgggaaaaactgcagatactgatgctccggcaattttttgtttttcgccaccagacagtttaaaaatgtttttatcaagaagatgctgtaatttaaagtcgtttacaacataattcaatctattttttatttcatcagtattcattgcaagattttcgcacccgaaaactatttcacttgttgtatccacattgaagaattgtgtttttggattttgaaaaacagaacctacatatcttgatatttcataaattggcatttcacttattaaattaccatccaaatatacatttccctgtcttgttccatcgaaaaagttgggaataattccatttatcatacgcgttaatgttgtttttccgcaaccggattcaccacaaagcagaatgacttcacctttttcaatattctgattaatatctgccagattacagttattcttactgttgtcatatgaaaatgaaacattatctattttaagcaaaaaagacaccacctaaaaaataatatacataaactcccaaaccgattaatgaaactgtcagtaatgtataatctattttatttaatttaacttccataaaatgagttctgggttcaggattacttaatccccttgttaaagaagctgcagaaagttcatctgctgttttaatagcgctgaccagaataggaatcatataaaattccaccagttttaaaggatttttcaatgatttaacattcaaaccaaaacctctcattttcattgcattagttattgatttaatttcttcataaactgacggaatatacctaaagataactgaaagcggaatagtaacctcttttggaatattacttttttccatggacactataaattcactcacttttgttgttgtgactgtataataccccatcatcaaaacaggcaacattctagtggtcgtataactaaacattatcatcaatattgcaattatgcctgttgcagttggaagaagataaatctgaatatattttgcaacaatatacattaaaatataacttaaagcaataccaatacgatttgaaaaaaataaacaaataaatggaattaaaactaaaattccactaatgtataacggcacttcattaaaaaccatgaaacttatcaaaaccaaaattataattttagttcttggatccaatttaaaatttagttttaatcccataatatcaccttaggcaatacctgctttttcaaaatgttttttcaaaacaatttttccaatatatgcaccgattaaagcaacaacaaatgtagcaattatcaaaataatcagcatttcatttgttaaaaacggtaaaattacatttacatagtcagttcccattgacgcacgaattgattcaacaaaataatctcttaaaatgtaaaacggtagcatattaccaaatattcccaatgagaaaaatccataactgataattgaatttttaatagaggaataatctccaatttttaaaactacatcagccaccaatccacaaagcgtatagactacaattggaatccatgtgtgaccgcttaaaaacattacaattcccaaaaccaaacccaacaatgaagtcattccaaatttatcaactcttgttaaaaacagcatatatggaattcctgcaattaatgctacaatgaccggcaatgcaatcatcagtattgggatatatcccagcattccaaaaataaaaattgaaactgtcagtatcactgcaaaaatacctacagtgattaaatcttttacatttaacattttactcattaatattacctcctattttatattatactaatgaaaataatccggagaatctaaatttgccattctccacttaagctctgtaaatcaaccatctttttaaacaaaccattatctgcaattagttcttcaggcattccctgctccacaattttgccgtcatctaaaacaacaattctatcagcattagctattgttctcatcctatgagcaatgatgatgactgtcttgtttttaatcaactcagacaatgccttttggattttagattcattttcaacatctaaaaatgaagttgcttcatccaataaaattacatttgcatcttttagaagtgcccttgcaattgaaattctttgtctttgaccgcctgagagcaactcaccattttcaccaattacagtatcatatccatttggaagtttaaagacaaactcttcacattctgcaagacgggcagcttcaatcacttcttcatcagttgcatcttttcttccaacacgaatattttccaaaattgaattgttgaacaatattacatcctgaaaaacaattgaaaagttttccagaagcttttctgagtccaattttgataaatcctgacctccaagtgatactgtacctgatacaggatcccaaaatcttgcggcaagctttgaaactgtacttttacctccgccagacggccctacaagagctgtaacttcaccctgctttgcagtaaatgaaatatcagttaaaacatccttcaaatcatcgtaattaaaactgacattttcaaattcgacatcataactgtccaaagaataatcagccaaacctccttcaactacaagactttcaatttcctgagcccttgtaattttattgtccatcataaatatttctgccaaaaatatcaatccgttttccagtggagaataaactgttgcagatgctatcaagaatattaaaaaggtaaaaattgatatttgcgaatttattattagatatgaacctaaaaggattacagatacaattcctaaatttaatacaacttttccaactattactcccgaagtagccattaattcagcattaattcttgatttttcaattgttgaagttaaactgccaatttttccataatattcctcttcacaattgtaggatttcaaatccccaattgattcaatgcattcttgcacagcatctccacaattaagcaaatcagccattattctatccccaccaatataaataagtcttttggagataaataagaatataaatgcaacagggactacccataaaagcgcaatagccaatctccagtcaaatagaaacattcccactgaaacaatacatagtgaaatgattgaacccatcaattgcggaaccgcatgtgagaaaacatgctccaaatcagtacaatcattcattattgttgcagtcagatcagccaaatccctattttcaaaaaaggataatggaagtttccttaaattctcaccaaggttgattcttctgtttccactttcaacatatgttgtattgaatacaaagtgatactgcttccatgcaaaggcaaaaataattcctaaaataatcagtatcaataaaataaatattccaagatttggatcaattatttcacccactgttaattgctccacccacagataaataagtaatgcatataaaccaacgggaaacataaatgatatgttcaaaagtgcagtatagaaaattcctttaatcaagttgtcagaaccctcttttgtaagtccaaatcttttagtaaaaaacttagataacatcatatcacctcgcttttaactttccactggattgattggttaaattcatcccacattctagagtaaatgcccccactatcaatcagagtatggtggttgccttcttcaacaattcgtccattttcaaccacataaattttgtctacatttttaactgaggacaacctgtgcgcaatcataatgactgttttgtctttagtaatttctgaaattgctttttgaatcagatattcattttccgggtctgcaagtgcagttgcttcatccaaaataattattggagcatccttaagaaccgctcttgcaagtgcaatcctttgctgttgacctcctgaaagataggttccttcacttcctattacagtatttattccgtccggaagctcatcaataatatcgtcacattgggttaaactcaatgcttttttaacatcatctcttgatgcacccttacgaccaattgcaacattattgtaaattgaatctttaaataatgtcgtattctggaatacgaaagaaatatttttcatcaattcctttgttgaaatatctcttacatcaacatccccaactttaattgaaccctgattaacatcccaaaatcttggaatcaatgatgcaattgtggttttgccccctccagaagggccaactaatgcaacagtttcattttcattaatttttaaattcacatcatttaaaatatgttcatcaccatcggcattttcataatcaaaataaactccttcaaactctattgaatgatttttaggtttttgaggattgattgggtcaactaaagggttttcatttagaatagcttctatactgtctaaagcacaacttgccaacatccaatcttgtgaaactgtcattattttcatcatcattacagcacagattggtgtgaaaataatgtaaaacatgaagtttgcaaagaattttacatctacaactgatcctgcaagaagtattcctgctggaatcaacaatgcaaaaaatccgttgatggatactgtaaatgcagtcataggaatgtgagttgacatagaatattcagccgaaaattttccgtagtttttgatggcattgataaagtttttaaatgagtaaatactttgttgaaatgcttttgtaactggaattcctcttacatattctactgcttctccattcatttcctccaaatatttctcatatttctccatgctatttctggattcttttgaaaacataggatacataaatacaaaacataatatgattggaatcagacagattaaccctaaacgccaatcaaaactaaataacaaaattaaaaatattattggagtcacaatagctcctgtcaaatcaaacaattgatgagcgaggaatatttcagtttttgcagtgctgtaatcaattatctttctaagacccccacttgtatggtttgaaaaataacctaaaggcaacttaagtaaatgctttatagctgcatctttcatgtttttctcatttttaaatgcggacaaatgtgtacccatcagaccaaaaaagtttaaaattattcccagtactgcaaatgtaaacgcatttatcgcataaacatccaagttttgggcttttgtaaaatcaggggcaaccgccaatagggcattgaccacatcccatatataaacaaatggaaccaataaacatattgcacttaaagctgataaaaacatacctacaattgtcaaatatttataattacccgagtaattcaataatctaataaatttatttttattttgagtttctggcattattatcgcctcaaataataatttaggtttacctaaaaatttaaaattaatctaaaaggacaaaacactaaaaatattctaaaaaaacaattaagaaataatttaatgtattttaattaaaaataactagataacctaatatttactataaagtattatttaattaaatatataaatatttttgaactaaaaagacaataaatataccaaaaagacaaaatctattttttatactccgacggagtgcaaccgatatattctttaaatgcctgagtgaattttgaaggtgatgaataacctaccatttttgatatttcagaaattgtataggaacctccttcgattagtttgcaggcatattccaatttatattcctttctccatttaaaaataggtttgccgtgaacttttttaaaacacttttttaaagtcgttttgctgatgccataattatctgcaagttcatctatagtaattttactttccaagtcattaatcagctcattttttacatcatcaacaattttaacctgctgtttggtaagggaaatattttcatgaacatcaaagtttgtaatcgagaaaaacaataataattcaagacattttaatttaaaataagataatttaattctattgtcaacatggtacaattcaccaataacatggtcaattttattatttgaacgaagcaatacatatccgtgagattttttcagaagttcataaaattcaatcaagtcaaaatcaggaatatactgcttgacataatcattagccatatcaacatcaatgaaaatctctaaaccattataaaatcctaatggaaagtcagaacatgtttttgtcatatcataaatattaatgcacaaatccccttttccaaaataaattatttcatcatcaccaacactataagcatacctgccgtccaaacaatgatttatcataagcaatcttgaagaaagtttttcttcaacatatacattttcatgattttgcaaattgatgtcaataaatgctaagactattccggggaatagagaatatgtttcaaactgaccgtattcacccaaatcaatgatttttttatagtcatctccagttatggaaaagtcagtgacaaacacctccccaaataattcaaaaagattttcattcatgcctttaattatatccactctgatataaaacatttcaacatacaccgcattaactaatcaatgttaaatttaatatacttctgtgaccaaatttttaattaaataaagtatgctctggtcaattaggaaaatgttttctattttgacaaatttaatatatctgttaggaccaacttttatatgagtataaaacaaaaaattaggataaaataccatgtcaagtatgagtagtgttgcaggactatctaaatatattacaaccttgcccaaaactgaaaaatcaataaccgccatgtttattataagcttcatatcaggagcagtctactttataattaatccaagccccgaacttggtatggtagaaaatattattttaggaggattattcagcttaataatacttggaatcagttcaataattggtggaggagtcaatcaacagattgtaagtggtctacatggtattaacttaaaaatcaaacattccatgtttttatctgcactttcaatgactattgtctgtattcttttaataatcggcggaattcttacacacttttttgaaacagacttctttttgaattccttactgttcggatgtgttttaatttacggagtcaatacgctggtattttggacaacctccaaaatcagttttacaaaagctgcaactgttggaataatccagccattaatcatgctggccatgtatgtgctgattacttttttagtaactgacacaagctttttaggttctgatttaatccaaatgacaataaaagtaataatagcaagtatcatttttatattggctatttactcatttattacaatagcaggatctcctttaaagaaaaatctcggtatcggaatgcttgatttgctcagtctgtttattgctcatatgaatgaaggatcaaactccctcgaatcattgtttgaaaacatgagtgaaactgttgaaacaatggttacatttattagtttcaaaggaaaaaatgggataaaatctttatttatttcaccatttgtccatcccggacctttgggggatttaggcggttccaatatgccgacaatacttgcaaataagtttgaccattttaccatggtggctcacggaccttcaacccatgacttcaatcctgtcagaacaactgaaattgacaaaatagaaaatgctgtaaaagaaggtttggaagaaattgaatactcaaaagatgcaagtatttttaccagatacaattcagaaaaagcaaacattggagtgcagttctttaataaaggtatggttattttaagtacatttgcaccaaatgacagtgatgacattgaatttggggtaggtcttacaatgatgactcaaagtaaaagtaaatgtgatgttaaagactccgtcattgtagactgtcacaattcatttgctcctgaaagtggagaagttttacctggaaatgaagaggtattccaattaattgatgttattgataaaatccaatgcaatcatcaaagagatactctaaaaataggatgttatgaaaacataatgcaggatttaaataaaaatgaaggtgtcggtgaaagcggtattaaaaccatggttgtagaagtagctaatcagagaactgcatatgtcctgtttgattcaaacaatatggaaatcggatttagacaagaaattattgatgctacaaaagatttggatattgatgaaatagaagtgatgacaactgatactcatacagtcaacacaatatccagaggatacaacccgattggaattgtaaaaagagacgaaattattgaatatgttaaaatcagtattaatgaagctataaaagatttagaagaagttgaagttggaactggaacaaaaagaattaaaaaccttcatacattcggtcctaataactcaacagaattaatatcaacaatcagttcaattgttgcagttagtaaaattatagctccagttttattaattactgcattagtaattgtatttatttggatattttatggtggtttataaatatgccaccaataaagtatatgtaataacccatccaacaaggaacggcattattccatcccataaccattgggaaaatccggagatttcatctccaaattgtttttgagcaagttgcccaacaaaatatagtataataaatgcaagtgcggttgcaaaaacatcgtttttaattccaaaccagcttaatgtgaatccagtagaaataatacctgtaatgataccaactactaaatgaagacttgttattttaattgtagtgtccatttatttcctccaaaaaattaaataaatataattattattaattatactatattaaactattgatatttataataaaaaggtgtaaacaatgaaacctatgtctaatgtagacatttttacaataactgatgaattaaataatttattaaccggtgcaagagtagacaaatcatttcaaccaacaaaagatattgttgtaatgagatttcatgtagctggaaccggaaggattgatttagtaatggaatgcggtaaaagaatccacaccagcaaatatcctcttgaaaatcctattaatcctcctgtttttccaatgcttttaagaaaaaggataaaaggtgccaatgtagttagtataacccagcataattttgataggattattgaaattaaagttaaaaaagacaaatactacactattgttgttgaactgttcgataaaggaaatattatccttttagatgaagacaacaacataatattgcctcttaaaaggaaacgttttagtgatagggacattagttctaaaaaagaataccagtttccagaagaaaggggaattgatcctatcagcataagtgaaactgaactaaaagaactgtttgccagttcagataaggatttggttagaacattggctatgaataatttgggaagcttatatgctgaagaaattattaaaagagctaacgaatttgaagaaattgacaaacatactccttcagctgatttaagtgaaagtcaaatagctaacctaaataaggctatccatttgctgtttgataacctgcaagaagaacatttcaaacctcaaattgttaaaaaagacagcaaagaagatgttgttgcttttgatttagtaaaatatgacggatttgaaaaaacatattttgataacttcaatgaggcctgtgatgaattttattccaaaaaggtaaacactgacattaaaaatattaaagaagctgcatggaataaaaaagtaaacaagttcgaaaaaagattaaagctacaggaagaaacacttgataattttcataaaacaattgaaactagccaacataaaggagaagtaatttattctaattacaccaccatagaaaatttggtaaaagtagtaaacaacgctataagtaaagattattcttacaaagaaattggaaaaacactgaaagaagctaaaaagaactgtctaaaagaagctgaaatctttgaatccattgataaaatgggcgttttaacacttaaactaaatgaaacttcaataaacattaatccaaaattgactattcctgaaaatgctgagatttactatgaaaaagctaaaaaagctaaaaagaaaacaaaaggtgctacaatagctattgaaaatactaaaaagcaacttgaaaaaatcaaagctaaaaaagaagtggctatggaacacatttcagttcctaaaaagagagttaagaaaaatcttaaatggtacgagaaattaagatggtttgtaacttcagacaatgttttagtaattgggggaagagatgccggtaccaatgaagctgttgtaaaaaaatatatggacaataatgatatttatttacatgcagatatacatggagcaacatcaactgtgataaaactagaaggcaataaagtaaatgatagtatccttaaagaatccggagagtttgcagcatcattttcaactgcttggtccaaaggtttcacaacacaggatgtattttgggtcaaccctgagcaggttacaaaaacacctgaagccggagaattcctgccaaaaggatcatttgtaataagaggtaaccgtaattacatccgcagtgcaaaagtcagaattgctattggaattgttgattatgaaggaaaaaggttaatggccggtcctgttgatgctttagaaacacattgtgacaattttattgtgttgaaacccggatatactaaaaaaacagcaatagctaaaaaaatacttcatgaaataaatgaagacgacttaataactttagatgatataatcagagttttaccatctggaaaatgtgatgttgatgaagaatatcacttaagaaaaaaatatgaaaagaattaatcctgataattttcaggattatattcaaaatattcaccgggatttaaaataaccacatcaatattcggatttaactgactgacaaagttagcataaatagaagggtcctgttcaattggcggaaatgtattgtaatgcattggaatagctacttttgaatcaatccaccttgtagccagtgctgcttcaaaaggacccattgtaaacttatctccaataggaagcaatgcaatatccggtttatatatttccccaataattgttttcatatccccaaataatccagtatcaccagcatggaacagtttagttccgtcttcaagtgttattaaaaaactggctgcatctccagcaggaagtggctcttcaacaatatctaatactgaagaatgtttagcatcaagcattgtaaatttaactccacggtatatgaatgagccgccgatatttacaccaatattgttaattccctgttttgataaaaataaagaaatctcatgaattgctgctacaggaacattatttttattggacagttccattgcatctcccaaatgatcggaatgtccgtgagtaaccaatatgatatccggattaaattcttcaacaggaatttgacaagccggattattgctaataaaagggtcaattaaaatatttaaaccctcatcagttattatttcaaaagctgaatgacctaaccatctaatttccatttaaatcacctttactgtatataatttgcaactaaattttcatccaagtttgctgcaatatcccaagttttctcaaagctagttctgatttcagaaatagatttcctatcttcataaatagctccatattccacatcactgttattgctacctttagaaataatcatagcattagaatcatctgtgattaagttaattgaatgtacttgaggaactgttttaatttgtactccctgtttaagaagtgaagaaactaaaatcatgtaagacatatcagatacatcaaaatcattgataattacccttgaatatactgtcggaacatgtgataaaaacctgtcagacaaatcatttaatgatggaatttccagcattatctctttatgtacatcattagccagtttatcaaatgcttcactggaagttattaaacctccatcataaacaacaaagcttctaagcaacttaggaacaggcaaactttcaggatgattaacatctatttggatatctcttggttcgcctatttttctaggtttaggcggttcaaaggtatcattttttatataatcttcatcttggcgtagtgcccttttaatttcttcagatttatcatattcagattgagcatagctgtgggaacgttttttaggttttctagtgatctttaaaggtttgtcgtaatttggagtgaacttaagattatttccaaaattggttgtagatttgtcattgctaactcttaaaactgatttagaatcatcttcctgattaaaatcaaaaaattcacttggagatgtttcataatactcttcttcaacatattctggaagatcatcttcataataattgtcaaaagtatctctaatttttaaaggaccattagaattatcagaatgtttattaaatgatggagctttaatatcattagattctaaaaattctttaaaaatagaagatgttttatcggcattagcatcaacaaaatagctgataatcataattataccaactattgcaataataaatccaacaaccagcaaaaggtctatcaaattataaacatttgcctcatatattatgagaaccccaactacaaataaaataaaacctgaaattaatttcaatgtgtttcccactatctcacctgttaataattataatcactctattaattaaattttgtataatacacttaataaatatgttgataaaaacgctatttttcaagagaaatttagaaaaaaagacatgataataaattttataaaaatagtaatattaatataatatgaaaaataattattactaccggtgataatatgaaaattttagaaaaaatcagcaatgacaaatcaggacaaggcgcagcagaatacatattattgtttggaggagtaatagttatagccattttcgctttaaccatctacaaatcatatatgcaaacaagcgacagcaatttaaaagtaaaagatgatatatcagaggttagaaccactgttcgtgaaaacaacagcatattaggataaaatgaaaacagacaacaaaggacaaagcagtgctgaactaattttaataattggaggtctaattgtaataattctattcattggaacatatatctccaacataacagacactactcaaaacaaattaaaaacagcaataacaaaagaaagaaattttttaataaataaaatttagaaagaagagcgtaaaatctctctttctaacttaaaagattagaagttaaaatatctctccaggattcggagttgatattatttaatttcattgaagttcttgtgacttccctaatgttttgtggacatgcattgacacaggcaccacataaattacagtaatctaaattaatagttgccttattgtcaataatttctactgcatcacatggacaaacatcttgacatgcgtggcaggcgtcccctttacatgttgattcatctgtttcaaccagttttaaagttccttcaaacggtttggttacattaattgtatcaacaggacaaacttctttacaccaagaacagtttacacagccatccttaagaatggatgcagtaccattaatttcaggagctttaatttgatcttgaagcatacatgttgaacatactgctttaattgcatcttgaggacaagccctcttacaaacaccacaataaatacatttggaagtatctacttcaatagtattattaagattgtcattagagaactcaggattattagttaaactaatagctcctgcaggacacatttctgaacagatactacagtaaacacatttatcctcatcgacactgatttcaccaataaccaaatcttctctagacggtaactctcttttaaataagatagtgtctctaggacaaacagaataacatcttccacagtatatacaatcatcatcattaatttctgattcaacttcccatacgggataatttcctgtttctttaatatcattaccgttaatggttaatgataaagcatcaaatggacatgcaacagaacataatccgcataaaacacaagtattagaagttacagaaactaaatccatttcaattaaaccacgtgcaatcggtacaataggtcctaatctcaaagaagatgtaggacatacatcagtacaaattccacaacctacacacctatcattgttatgtgataacttacgggtttcttccccgctcctctcaacattaaacataaaatccctcatgctttagatatagcttgattaggacagttttggatacaaaggtcacagtcatcgcatttttcagggacaatagttacatcgccatcttcttcaatgagagcgccttgttcacaaatctttacacataaaccttgtactggacaattttcaatgtgaccgcaaagatctgaatctatttttactgccatataaccacctcaaatttgatatgaaaattattttatgaaaaaataatattttaatatcaattaatacattgtcgaactgcatatataaacatgtcgatttaattcgataataaaatactattttaaaatatttccttttttattaatttcaccactcctaattcgtgtagacgaaataggatgaccatcatctgctaaaacaaagctaacaacaacaatatctaatggagacattcctttagaatctctaatttcattaatttcaactgctacaggttcagtttcttcactaacaacaattgcatcaaattcatcatcgaatacagttgtcccatatgcatcatctaaaaccataacagtgtaatttaatctgtccttaaaaaattccttaagacatctcatcctatcttcacaggaatcaatatctcccttaagaccaccaaaagcattagaagttactccgatttcaacctcttcacctaattcaaaagcagttgcaagtaactttttatgaccatcatggaacttatcaaaagttcccccaacagctattttcttatattttttatgatccataatattgtcctataattagtttgctaatataaatttatataaactattataaaatattagcgattaaaaaaaatcattttatggataaaaaagaattaaaaaaaaataaaaatagagtaataaaaattagaatggtaaagatgtataataactcttaaaagtaaatgtattaatattccaattctttattacacctaatgagtttctagaacttactggatcagcaactacccatgtatcaccaattaatacctgagcccatacatgaccaattgtaccacttgaaaaagtacagcttccatgaacatatcttgctggaagatctgctgctctaaataatgctataaccaaatgagcctggtcacagcagttacctcttttatcagttaaagtttttttagcaccacgactagtatcataataactagcataagctatattatcaataacataatcaagtattgcactagctttttgtgttggtgttgatagtcccgcagttaatctctgagctaaagcaacaattgtagggtcattaacttgacaattagcagtaggctgcaaatatgtgttaatattagccaattcactttcagtagcttttacattgaccctattgattacaaattgagaagattcagaatctattgacttaatagtaacataagcaggcagctgttgattattaccataaaatgcaacaacacgagcaaatgcatataccaaaccgtcaaaagttatagttcctacattagagggtactgatcctggagcttttccattagcatttacataatctataatagattgtgcaacactaatataatctgccagattacctaaattaccgcacttattgtagttatcaggattagcagcatctttagaatccaaatcgctgaaatcaccattatttatatttatagttgctatagctgcaagatataagaattgtgctaaagtataactttcaccatttattaaaacggaatctggcaatttgccctctgattcaataaatgattttacaactttagatgcatcaattatatttgcaattgagatagtgccagatacatgaatatatgactgtccgctgtttgagtaattaccgccaattgtaggataataataataagctatcggatagtctccttttcctaaagaatcaacagttattgtagctataccctcagcattagtaattgcatttttagtaatgccctcataatagaacttaatagatgctccactaattggattgcctttagcatcggttaatttaactgaaaaagttccattagttcctgcatttatgttaatatcctctgcaatgattatggttccattaaccaaaatcatatttgatccggaaccctgacaaaatgtatcattaattgcatatgaaatatcataataacctacattaagatgaatatttaatttagcaacacctgactgatcagtatatttagtataagtaattccagagactgtaaatagaacagcaatgccactaacaggtttcttatctttatcagtaactgtgacttcaaaagcagaaccgtcatttggcaacattactaaatcttttccttcaatatttaaagtttgtttagcaacgaccacattgtttgatccattattataatctaaagagcctttattggaataataatatgaaactaaataagttccaggatgcaatctaatatttatacttgctacaccattggaatctgttgtacgattataagcaataccattaatcacgaaagtaataatcttattagctaaaggtttaccatataaatcagttaatttaactttaaattcagaaccatcattataaaccatggttaaatcattacctgtcaaaatagtagttgaatttacaacatgcaagatactgcttgaactggaagaacaataaccctcaactccatcaaaaccataagttatattatagtcaccatttttcaaaccagaaatagtgatggtagcattaccatttttatcagtagttgcagttacctgtttattatcatatctgaagtaaacagttttattcccaatcggatttcctttcacatcaactaatgttacagtataattactattaatactatccataataacatatgcatctttaccaattatagtggtatttgaactactaacattaattctattagatacctcaagaccattataactacttgtaataatatagttatttggataaagtctaatacctaactttgcaataccattttcatcagtaatcttatcatagaatacaccattaacattaaacctaacagcagcatttgctaaaggtttaccttgaccatcaagaacagtaatggcaaatgcagtaccgtccctataatacatattaatatctttattatctattaatgtagttaatacactaatattataacccttagcttcaccattaggatgataagcagtcaatatataattaccaggataaagtgaaatagttaaatttgcagtacctttatcatttgttcttttttcatagataacaccattaatattaaacctaacagtttcattaattaatggattacccataccatcataaaaagttgcataatattgagtaccattcctgaagtatttaattatatcactactattaatagtagataaaacagtgatattataacccttagcttcaccattaggatgataagcagtcaatatatacttatcaggatataaagcaatatttaatttagctataccactaccattagtattgcgagtatagaaaacaccattaatattgaatctaacttctgcattaactaatgggtttccatttccatcaacaaattttgcataatattgagtaccgtttttatagaatttcacaacatcatttgcagatattgtagacaatacttcaactaaatttgtaactgaagaacttccatacaatgaagaacctgcataacttgctgtaatcttatattttccaacaaccaagttaatattcatagatgcaacaccgtcactaccagtagtacgattataaagtttaccatttattaaaaatgatacagtttgattagataatgctttaccagtaatatcagttaattttacatcataagtagtgccatttttaaaatacaaagttgtatcattaccacttaaaacagtgtttgaaacagaactttgaggttcagaaataacatcattgtttgaaatctgttgtgatcctataacattattattctcataattagatttgattactccgctgccggaatattcaccattaaaattataagaataattgtctgagatagatccattactagaaacttctaaattttgataagataattgattatcatcttgtatcaagtttgaattttcgatatcagaaacattatttaaatccgctgcacatacagaccctaacattaggaagaatgcacatataattgaaatgaacaatgctttatttatctttgaaatttttccacctcttagttctcattacgaaaattttaataaaaatattatattatactaacatatagtattcataatgagtaattaagtatttaggatttattattatataaatgtttttacaagtttattgataaaaaaacccatttaaattagctaaatcagtaagaaaatgattaaaacttttataaaatttaaattaaaaacaaataacattgaaataggtaaaaaaaggataaactatcttcaattcaaattcaaaaattaaacacacaatgaaaaataaatcttacatataaccaattagcatatttaaaatctaattataaggaagttttaaatacaaaatacattgaaaatttatttttataataaaaaataacatgatagaactcaagaattagaaaataatgaatttaagttaaatattctaaaaacaagtaaatttttcaaaaaaacctaaaaatttcatagttgattccatgatttacgagaaaaatattttccagaaaaaccataaaaatatagatttaagatttgggcttgcatatccaaatatctataaaacagctatgtcatcattaggttataatatattatataatttaattaatgaaaggcaagacacatggtgtgagcgaatcgtttatccccataccacttctattgagtcaaataatcctatgaaaaactttgatataatcagcttttctctacaatttgaagaagattattttaatgttttggaaatgattaaacaatcaggaatcccccttaaaagaaaagacagaagtgaaaatgatcctttaataatagctggaggaccatgtgcaactgcaaacccaatgccattatctgactatattgatgtgtttgtaatcggtgaaggagaatttactataaataaatttttagacagataccttgaaaataaaaatttggataattttttagatatggatggaatatacattcctgaattcaacaataatgcaaaaatagctctcatagatgatatgaaaaatgcataccatataacacagccaatcattaccaaaactgacaaggaagattataaaactgtgttcagtgattcaattatgctaaatgtttcaagaggatgtacaagaggttgtagattctgcatgtccagctatctttacagacctttaagagaaactacaataaaagaattagttaacatagcacttaaaacacgagaaaatactaatttaaacaaaataacattaatcggagcagctgttggagattattatgatttggagggccttacaaaagctcttgaaagtgaaggttttcaaatagccacaccatctctacgtatagattcacttagccgggaaactttagaaaccttaaaaaaaagtggtttgaaaagcattacaattgctccggagtctatttcaacactacgtgaaagaattaataaaagcatttcagatgaaaaaatattttctgtaataaaaaatgcagttgaccttgatttcaatattaaattatactttttaattggaattccctatgaaagtaaagaagatatagaagagttagctaactatattgaaaaaatagcaaatatgcataaaaacagaaactatataaaattcagtatcaatccagttatcccaaaacctcaaacacccttacaatgggaagtttataattttaaagagattaaatcaaaaacaagatatttgaaaaagaaattaaggaaatataatgttaaattcgaaagtccgaaaaaagggttgattcaatatatattatcttgtggaaatagggaagttggtgcagttattgaaaaatctttaacagaagaggtaacattgaaagaatggcagagttacttgccaaattataatatcaatgatgaactaccttggtctaaaattgatattggaattaaatctaattttttaaaaacagaaaacagaagattaaaaacaaaaaagcaaactccatggtgtggagattccccatgttataactgtgggccatgcaactagaaaaaatttttaaattaaaaataatataataaataataatacttagtgaggaaaaaatatgataaatcccgcaaaaagaaccagtacaattgaattatcccagataagaaaaatgtttgaagttacaaatcctaatgctataaacttaggaatcggagaacctgactttgatgttcctgaaaacattaaattagctatggaacaatcaataaaaaataatgaaacacattatacaccaaacaaaggttatattgaattaagagaagcaattactcaaaaattcaaaaaggacaacaatataaacacaaatcccgaaaacataatagttactgccggagccagtgaagcattatatatgtgtgcacaggcatttattgagaaaaatgatgaggtaattttaccagatccaagtttcctttcatatgaagcatgtataaagttagctgacggaaaagttgttggagttaactgtgaaatggaaaatgaatttaaattaaaggcagaagatgttcaggaaaaaataaacaaaaataccaaagctgtaatcttaaattcaccgtcaaacccaactggagcagtgatggataaagaagatattaaagctattgcagatttatctatggatcatgatttcttaatcatatctgatgaaatatatgaaaaaatcatttatgataaaaaacattactcccctgcagcatatagtgacaatgtaataacaatcaacggattttcaaaaacatatgcaatgactggccttagaataggttatttaaatgccaaagaggaatatttggaagaactgcttaaaatccatcaatacaatatagcatgtgctaactcaacagcccaaagaggagcttatgaagcattaacagggcctcaagatacagttaacaaaatggttaatgaatttaaaaagagaagagacctgattgtatcaagattaaatgaaatgggatatgaaaccgtaaatgcacagggtgctttttacgtatttccaaaaattgaaaatcctgaagaatttgttaaaaaatcagctgaagagggagtcataaccgttcctggtgctgcatttggacaaaatggtaaaaatcacgtaagaatgtcttatgcaaactcctatgaaaatatagctaaagctatggatattctagaaaaaggtgagtaatatatggatgaatttagaaccaaaggcggaacaaaagcagcaattgttggaataggttcaaatactttccttactatttttaatattggaattgggatcatatccggaagttatgcattaatctctgaaggagctcatactttatcagatgttgcaacttccataattgcatatcttggatttagaataggtcaaaaacctgctgatgaagaacatcctttgggacatggccgtgctgaagctattgccggacttataatcgtattatttttaactatggtagcttatgaaatcatgactggagctataaacaaaatagtccatcccgaacttataacaaccccaagttatcttgctgcagttatggcattaattggaataggcgttaatctttgtataagcagatatattattgcacttggaaaaaaaataagaagtcctgctattgtagcagacggaaatcatcagaaagtagatattttctcatcagtagctatattggttggagtttttgcatcaaatagtggatactctataattgatcctgtcataggtcttattattggattatttgttttaaaaactgcatatactattggaaaagaaaatatagataatattatgggaaaaataccttctaaagaattgattaaagatattgaaaaagcagctaccaaaactcctcaggtactgggagcacataatattaaagtggaatatttggggtcttattccgttgtttcactgcatattgaacttgatgaaaatatgactttaaaagaatcacataaaatagttcatagagctcaaaataatgtgcttaaaaaagttccattagtaaaatcagtaacaatacatgcttgtccagcaggaatagaatatgaccataaacaagaaatagataaataaattaaaaaacgccgggaacgggatttgaacccgtgtgatcataagatcatcggattagcagtccgacgccgtaccaggctgggccatcccgacaatacataaaaaaacaaagtaatatataatctgtttaaacttattaataaagttaattgttttttataaaaatggcatgttcaaaagtggactaatctcaaaactacaagttatctaaaaaacccaactccaccccgtggttctacaagcatcaactgttaatggtagagctgctcccttccgggcctgacacattcccatatttaagataattaacttttaccctccagtaaaagtcccatcaccatcaatcctgtaggacgaagtttctatgtcgtttttcttaggctcataattccttaaaaagccgccttttgaacttcaactgcaccaaagggggtgtgtgcttacagaggacccctaaccctccagtctagccatatacatatatgaaattaatattatataaatgttaggtaaaaaatttcaattctggaaaaaaaacttattactgaaactaaaatataatccaatttatccaacaagaacctatgtaaatcccacatatataaaaacagaagtttaaaattcaataaccccaaataaaagatattttaaataaacaaacttcaaaatcaaaaaatcacgttatttttaaaaatatagcttagaaaataaaatactggaaaaaaaacttattacagtaaaccaataaaatttattaaaataagaaaaaaatagaaattataaaaggattttataatattaacttaattatgtctccatcggaaataattcctactaatttgccattttcaacaacaggcaactgatttaatatgtttgaatcaggagcgtgagactgcatgatttcaatagcttcctgaatagtattttcaggtgaaacagttacaacatctttaatcataatagatttaacatcagttcctaattcatatttatccaatattaaattatgacccaaatcagttgcagtgataatacctaccagttcaccatcatcaacaaccggcattgcacttattttatgttccataagttcttcaaatgcattaaccacatctacattagaaggtgtagtaattacatcagttgtcattatttcctttactttcttgtctaacatcataacttcctccatatttttcaataatgtcattaaccattatatcaatagtatatttaacatcaacattatcaataatttttgaattatgttttattgcctgatcaatcataaaagactgggttttcctgattaaatgaaaattactcaaataattatcaagtgaacgtttaacccatggctgtctgcatcttgaataaaaccgggatttgtgtgtatcttcatccctaacaatcaaggtaaataaaatcacattgcttttacggataaggtcctcttttatgaatcccggtactatatgaactccctcaataatgatacttattccttcttttaatgctctttcaataacagcttccacacctacattcacaacatccacatgactaataaaaccttcaacaacaggatcaggacctaaaagcggtgttctaatactctcatatgcattaaaactagatttatgaataacaggacttaattctttagaaactattttacgcataacctcacgtatcatatctgtactgattaagttttttaatcctaaacgactggccaattcaaatgccatagatgaagttccaactcctgaagctccaccaattaaaataataaggggctcttttgattttctaacatttctccacttgatatatttctctgcaagaacagggtccacataatttttcaaataattagttacaaagatagccaaatcttcaatagaaatttcagaaatattttcttcaagaagtttattttcaatacatgaagctatttcataagcttcatcatgtcccaaatcagtgatgtgtaaagaacgagccattatacctttcgaaaaaggttctttgtactcctttttaccaacagcacccttaatcataatcataataatcacaaactaattatttaattttagaaatataaatagatatcttaaattaatattaaataaaatttgtgatttgattttagccactaaaaaaaataataaaaaagataagtaagatatttactcatctaaagagattatattaattgtataatccgcaccttcaccaacatcaattaaaactgcaccattatccttaagcattccaggattagctacatctgtagtatttccaattttactaatggattttgcttcatgaatatgaccgcagatattaatttgaggctggaactcgtgaatagattttaaaattccctgactgccgacgtgatctccgctttcagttaaatcggcaccagtattataaggaggagcatgagtaaccaatatttttactttaggtacttcatcattagctacaaaatcataattagctaataattcataaacatccccatagattttattatcttgaatctcaccaggagtatcaaatggtgtaggattggaaccaccgtatccgaataaaacaacattatcaaaagataaaatgttattgtgtaaacagattgcatctgattctctaattgcattgcatattcctgcaggatcacagttacctggaacagccatcacttcacagtcacaatcaagtattttgccaataaattcatcaacaaactccaatgggccaaaattagtaatatctccagtgataatgacaatatcaatgtcattattattaagatatttgtataaattctcgttgtcttctccgtgaacgtcacttattgctaaaattttcataaatatcacttacttattctaaaaagaaagatcccatttctttcaaacctgttttaaggtcttctttatctccatgaagatcgacagtaacatcatcttcaaattcaattattagaccattccattcagctatttcttgaactctttcttcagccaatgcttttttcaatgttattctccctgttgttaatcccggaggagtgttaacaatgaatgttgaacgggatttaggaaattcaaaaacttctttaccatgcattgcatctttgaataaacctaaccatttgtcaacatattcttcaccttcttgtgaagctaattccaagagtgtttcttgaatactgtttaaagacatttcagctttagctaaactattaattaaatcaggatgagatgggtcttttttatatgagcttattgaagatctgattaaacctaattccggattaattcctttaggaatatcataaccttttttatttaaatcggttaaaagattaaaaacaattaaccaattttgctcagaaggtaaactcataaatgtccacctatgatttttaaggttgtgtgattaattttagcatcagcatcttttaattctttttcaatttctctaatgttattataagaatctaaaaataatacatggtggctatcagtaccggaaatacttaatatagctaaatcatcaccatcttttacttctcttttttcaatagttgctttgaattgtacgtatggttcgtactcttcaggaatatctggatatttaaatataccatctaatgttgctacaaacatattatcaccttaaatatacttaatttaaatcattgaattttaacaatcatatcttttatactaataatatataaagttaattacgaattattcgtaaaatataaaactaaaatttaaaatcgcaaatatgcaggataaaaaaataataaaattaaaaaaaaatctgtaaaaaatgaatgaaaaaataatttcattcaatgattaaaaccaaagtgtgttttcagtgcctaaaaaaatgaaaaaattgaaaggaaattaatccttacaattatttagcgttttcacctaatgctttagctaaagcaggagctgcatcaatagcttgtgcatctaaagttaaatcatcagctgttaatcccatagctaatccatataattgagctaagtggaaaacaggtaatgcgtagtcggttccgtatttatcatttacttcagtttgaccttggtcaaattgtaagtgacagaacggacatacattaacgatagcatctacaccagcttcagtcatgtgttcgagtttttctttagtgtagcttaaagttacatctaaatctctggatcttaatcctccacctgcaccacagcacatcattttgtcttcgtaaggtacagatttagcaccagtgatttctactaaatcatctaagatagatgggtcttctgcttgttcttcaataccgatttcagcagttggttttaagaagtggcatccgtagtgaacagcaacatttaagtctaaaggtttttcaatgagggatgctaatttttcgtatcctacatcgtctcttaagatttgtgcaaagtgttttacttcagtagttcctttgaattctttaccaacttcagataaaacttcattaatttctgcttttttgtcttcactttcttttaacatgtgattacattcagttaaagaaccgaaacaaccattacattcagtcataatatccattcccatatcttctgcaatggataagttacgagctgcaatggaagcccatgttttttcatcaaaagaaccaaatacaccaggagcaggacaacaagatgctccttccatgtcttttaattcaatatctaatgcgtcaaataattgtctggttgctttttcaataccagggtaacggttgttcataatacaacctaagaagtatgcaatttccatattaatactctcctcaattaaattattcttttaaatctccggttgctttatcataaccaattaattcatcaaaagcagtgatttcacatattttttgtacttcttctaaagcttctgggaatgaatgagtggttgcaggtaattctgaaagaccgattttggatcttaaagctttagttgcatcattaataggtactccgtgaccggttttaattacaaataaaccagtttttttgtgagcaagagccatgtaaccagcatgagcagcaacgttacgtgcttttttaatgatttcaacgattttaacacttctaggacatctttcttgacaggtgtaacaagtagtacacatccataaagcatcatcggaaattacttcttcttttaaaccaagtaaacatttccttactatttgtcttactttataaggagttcttcttccagaaggacaacttccaccacaggtaccacattggaaacaatgtttaactgtttcgattccagcatcaatgaattctgctgtaaattctttatcacgatttgcatcggttaataattctttatcagtcaataaagtcatattatctctctttttatcattatcttttgaaacttcgttttcaactttttcgtcgttaactacttcttcagactcatcaattgactcgtcttcagtttcagtggtgttattttcatcttcagaaacttcatcatcctcatttgaatcatcagttaaaatatctagttcgtcaagaacttcagttttttcctctgcatcatcaatttccggagcaatttcttcgttttcttcaacatcactagtttcagaagtcttaacgtcttttttaaaagtcatatcctcagtgtcatctgaactaattttaatcttaaccataggttcagtagttttagttcctgaaacaatactttcatcaagattgttggaagatgtaactttggtatcttcagattttaaatcatcaatacctttttcttcattatctttacctcttttaaataaagattttagattatcaataatagacattgaaaacacacctcggataatcatcggaatatattcctcaaatccatactaatattctgtcaaaaaaccatatataaaggttactaaatttttcaaaagtgtaagctaaaagattacactaccagttatattttggataaccttaaaatagaaagtaaaaccaatataatgttaagaaaataaatggaatgtttaaattgattgaaaaatttgaaataaaatcacatgatggacctggaagagttggaaaaataaacgatgcagctacccccaaattattttttaaaaatgatattaaaatagcaccttctgaagggtctgcatataatattgaccgtgaaattgcccaattcaatgttaaagaaactttaaaactagctaaagaaaatgtagataaatgcaatgtagctgtaattcaaggttcaaaatatattgatttaagaattgattgtctaaaacagttagaagaaataggttataacggatttataatagctaacagtgatgaattattattacatccgaaagatctaagcaatatgattgttaatttaagaaaaaatatgcacccgaccagctatttaatattttcatttgctgaaccatcatttatgcctcttttagcttacataggtgttgatggatttttagcggattccagcaattattatagttatttaaatgttctgttaactccaactaaaacatatgacctggaaacttaccccatttatgaaaacataacaagagaagaacttgaagaaaaaaatattgaagctcttaattttgtaattaaagaaatccaaactcatatgaaaaacagttcattgagaaatttagttgaagaaaggtcacttaccagtcctcaaaatgtttctgctttaaaaatattagataaacaacataaagattatcttttagaatacagtcaattattttaatactaaagtattaatcatatctttaaattctgtaactggttccaaagaagcttcaacagttctcaattcaaagatataaatatttccattttctataaacacataattgtgaatgtcaaagttgatatctggagtatccatatttgcatgtgttttaatagcatgttttccggcgatttcaacaaaatcggattctaaaataacaccaccatcatcactgatagcatcctccataaataacttataatcttcaatatttgttcttgttggaaacattacaacattaagtaaattttcttcccctttagacaatgtagctacacaatcaggattattataagtgtctgctttttctttttcccaggttacaggatatttgaatgttaaattagaagtattgacgtttctaaattccataatctaatctccctttttgtgtttaacatcaataggtgctgtttcatattcatcatcatctaatgtgtcaatatatttggaaaatggttcaggaagtttaggcattacttcctttaaaatttcagacgcatcaagttctaatgcctgacctgacaaaaactgttcgacactgaaatcaaactcaaaaggtttaagcaaatcctcagtaggtacttttaaattaatcttgtttttatttaatagcattttaatcatgcttgtctcacgaatttgttcattcatgtcatcaatagtactatttatctcaaatgctatagctttattcttctcatttacatcatgtttagctttagatatggatttttctaaatcttcaactaactgagcatttctcttattaatattgtctcttgcttcatcaatgacaacattaattgcattaagaatagacttgtttaattccacattgtaagctaaaatcatcttatttttataatcaagctctttaaaaatagctactctttcttcatctactttattaagttttttattaagttcctgaatttcatccttagctttaatcagttcatccttatcattaatctgttcttttaaatcgtccacattatcaaaaaatgaatttttaagtatatttatctgattatttaaatcggcaatctgattgtcttttttattaataatttcttcatactcgtttaatttatcctgagaaaactgattgccaaccaattcctcatattcttcacttgaaagaacacgaacaagatcattatcttcaaaagggtcttcttttttgagactaacctgtttttgttttgattccttttcaatagcattaccgtctttgtctttgctagtgtactttttagtatagactctgacagttctataatcatcattttccattttgaacacctattaataataaatacaacttattaatttaaatagtttatccaaaaaagtaagaaattaattaaaatccatttaagcagttacaattttgtttccaatttgcaaatcatttaacttactaccatatattttagccacagccaaacggatcaaaaaaaaaaataaaaaaataaaaatttaaagactttcattttcaatccacagctccattgcttcttcaacagctttagaataccaccccgtttcaaaaagcatcttggaagaagccagtttacgaaaatgcaagtccaaatcattattgatagtaatggttacacgtttgttttttgtcatgtataatagtactgtaacttattatacataaattagtaagtgttttttcacataaattcactaaacaaaaaacaaaaattacatcactttcctaaaaaaacaaataaaaacatttatatgtgatgaaaataaagtataatacgatgtgaagtaaaattcatgtcagacaatgaacatcagtcaaccattttataatctccaaaaatatattaggatatgtttcattgaatttaagaagtagaaaatccaaaaaacacgttctacttctctccccttattttaatttaaatttcatcaagaatttcactgtcagctccagctatctcaaccagatattctgcttcaacaatatgaagtttggaaggaataacaatacagtgaagaggtcctccaaaatcataatcaatcaactgactaattttaccggcttttacaacaacatctttagagcctacccttgcaataccaacagcaagagtatcttcagtaactgccccatcataatctaaagtatttttaatattcatcagatattccaaaccctgattaacagtcatgtaacggtctttatgagcttgaatatcaagtaaaactaaagtatgtaactccatagccaagttctcttcaatagctgtatatggagattttggatagaaattatgatcagggaaaggaatggttgtaaccttaccgaacttatagccttgaagtccggaaatagccggtgcagaagataaaatagatgatccgtgaatcacttcgtaatcaatgccttttttagaacattgaactaaaaaatcactgtgggtagtagctattaaaggatcccctccagtaattaaagctacatccaaatcaatagcttcatctaaaaatttactttcttcttcaacttcatttctaactaaaacttcaatttttttacctatctgagattcaatctcatcaaagctagaaccaaataatctggaagtgaaaaattccgcataaattttatcgacactttttaaacatttcaaacctttaagactgatatcgcctgcatcaaataatcctaatccaactaaataaaacatagtataagattttaaaaacatagtataaaagtgtttttttagaaaatattataataaaactaaaacaaagattagtattagaggtatttagtatgaaatcagttaaagttccattaaaagaattaaataacacaagaaaaaagctgatggaaaaacagttaatgaatatggattacaaaataaaaacagaagatgaatacggtttcataccaataaatactgatgctgattttaagtgcaattatgaaattgttgatgtcgaattagaagccatgaaaagatatcctaaaaacataagtgaactgcttaaagatgatttaacttctaaagaaattgaagatttaaaaacatcatttgatataatcggagacattgtaattgtagaaattccagagaatttggaagaaaaaaaatcaaaaatcggaaaagctacccttgaatttaccaaaagaaaatcagtttacatgaaaaaaagcgcaatacacggaacaataagaattagggatttggaacttattgcaggtaaaaacaatcctgtaaccatccataaagaacatggaacacgcttaaagctaaatgttgaagaagtttatttctcaccaagactagctactgaacgaaaaagagtaagtgacagtgtagaagaaaatgaaaatattctggatatgttctgtggaatcggcccttttcctgtagtaatagctaaaaacaataatgtaaacattactgctgttgacattaataaaaatgcaataaaatacttaaatgaaaatatccgcttaaacaaactacataatattgaagctatctgcggcgacattaatgaagttagtaaaaatctaaataaaaaatatgaccggattataatgaatctgcctgggcttgcttatgagtttttggatttggccatgacattaacagcgaataacggaattataaattattatgagttttctgattcctacggacagggaatagaacgcctgcaaaaagctgcaaaaaaagaaaataaaaaagtcgagattttaaatacccgcaaagttaaatccagcagtcccggaatgtggcatgttgcaattgacgctaaagtaatttcttagttatatcatcaatcaaaacataagtttcaataacccaaagacaaacaaatccaaatattgacaatataaatgttaccggattcatagcttggaaatttggcatcacataaggcattgtataggcagttaaattcaatatgaaatgaagaacaatagtggaagctaaactttctgttttgatataaataacaccaaataataatcccataaatgatgcataaactatttgaatagctgtattagtccagtctccgccaaaacctgtgataatatgagcacatccaaatatgaatgcagataatatcactgccttaacaatacctcctttagagttaccccattttttaagcatatttgtaagaataactccacggcaaagaaattcttcccacaaagctattgccgcacagtaaattaaagcagctaccacaccaaatacattaactacaatactgcaatcataggttgcctctaagattccggatagctgaactaaacagaacaataaaaccggaattcccaaaagcaatcctttagaaatccccctaacattccatggaatgtcctcaaataaccctagttttttagctataattattaaaataacaaaagcaaaaagattattaattgaagataaaacataatccattgcgggcaaactaagtatttccggaggcagtataaatattaaaccaattgttactgccccaaatccaaaaattacaacaaaagccaatgctaaaagtatgctgaacaaaataacatgcttttgtgaaaatttttcattaatatcaatcacctaaattggatcaataattccattttcagttataataccagtaataagctcctttggcacaatatcaaatgcaggattaataacttcagttcccttaggacaaatcctacatccgccataatatcttacctcatcgccgtctctttcttcaatttcagtgtcaaatacagaagcatccatgtcaaaagtagataatggagcagctacataaaatggaacatggaaatgtttagctgctaaagcaaccattaaagagcctattttatttacaacaccacctttagctatcctatctgcaccaattacaactttattaattttgtattgagacatcaaataacctgaagccacatcaggaattaatttgactggaatgttttcctgctgcatttcccaaacacttaatctggctccttgacctcttggacgtgtttcatcacatattacattaatattttttccctgatggaatgcagaacgaataacacctaaagcagtaccataatcaacacaggccagtgctccagcattacaatgtgttaaaacagtatctccatcctcaattatttcggcaccatatctcccaatagctaaattagtatcaatatcttctttatacatggttaaagcttcttccaatgggtcatcactatttaaaaccctgtcaactgcccaaaataaattgatagctgttggtcttgctgctttaatttcatctgcagcattatctaaatcttcaccatgcaaatcagccaatgccattccaaaagctgctgcaactccaatagctggagctcccctaacaatcatgtccttaatagctacaataacttccttataatcattacaataaacataagtcaattcatctggaagttttgtttgatcaataagctttaatttattatcttcccattcaagtgttttcataaataataccttctgttaattagaaataataaatctttaaaaaaaggaaaagcataattccccgttagtttctaatttaaatccattaattaaaaatataattaatagttttttaattttaaaattatgcttttcttcctaatgaaatatccattatattggaaattgattagagatgtaaaaatacatctacttatattttatatttgaaatattatatatattttaagattttattgaagaaaaataaaaaaataccaaaaaatattagtgaattaatttaattaatcctaaattttataaaaattaaaaaaaagatacaagataaaatcttgtatatcaattaatcatagaattttcctaagaattctttcattcttggattatcagaagcaaatacttcttcaggacttccattttcaactataaaaccgtcatccataaatataactgtatctgcaacctttttagcaaagctcatctcatgtgtaacaataaccatagtcatcttttcagttgctaaatcctttattacccttaaaatttcaccagttagctccggatcaagggcagatgttggttcatcaaagaataaaatattaggattcattgctaaagctcttgcaatagaaaccctttgctgttgaccaccagataattcacatggataagaatcttccttatcagttaaatctaactttttaagtaaatttctggcatccctgtaaacatcatctttatttcttttttgaactttaataggtgcattagtaatgtttttcataactgaatgatgagggaataaattgaaatcctggaaaaccaatccaaatgttccgtcaaaatcaatgattccactatctttggtttctaaaccagttatgcatctgagtaatgtagatttacctgaaccagacggtccaattatacataaaacttcacctttatccactttaagagaaatatccttcaatacttcatttttaccgaaactttttttaagatttttaatttctaataaactcatgatatttccccctaatcataataatccaatttttcttcaatgtattccattacaaatgcaacaattacattgaatatgtaataaaatacacccgctataagtaatgccataattgaagcttctgcagcagcaatttgcttagctactgtgaacatttctggaatagctattacaaaggacaaagatgtatcttttacaagagtaattacttcgtttgttattgaaggaaggactattttaatgacctgaggcaaaataattataaaaaatgtttctaatttgttataacctaatacctgtgcagcttcatactgtcctttaggaatagcttcaattccccctctgtaaatttcagcaaagtacgcagaataattaattgaaaaagcaatgattacagatatcatcctataatcaggagataatgaagcaccaaaaacataatacggtgcaaagaacactacaattaattgtaacattaatggtgtacctctcataattgagatatacactttcattaaccatcttaacggtttgaacttactcattcttccccaagctactacaagacctagaggaagtgaaaataataaagtgagtaaaaaaatttctatggaggtaatcatacctccacataattctgttattacagtacttaataacatatattattcgcctaatttatttccttataagagaatctttaatatcataatcactgtatttgtcagcaattttatcaatagtaccgtctttaaacatttcatctaaagtggattgtacttggtctcttaattcagtgttaccatttttaaatccaatagcatattgttctgatgatatattgtcatttaatattacaaaatcgccatcattatcttttgaatttatttggtaatgtgcaacaccaatatcaactgcaatagcatcacatgctccagattctaagtccataaatgcagtattataatcagctacttcaactaagtttccaaatgtatctgctaatgctttttgatcaccttgaagtgcagctaatgcagaggaatctttttgagtttctacatttttaccttttaagtcacttaaagaatcaatacctgaaccgtttttaacaacaataacctgtttgttatcaaagtaaggatcagaccaggtgtattggtcttctctgccattcatagtaaatccattccagatacaatcaatacttccggaatttaattcactgtctttagcatcccagtcaataggttgtttaactaaagtccaattgtttctgtcacaaacttcctgtgctacatctaaatcaaaacctacatactccccattgtcatctttgtaaccatatggaggaaattctgcatcaaatccaacaactaatgtcttatcatcgttaactactttactttccccatcaaatacgccagaatatgccgccacaccaacaattaaagctattatgacgattatacaagcgataattccaattttcttatccatattttaacaccaaaatatctattaaacatatcttaaattcttaaattaagtaaaaaatctaagctatacaataagttttatttctttaaatatttattattttatactattaattgctgaaaaaatgaatggatgcaataataaaaaaaatgaaaaaaattaattaaaaaaagaaaaattagtaatgactttgaggagtcattcctaaatgatggtcttcgctttttttacctggaataccataagcatctgccctacattgagtacatgctctaaatacaggaataatttcttcaacttcttcacgaaccttttccatcatggaacatcccggacgttcataaattttcattttatttaatggaataagtggtaaaacattcattaaagaagctcctcgttttttaacttccttagctatttcaacaatatgttcatcatttaatcctggaattaaaacagaattaactttaacaaccataccatttttagccgctttttcaacaccatccaactgatttttaattaatatttcagcggcttcgtatcctttgtaaactttcccttcatatttaataaatgagtaaatatccattgctatatcaggatcaactgcattaattgtcacagtaacagaatttactccaagttcagccaatctgtctgcatatttaggaagtaaaagaccgttagtactcatacattttattaaatcaggatgagttttacctagcttttcaaaaaactcaaaagtttcctcattcgctaatgagtctccaggtccagctacaccaactacagaaattggtccttctgcagttacatcatcaacatggctgatagcatcatctggtttcattatacagctagtaacccccggtctattttcctcatcatttatattcctagtacagaaattacagtaaatattacattttggtgctacaggcacatgagctctacctaccttatcatgcattttttcattaaaacatggatgtgctttagttatgtgtgcaaacctggaaccgttatgttcattcatataacatcactcccctacttgtaattatgtttgtatataatcgaactatattataaagttatctacaaacccctattcaactctgcaatatagtcattagctttgtcaatccaatcatccttaattaattcatcagtagctattactgccacaatatctccaacagaaacatctttaattattttaaatccttcaggcaaaattctaaagattgcatcataaattcttctttgaagatttgaatgaggatcatcaacaaccaaatcttccaattccatctgatttccgtcaagatcaatattgtatctggtcggctgataaagttcatctctagaatatcttctccacaataactttaaaatatttggaagataattctcattttcaataaatattttagtaacattattatttttatcataagtgaagttagccacatcaccaaatttaataactccagaagtctttttcattttaatagctaaaataaaaactgcttcatcagggttagcaaaagcttttaaatcttcaacagcaggaccaagaaccaaatcctgaaaaatctgtttaataatcatttcatagacttctgcgcctttttcatcatagcattctactaacatcaaatcaactcttgactatttattatcttgcctgtgacccattccagatactaaaagagcagcacctactgctccaatgtgttgagaatacggaggtacaataacatcaataccacctaacatttcactaacagcttcaacaagtccggaaattaatgatgttccccctacctgtataagaggttctcttaaatcaatttcctgaagttgttgttcataaacttgttcagctacagaatgacaggttgcagccgctgcatcagctttagaacctccagctgcaagagtagtaactaaatcctgaataccgaaaacaatacaataactgttaagtaatgcatttctataatccccctgtaaagcaagaggacctaattcttcaatagaaacatctaaacggcgggaagccaaatctaaaaatcttccagatgcaccagcacaaattccccccatagtaaagttgtcaggaataccgtcattaacagtaattaccttattgtccataccaccaatatccaatacagtggcttctcctttttgatgacctgccaaatatactgcaccttttgcattaacagataattcctcttggattaattcagcatttaactgtttaccaatatttatacgaccataaccagtagtaccaattccatcaacatcatcaattgtgtattcagtatctgcaaaagcttcttcaacacctttgtaaacagaacccataatatcttttgtttctgtccagccagtaccaataaccttattattttccatagctacaacttttgtagttgttgaacctgaatcaatacctaaagtaaggccttcctgtttttcacgggcaagaatacttctacgtgttacagtagtagctagtgcttccatacgaataaacaattcatccgcttttgttctttctgtaaatgaatatgtaactaccggaatacgggtattatcctgcaggaatttacgtactgcatttcttacaagagctccttctgcacatctgaaacaggaagcaataaatactgcatcaggtttgcatcttccttcaacaattgccattgctcttgcaatcattaattttaaacttgaactttgagcagaaaatccaaatttagcatatgattcatcaatataatccaaatcaatttccggaagaataatttctgcaccaaaagtattagctgctttttcaatttctttttgaattccactatattcagttccgcatgaaactaaagcaattttaaccattattattcctccttaagagagtctaaaaactcattaatttgatttaccattaaaaatgttccatccctattttttggatatgtaatttcaagtataggaatattcctttgcctaagcaggaatattgacaattcatttgttctagcacaacctacacaaccaaaaccaaatggagcaccatcaactaaaatagctgcttcagcttcatctatcaaaggacctataatggacattcttccacgaacacctgaaggaacttcaatagccgcgtatttaagacctttaatcgggtcttcttcagtaatattcattggaggagaatcaatttccggatctttaattttttgccttatttgtttttgaagaactaaaggagtgtgacctttcctttcaattaaatctgctaagattaatgaatttggaggataaatagctactttcaccatgttttcacctatcattattattttctaaacattcattcataatttttttaaattcatcaacatcaatcggtttttcaacctcaacttctacatcacgaggattttccaaagcatctgccacatcaccaagtaatctgtattcatcttccatttggtggaaaccttctcttggtccaaatctgtggcctctgcatcttctaggatctccaggagcaaaacctctttcttttgtgaaaatgtgattcggatccaattttcttatttcgcgaatcgcttcaaaaacatcctttgtttttccacttaccatagaaccgtaacaggtattttttattgtaagaggcaaatcaagcatatgcaactcattaacaatttcactttcactaacatgagctccaggagcaattataatcatacgggtaattacatcagggtcccaatcttccttatccaattccggactaatcgttagattccttaacataaactatctctccatctttaaatttttcaagtttagaataatcagagacaactttacctaaaatgtttgttgaactaaatgattctgcagtcggcccgaattctttattatcttcaaatcttactccgattaaaccaacattctttgcagccatattagttataccaatttcgcatgcttttacaatattttcaggagtattttccggaacaagaccttttgaagtatttgaatcaccttcaaatattaatatgtgcattccaggtactgaaaaatgaactttaattttaccaatcggctcttccaaaagaccggatactaatttaaagtatttgaccgttcttggagcattatcagtaaagttaatttcacataaatcatctttatggatggatttagttgtcacttttccctcatttaaaatatcaatagtatattttggagtctgctctacaattaaagcatcctcgccagttactccctctttaatatgttcaatgtttaaactagctaatttttcatcaatttcattttgattatgaccaagcaacattaatctgtcctgattagatttaatagttataaaatctccttttttagctatatcaacaatttccattccttttatgattttacctacattggtgtgatttggacttaaaaccctattttctctgtaaatatataattttccaacacccacaccactgtttctcacagtcacagttcctcttgttctggaaacgacattttctttaggtttatttattcctttcaactcataaaatcctaaaaatgactctgattcaaaatcaactttaattctgccgtctttaataactgaaaacagatgctcaacagaaaccggagaatcattgtcaacttccagtgaaacataagtaaataactcattgccttcttccaaaacagtgtccaaatcagatactgcagaagaatctgtagttgtgcttctctcaataataggttcaatagctttcacttcatcatcgtccgtcagtaagtttaaagtttttttaccaccaatgactcgtgcaaatattcctttattaaatggaggaacactgtaaacattagtagtgttttctttaataagaattaaatgtgtagactcattactaaaactggataaacttaaaacaacatccccttcataatatttatactcttcagaagtaggttccaaatcagtaacaacaggaccaatagccacttcatttgaagttgaccacctaatagacaagttttcaaaatccttatactgttttttccaaacatcaactaaaggctgtgcttctttagtatcaagaagttccaaaataactgatccttgcgttgttttaattttaaatttgctgacattcttttcaagttcttttttacccttaattaaacagataatactgccgggagtgtatggagcattagattcatcaataacatcttgaattgtagaaccttctgctacattcatttcttctccattaatttttattaacatataatctcccacaaagaattttaattaatatataaattttaaagcttataaaaataattattcctttttagatttaaaaaccggattggttttttgattgaaaacttccagtttttcaccatcgccattaaccaaatataaagaacactccccagtaacttcaccgacaacatttgcttcaatagaataatccttcaaatactttttaataaattcacagttttcctcatttgctgtaaatataaaaccagaaccaggatatgattttaaccaattttcccaactgatattttcatttttcggaatatcctccaaattgacaattgctcctttatcagatgtttcaagcaacatttccaaagttcctaaaatacccggattactaatatcctttccagatttaatataatctctttcagccaaatactgaaccgctgtaatttggtcctgaaccagttgtttatccttatcataagtagtgtcccaatttagttcaaacatttcatgaggtttgccgtctaaatcaatagcaacgatgattttatcacctacttctgctccaaagctagtgattaatttatctttctttgcaattcctacaatagctactcccaaagaatcaacttcaccatcaggatgtagatgacctccaaccataggcacaccaaacttcaaacagccgtctttaatacctgccagtaaattttcataaatttcatcatgttttactgacattatattaaccatagccaagggttttccacccatagctgcaatatcatttacattaacaagaacagaacaataacccgcccaatatgggttaacattcattatttgaccccatatgccatctgcagctattaaaactacctgattatttccaatatcaatagctgaagcatcatcaccaatgtcaattacaacatcacctgaaacattatatgattcagtcaaaagagaggttacagtatcaatagaagacttacgggtcactccctcaaattcttgaactgcttttacaaggtttttaaaatctgaaataaaaacaccatccatcatttttttagatatttataatattatatttgcaatttaaaagatttgttattttaatgatttcatccctaatttcatcaatatttttagaatttctggatttgactaaaatcttttcctttttaaaaatcaattcaaatatttttctaccaacaacatcatcagttccgctttcaaattcaaatattatggaatttttagctttaaaaccatcttcaacaactttatccaaatcaccatcggtaatcccgacaattggaatattgaatctatataaaatatctgaagctattaatgtagtatcatctccaacagtaactaccagatctgcatccttaaactgataaacatcctctccggcatggtctagaaaagctattttaaaaacatcttcagattcattttttttcaggactctaggttttaccttagattttcttaaaagccctgtttttacaatagcctttgccaaatcaactcttcctaatttttcaacaccgtgttcttttattgttccgccaatgatttctgtaatgtaaccgtctttggctatcaaagtgattttatcactatttgatttgccaataacaatactgttaaccattatattctcatcagggctaacaccatgcactattctttgaatcttagtatcatctattttatcctgtttaaaatgattgtcataaatttcttcaggagtgacaatattcaaatctaatttttgagacaaatcatcgactagatttttattatttccattccatgaaattatgcttccatcactttcaccgggcctttcaatttgaattaccggaatgttatttttatttatttttgagagataatgattataaaccttatagccaaaaacctgacctgttacatcagactttccatagtttattaaaaatataacatccacatctgcatcattgaataattttaaagagtcgcttggaactaattttttagatatgtcaataatatcttctaaagacccatcaataaccgcagttcttcccatagtcccacctaatctggctgaaacatcaccatatccagataataaattaattaactttaaagcccagttagaatcaataatattaggtccgtgaaccactacaccaatttccataaaaacaccgaattacaattttattctctttttaaaaaccttagatccgcaaacatcacaatcatcaaaaggataattttcatcaaattcttttttacaaccttcacaaacctttttccaattgtaaacacctttaattccatcagtcatgattccggaataaggaatattaataatttttaaagtattctgaatagtataatcatcacttataactttaatatttttgccttcatctctaagcattaaagctaaagctattaattttttatcaggaacagataaacgtaaaacatcccctgattttgatatgatttcattaacttctttaatgtatttttcaccaacatcctgaataattaattttccatctctaatagccatatccaatgttaattttgactcaaaatctttaacttcatgagtaatctcaggagcagtataattattatttgattccaagccaaaaccgttgataaaagcagatgcatctaaaacaaaataaatttccatgatttttattatgattttaaaaattaataaatattgtcaaatccacataacccattaaaaaagagttataatcaagttatcaactaattaacaaaataattaaaatttacattaaagtgtacaaaaaattcttaaaaatagcttaaaaaagacatgagtgttcaaaaattttattaaagaattggaggaaaattgggaacaaattggaggaaaatttgatgaaaatttgaaaaatctatttaaatctgtataagaaacttgatattatacaattattgtacaaaaattgaaaattggagtacatattgaaaaattaaatgaggcaaaaatgatgtcaacaaaagtagaaaatataaatcagaaaatacagtttttaacaaagtctggaatacgactccatatattaaacatactaagtaaaaatccccaaaatataaaagaattggtcaatacaacacaaataacttatagtaccctatcaagtaatctccacaaattacagcaagaaaaatatattcagaaaataaaaaacaaatattatttaacccaaacaacaaaaatgtacttaaatataatattagagtttaaaaatgcaataaaattaataaatcaatttgatgaattttgggataagcatgatgtaaaacagattaatttagattccctgaaaaatataaccagtttgcatgattcccaattaattaaaacaacccctattgacatttataaaactcataataccataaaaggacagctattaatgtcatacaacattaaagcaatattcccatatttacatcctgattatcctgttattattgaacaggtactacaaaaaggaggtaacgttgaattaataataaatgatgaaatttttgaaagtttaatggataatatagaaacagaaattaaaaagaaaagtattagaaacggatgtttgaaagtgcataagttaaaagagaatttaaacttatatctgattatatccgataaaaatactaatttgggactttttaaaagtgacggtagctttgatcagaacagacttctaacatctgaaaaccagcaagccataaaatgggctaataatctttttgaaaacgtaaaagcgaattggtgattattatggcaacaaaaattaaaaatgatttaaaagaggaatatcaaggtatcaagtatatacttacatcaacaatgcgaacaaaattattattaagcatttataatgaatcaaaaaacttagatgatttacgaatagaattagaaaagccatcagcaacaatactgcatggtttaaaagaattggaaaatttaaattttgttaaaaaagttcaaaaatattatcaattaacatcaaacggttatctgttaaccacaaacatgatcaaattaattgataactggtatgcaactaacaaaaacgaagatttttggaattcccatgatttaacagccatcccccaagaaaatcttaaaaacatttatcttttaaaaaatgcagaatgtatatcttctacaacaagtaatttatcaaaagcttacaatagctacaccaaattaattgaaaatgtcgaagaattaaaaataacattacctattttttcagaaaaccatttaaggcaaattgttcaattaatccaagaaaaaacactgcacaaacttgaattaatcacccaccaggacatactgccattaattcatagaaatccattatttaaaaaatggctgattaataatgaaaatgtaaaaataatttgcataaaaaatcctttaaaaacctttttaacattgggggatgaatttatgtcacttacattattttttaaagacgggcactacgatgactcacaaatcctaattgataaaacccatgaaggattgaaatggggagcattattatataatcaaacaaaagagtggagatggaaccaatgacaattaaaaagttacttcaccaaatctttttaaaaagaaaaggaggaaaaacttctgcaaaaattgtagatttgctgctgatacgcccatataacggaagtcagatagcaagaatcatagaaatggattacaatactattgaataccatttagagattttatgcaaaagcaaattagtaatgtgtgaatctgacagctatggttcattatactatcctacagatttactgctaaaaaatcatgaagaatacgaaaaaataaaagagatgatgacaataactgcataatataaggggatttaattatgaaaagtgaaacaaccgaaaaacataaaaaattatcatctactgatattacctgtggtgtaataacattaagtgacagcatcactacaaatgaagatgatttatccggacaatatcttgcagatgaaacatcaaaaagatacaccttaaaatccaaaataataatacctgatgacagggaagcattaattaagactattaaagaaatggttgatgaagatattgatgttatcttaacaaccggaggaacaggactagacagtagagatataactgttgaaactgtagaagaactttttgataaaaaaattgaaggcttcggtgaaattttcagacatcagtcttttttagaaatcggttcaggagcgcttatttcaagagcaacagcaggagtatataaaaaaacagtgattttttcaatgcctggctcacctaatgcagttaaaacagcatccaacatcataatagatgaatttccccatctagtattccatgcaaaaaaataaaaattttaaaatgatgaacttaaccattcatcatctttttttaattagaaaaattcgtcaacagttattaaaggttctaatttaacaccttcactatcaaaagcttcaatagctccttcctgcctatcaacaacaacaaaagctctttttacactacctccattgtcttgaatagctttaatagctttaagtaatgatcctccagtagttgtaacatcttctacaacaatgacatcatcaccttcgtttaattcaccttcaataagtttggaagtcccataaccttttttctcttttctaatcattaacaaaggaatttcagattcgagagaaactgcagtagctattggaaccgccccaagtgcaggacctgctactttatcaatattatcttcactaatagattttgtgattagtttagctattgttgacaggatttcaggatcagtaatagcctttttcatgtttatgtaataatcactttttttaccggaagataatgtaaagtccccttttaagaaaacaccattttcttttaataaattaattaaatattctttagtaatcatctaaataaccaaaatttaaatatcatcatcacttttaagtaaaattttatccccaataacttttacaagttcactaggaacaacattttcccctccagctttaatttggtctgcaataccggtttttttaataaccaaatcagttacttcaaaagtgtctttatccattacaacatcaacaactttaccaattaactcagcaccaccgtcaaggacttctttgttaattaaatcttctttaatcctcataaataatcaccttaattttttaatatgttttattataaacttcgatatatattaaatttttccaaattttatttgctatctaaaatacaaatactttcatcattttgcatgtcatgataaaattcaagcttattttcattgaattcaaaaattttaaccatatcatacaattccttatcaaattccggaataaattcacataatttatttggataatctttaaataaatttttattaaactctaacctgttgctattttcaaaaatagctccataatatatatccgtttcaactaaatcctggaacatatgacttccaaatgacaattcaggaacatagccaactttactgtaggactcttccagaatagcggaaaatttactaatgtctgcaaatactactggaattccaagttctggtgaagaagtgcctaacctgcctggaacaatcagcatagcttctttgtcatgatttctacagtaagcattaatagcgctgattaatttagctaatgaagcttttttagtaaatggatattcataatacttatgaggatcaacataaactaaaatatcaaagttctgttttcttgaccttcccattgaagaattcttaatatggaaaaatacttccccattacctttaggaatttcaacagcctctttagtagttgcaacctgcagaggcctgcactgcaacagattaataacaaaagaaccttcaggacctacatttacagtatattcaatgtcaacaggatagtcataagctgcctctaaagtttgaagcaattccttcatcaatgatgtaaatttatcattgttaactaaaccgttacaatttacaaaggttacctctcttctttgacccctttcacgaaatctgcgctctgcatcagtgtcatgttcaactactgccctttttgcataaattggaactacctcaataccttcatcaacagaaatttcacttactttaatattttttaaatccaaaacatccaaataatgctgagaatgtttatgcctctcaacaacacttggaacttccatagctttcggtttatccaaattaacaatacggggataatctctttgagtcctatctaccgcttttgtacctaaacccatgactaatcttaacattcccccattatgtcccatatcaggcaatggagaatatggactatacgaaaatccaactcctgctgcagaagggaagaaataatcctgataataagatcctgacactctctgaacaagtaaagacatttgttcatcgttatcatccaaatcatttaagctcctatactctaaagcagatatattcattgtacttgcatatactgttttaacagcttcttcaaaagcttccaaccgttcttcaatagaccctctattaacacagaaaacagactcatattttccggcaaatgcattcccaaaaccgtcttctaaaaaactacttgatcttacaataatcggactttgaccgaaataatccagaagccttctaaacttctcacgaatatcatcagaaaaagtaccgtttttcaaaccttcctcaagttcttttccagcctcgtaataaccttctttagttctttgctttacccgaatatcccacaaatcatttgaaacaatatatgtataaaacaaatcagaacatatgtaaaatgaatcatcaggttcaaaatcagcatagatatccggacggtcatgttctatgattttacgtgaaagcagcataccgcaggctttacctccaatcataccacttccaacaacacgattataaactgaaaaatagtcttcaggtgcaaaatattctttaactttctgaatcatgtttttatctttagtcatgagcattctgcacattaaatcgcatttatcagaaatatcctcattattttcatgctgtaacttggtcaattcaaagaatctttcccaactatctgtgttttgctcattatgataatcagcaaccctgttaacaaccttataaaaattacttacttccaaaccgtcagtcaatgttgttaaaattccttttttagtttcatatttatgacctaaaaacatattctgagaatatctgttccatactttcagaggatgcacatacacatcatccctatgagagtacaaatctaaaaaaagctgtgttgtttcacgaattttagctatcgcttcaaaagaatgcttacctctaataatcgggaaataagctacagtatcaagagaaaataaataagggcatgttactctaaagaaatttcccatcatcaaatcggtagaccatgcagcctgtaaatcagacaaacagtcaaatacataaaaagcatccctaccctcttttgtaatgatgttatgaacttccaaagtaaaaggttcaaactgcttgttcgggtccacatgataaattttaattccgtcacgttcaatcattgcaaagtcagtttcagaattattcttttcaacctccaactttaaaaaatcatcagcagtcatgtctattaatggctcatgctgaccaaaatttatgtaaatcaggtttttattatcttcctgagcttgtttaacaaaaggcttcacaaaatataaaaattcatctaaattagaaacttgccatactacattatctcctaaacgaatattatctaaggtttcgtctagctgcggaataccggattttattctttcgaaagcaaccatattaaaaactcctaagaacattcaatttttcagctaaattttaacatcagttatatatatgttcaaagaagtattaaaatattgaagatttttataatatttgttccatggaaaccttttgaattttcattccaatattttcataaaattttatggcactgtcattgccttcccagacatttaatgtgacattatgacatccgatactttttgcatattccaaaacatactcgtataatgcagttccaattccttcatgccttgcattttcatcaacacacaaatcatcaatataaatagttttatggtcgcaaaaagaagtatcgttatgataattggttacaatacaaaatacataccccactaccttattatctgattcataaacaaatactggagtttcactattttttataatcccctcaagttcagaatcattatattttgttccgatatatttaaataaatccggacgaatgtctgaatgaactttctgaacctgaagcagcagttcattaattcttctgatgtctcttatacttgccagtcttatcatgcaatatatattactagctagtattataaaaaattaacttaaaaatttattaatccaaaactctaaaagcttctgaatacaataatccttgcagttattttctaaaatagaagcagctaagttataagctacttttttatccaataaatcattttcaacttcatcaattaaatgtaaaattgaagtggttaatgctacattttcctgttttcttgcagcttcctgtaatgattttataaattcttccttatcgtcaccaatattactataaaactcattaatatccaaatcatatcttcttaaacgagctaaaacactgcattgagattcttttgtaatccatacctgtcttttaatagcttcacttattgattcaataacacatttagctatcaattcaccaagtttcgaatgttttcctgcattggataatctgtttttggattccatatttgaaaaaatagctattccgtcagttcctgttcctgttgcaaatccatttgaaaactgactgggaattcttaaattgtttaaagctacagtttttgcttcagtagcagttactaatccattagctaatgttcctggttctaacgaaacattagttaaaacaattatattgattgttccaacatcaaagtgaaactctccattttcctcataatagcttgcactgtctcctgctcttgaggcatttactcttacacctgcagtagttattgcactgacttcaagatttttataatgttttgtaacaacacatgcattttccatctgggcggaagttaaaagacctgttgtaaaatcagaatcaattcctaaaatttcgctttgcctaagcagataatcatttatgctatggttttctaaaaaatcaatgttttcctgagataaataatggttgaaagctgttttaaaatcttttttgtagccgccatttaaatcagacgttgaaattccattcctgcaaactccaaactcaaccactatagagttttcacagatatatgctctgtctccagttgaatttttaaaaataagtcgtttagcttgcaagataataccttaaaaataaaaagaaaaaaagaaattaaataatttcttttagatttacatcattggaggcataccgcccatagcagcaggatccataccgcccatgtcagcatcacctttaccgctagatgcgattacgtcatcaattcttaaaatcatttcagctgcttcagaagcagattggatagcttgttttttgacacgtttaggttcaattacaccagcttctttcatgtctgctactttaccggtaaatacatctaatcccattacagcactgttttcatgagcagctcttaaatctactaatgaatctatactgtctaaacctgcattttcagctaaggttttaggaacaatttctaaagcttctgcaaatgcatttacagctaattgttctcttccactgattgaatcagcatagtctttgagttttttagccattgcaatttcaggagctcctccaccagctacaactttgtcatcttcaacagtagctgctacaacaccaattgcgtcttcaatagctcttacgatttcatcaacaatgtgtttggtacttcctcttacgaataaggttacagatttagctacactgcattcttctacaaagatcatttcttcgccagatacttttctttcttctacaatacctgcttcacctaaatcgtcagcagttaagtcttctaagttagttactacattagcaccagtagctctagctaatttttcaatatctgattttttaacccttcttacagctaaaatacctgctttagataagtaatgttgtgctaaatcgtcaatacctttttgtgcgaataatacattagcaccggattcagctactttatctaccatgtctttaaccattttttcttcttgttcaatgaaagcttgcatttgagcagggtcagttattctgatttctgcatcaacttcagtttcttttacttcaagaggagagttaactaatgcgatttttgcatctttaacttcagaaggcatacctgggtgtactctttctttgtcaacaattactccttcaactaaagtagagtcttctacaacagcaccgtcttttttctcaattttaatattatcagtgtctactgcaccgtcttcagctactttttgaactgcatctacgattaattttgctaatggttcacgtgctgcttcagttcctttaccagtcatagcagtcatagctactttaattaaagtttcttcatcaactgaatcgattgcaatatcatctaagatttcttgtgctttttcagctgcttgtctgtatcccattgcaatgattgttgggtgaatatcttgatctaataaagattcggattttttcaataattctccagcaatgattactgcagtagtagttccatctccaacttcgtcttcttgagttttagctacttccactaacattttagctgcaggatgttcgatatccatttcttttaagattgtaacaccgtcattggttacaacgatatctccaagtccgtccactaacattttgtccattccttttggacctaatgtggttcttacggtttcagcaagtacttttcctgctaaaatattgtttctttgagcatctcttccgacagacctgtttgttccttcaggtaaaataaaaattggttgtccaccttgtgccattaaaatcaccttttaaaattaatttattatttatagaacagtttaaatatcaacataaaaaataattatattgttgaataacccttctaccatatagtgagtttaaggttatataaatacttatcggttgtaaaaaatggaatatattgatcttacacacaaaataaaaaatgaactttcagaatacccgggagatcctaaaacaaaacttaattattttaaaaaagctgatgaaactgacagttccacattgcttaaattagaaactggactccatacaggcacacatatggattccccattccattatatcataaacggcaaaaaaatatcccaattgcctcttaaaaattttattggtaaagctagtataaattatgtggaaagcaaaagtaaagaaattttagttaaaaattgtaatttaaaaaattcaaaagaaaagatagccataataatcacaggatggagcaaatattttggtagtgataagtacttctatgaaaatccttacctctccgatgaattaactgagttaatcatagaaaagaactttaaaggaattgcaatagatacatgttcagtagataaatatggaaaagatacaaatcataaaaagttacttgaaaataatgtgtggattgttgaaaatataaccaactgtgataatttaaataaaactagttatagttcattctttattccgttaaatattgaagcagaagcttctccagtcagagcatttctaaaaaaagattaaaaatagattattttttattaaatcgctttttctccaacctaaatggaggagttctgtccatagtttcataagcttcctgttcttcctgaagctcattaaagaaattattgatttcttccaaacgtttaattttatcatctctggaagacaattctttttgaagactgatgtaatcttctttaggaatagtagactcccttaaaaaagacaattctttttgaagattaatgtaattatctttaggaatagtagactctcttaaaagagatacctcattttctttagcagtaatcatgttatttttttcagacaactcattatttttatattcaagttccctttcaagatcagaaatcctgcttttgaattctgcattattttctaatttgataacctgaatcttataatcatcaatagttcttgaaagtgtattaatttgagcatctttctcagcaatacttttaaaagattcgtttaatctttcattaacttcagcaagctcttttttcttataatcccttaattgctctgcaaaatattctttaatctcatcaagagaattgtttacataatctaattcataaattctatcttcctgatttttaattaaagcatccttttcctctagctgttttttcaaaagactaatttcatcctcagctttaaatttaataagagaaacttctttttctttgttaagaatatgattttcgagttcctgaatcttctgaggagtggtatctctagctttagctatttccaattcagttaaatcgaatttaagcctgtttagctccaataaacaatcacgaattaaattttgtaaggtttcgttttcaataccagcacctaattccatgttatccctttaattcaaaaatttttatcccaatatctagttgaataataaaaattcaaatattataactattaaagtattatgaaattcatactatttaaattaaactctaaaaaccaccaaaaattgaaattaaaactaaacagaaattatatgaaaaataaaaaaaatattagaaaaaataagaaaataaaaaggataaaattagagtattttatcattgattaattcagcatttaatacagaagctccagcagctccacgaattgtattatgcccaaccaatacatatttgaaactgttatcaaatgcttggtctttccttaaccttccaacagaaacagacataccattaccagcatttctgtccattcttggttgaggcctgtcaatttcttctttgacaattactggattttcaggtgcagagaacaaatttaatttttgaggcaatgctttgaaattagccattttttctttaacatcattaatatcaaagtcatcatccaactcaacaaatactgcttcagtatggccgtcaataacaggaaccctatgacatgaagcacttaatttgaaatcagcattggaaactttttccccgtcatagttacctaaaagatgtaatgtttcactttccatcttttcctcttcactgccaatataaggaacgagattatcaacaatagccatagaaggcacaccattataacctgcaccagatactgcctgcattgttgacactctaattgcatctacattaaaattatcaacaattggttttaatgacaaagttaaagcaatagttgaacagttaggattggttacgatgaatccatcccaattattttccttttgctgagcatcaatcatatccagatattccggattaacttcagggataactaaaggaatattttttttcatcctgtgagcactagcattacttgcaacaacataatcacgagcaaaatctttttcaactttagctgcaaattctgttggaagagatgaaaatacaatatccacatcattatccattgcatcagcatcagtttcttttacaataatgtccttaacagaatcaggcatttcattatcaagataccatgtagtagcatcctcatatcttttacctgcagatcttgaagatgcagctaatgctgtaatttcaaaatctggatggttatcaagtaattggataaatctttgaccaaccattccagttgcaccaagtataccaacattcaccatagataacacctattctaatcctaaaacatcattcatactacttacaatacctgattccgcatctggaatgtatcgaatagctctaattacacctgcaataaaaacttccctggtgtgagcacggtgagtgaattctattctttcaccatctccgataaacattacagtgtggtctccaacaatgtctccaccacgaatagcatgtaaacctatttcctctttggttcttttaccaaccattccttgtcttccataaactcctacttcttcagggtcacggtcaagttcattagctattacttcaaatgcagtcattgcagttccagatggagcatcttttttctgattgtgatgtgcttcaataatttcaatgtcaaaatcatttaagataggagttaattttttcaaagtattgaaaaatacatttaccccaatagacatgttagatgaaataactgcttttacatcattgtcttttacatttttaatattttcagccatttgttcatcagtaaaaccagtagtacctactacaacattaacaccacatgctgtagcttttttaactgtttcaactgctgcatgagctatggtgaaatcaactaaaacatctgctttagattcttttaatgtttcttctaatttttcagcaccgactattttaactccaagttcaccagcacctgcttgaatacctgcatccactccagctaatggagaattaggaatttcaatagctgctactacttccatatcatcttgctgtgttatttttctaataataccggagcccattcttccagctgctccggtgactgctactttaatcataaatattaccaacttaaattaaatctgcttcttttaaagcatttttgagaatttcaacattttcatctttcatatctgttaacggtgccctgagaggtcctgcaggaagacccattatgttcattgctgtttttgcaggtacaggattgctttcaatgaaaagagcgtcaattacatcaatcatttcgtaatgaagctcctgagcccttgtataatcatcatttaatatactgtcaaccattaaaaccatcctcttaggatcaacattagctgatgcactgattacaccagttcctcctaaagccatgattggtaaagtcaagccgtcttcaccagacaatatattgaaatcttcttcaagaccttcttttgttaaagctttataaagtttggatactttatttacactcccactagcttctttaactgcatccacaccatcaattttagctaattccacaatagtttcaacactcatgtctacaccagtacgtgacggaacattatatgctataataggaatatcagttgcatcactaatagcctgataatgtttaattaatgcatgctgttgtggtttattgtaataaggagtaattactaaagcggcatcagcacctaattcttctgcagatttagtcaattcaatagcttcatgtgtagaattactaccagatccggctactgtttcgactctgccaccaacttcatcaattaaaatttccactacttttctgtgttcctcatgagttaatgtagctgattcaccagaagttccggcaccaagcaaaccagttacacctttatcaattaaataattaatattggatctaaatccttcttcgtcaatgttaccatcatcagtaaatggagttaccattgcaacatatgttccttcaaaattcattttaaaacctctttaattaattcaagtgctttttcaccatctttccaatcgacaaataataccacagcagtttgagaggaagaaatctcaacaatgttgatatcgttttttctaagcgggtttgtaatattagaaataatgccaggttcatcgataaactcaggactgactacagtaatcatagctgtatcatcaccaagagacaatgaacttaaaacatcttcatcaattacccaactgtgtaataaatgatatgctttatcagaatcctttttttctacaaatacagttatagaattctgacctgctgaaatgccaaatatgttaatttcattttctgcaagacatgaagttaaatctgctaaaagtcccacttttttgagcatttcttctccaacaatagcaatgacagaaataggatttttatacaaagatacagtttttaacatgtctccttcaaaagggccagttatttttgtaccttcagaacttaaatcaccattattgaagttgataatttttgcacttataagcggatctttatattttagagcatgaggatgtaaaacctgtgctccatgagtagctaagtccctcatttcttcaacagaaatttcatctaataattcagcttcttctattttattagggtcagttgacattactccgtcaacatcagtgacaataactacattattggcacttaaacaatgcccaagtaaaaatgcagttacatcactgccgcccctcccaatagtcgtaatttcaccactaggaccttttcctaaaaatccgcaaataactgggataataccttggctaataagattttttattccttcgcattttttatcagttgttgcaaaatcaattttggcattgagtgaattggaatcagttataaccggccatttatcattgtatggatcgataaattctgcctttacacctaaagattcaatagctgcagcaaataatcttgagctagttaattcacccatagccattatttctgccttttgcttatcagttaaacctccaccaatagcttcattagacaattcaattaactcatcagttgcattattaactgcagaaacaactacaactaattgattacctttcatatattcatttaccacagattgcgctgcttttctaattctggagccatctccaaccgatgtacctccgaatttcgctactattaaatccattaatattcacctatttccataaaaatttcactagatttttgattaaacaaaaatacctaattatttatatgaataaacacattaataaacttttaaaataggttacaaaagaataaaattaaaaaaagtagaatgataaaattgaacaaaataatgataataataaaaaaaattaaaaaaaatgaaaaagacttattcttgagtttgttctaatctcacaagtcttgtaacatatccagcgattttatttcttaaatgtttagtacttacagtggaatattccataactaattttttattttggtcaaaatcagtagtgaagactcctttgtgagtttctataagctcttttgctaaacgtttaacaaatgaagttctaatattacccattaacattcctccttaaaatttctttttgctcatttttacttaatgtagttagcatatccatgatttgattactaatatcaacatcaatatggtttttttcagacaactccccaatttttttatgaattgaatcctctcttttcttatcatatacaggcatgccaatatagtcctttgcaagagctatatccatagcaaatgaagttctctgacaaattaaatcaaaaatttcattatcaatttcatcaatgcgttttctagagtctaaaagcactttctcggcatcttttttatctttaaaagattttagcttgtaattatttttcaagaaatcaccatcttttgataataatgataataatataatttattagtattatactatttaatactatggattatttgacgtttctaataaaaatttattttggtcatacataaaattattatcctataaactgacacccgatgttatcaacttttgtttcaataacccttccttcatatttggaccaagtttccttaatatcatcaattgcttcatcctcacatatagctacaaatgatgatccagttccagataaacctgaagctattgcaccaacttccaaagcatcaatagctatattggaatcaaaacctaaagtgtttgcataaattaaaccatttaaattaagtgctttaaaataatctcctgatctggccaatccgaaagctgtttcaacaagtggtgacagcactttcatacggccaacatcagaacttccggatttagaaccaaaattaggcatataaaccaaaacaggatattcttccattttctctttgatgatgaattttctatttttgttatctgtaacaacaactcctccaaaatatgaagctgttgcatcatcaaatgatccggttatagtaacttttgcctcaagagatgcatcaatagctaaattgattatttccaaatcatcaagaggcattaaattaaattcttctgcaataattttggaagatatacttacaacagcattagataatgcactgctgcttgataatcctgatgccatcggcagttctgattctgtcttaaaattcattccaaaatcatctgaagaaattccatatttttcaaaagtttttttagcacaaatctccatcaatgtagttggtgctccaacatcattagagcaggttatagaactattttgagtattggcacagcattttatatccaaacctataccaaaagcagcaccgaaacctgtagctattgcattaattactgttgctgaacctggagaccttactgattttttcattattttacctcatcataaggaatttcaactttactgaatattttagccctgtttcttgcatttgaagctaaattacttctaaattcatcatccaaaatcatcttatcaatagcatcagatatagtttcaggactgttcgggtcaattaacagccccactccaggagttataatttctttaattcccccaacatcacttccgataacgggttttccgcaggccagagcttcaattaaaaccagcccgaaactttctgaaaaagacggcaacacaagcatatctgcacatggcataatattttccacatcatttctggcccctgtgaaataaacatcagaaatattttctttttctgctttatccttaagctgttttaaaagaggaccatttcctacaacaacaagattataatcagttttagctatttttttagcttccagtaaagaatttacatttttacgtttgataatattgcctacaaaaagaacaatgggcttatcatttttaaattgtgatttgaactgagtatttgaattattattaaacttatcaatatccacagaattccaatacaaccttgttttattttcaattccaggaactttagtagctaatatttcatctttcaaagcattgcttactgcaaaaataacatctgccttttttaatacttttttaataataggcctcatgaaaaactgttttttatacatttcaaacatgtcagaaccatgtgcagttatatatgttttaataccatgtttttttccaacttcaacacttgctgcccctgcaggaaacaggtaatggccatggataatatcaatatcaacttcttttaataagttttccaatgctttttttgcatttatcttaaacatcaatccacggattccaggaatattaactcctttggttccgattacatgaataccctcaatatcttcaatatctttatgaggataagttattacataaactttatgaccttgttttacaagttccttggataaagtatgaatatgaacccctacaccacctacatgaggcggaaactgaccgaccattgctattttcataataaaaacctttcaaaattatcatttaaatagttaccttccatatcaaccaaaataacatttaaatctaaatcaaatctctgcatacatctctctttaatagccaatgcaatactattacaaacatccaaatgcaaattttcttcatctaaaatatccaacatgtcttcagttgttttagaatcatacagtttctgaagtgtttttgtatcagcaccgcaaatacctgcatgagtaatcattatttcccgtcttccgtctgctattgcatgtttggtgttaaaaattccaccggctattttaatcagctttccaatgtgaccaaagaaagtaaattcatcaattcctctttttttggcttcctcaaacataaaacccacataatttccagtctgaataatatgctgctttgtaatgtcaagttgctttaatgccaatttttcaccaatatttcccggaacaaaaaccagattatccaaatttaaagccaatgcaacatctatttgagtaacaatggaatttttataagcttcactagacatggatctggctattccagtagttccaatgacagatattcctccaacaatacccaatttaggattcattgtttttttagctatctttcgaccttcaggaattgaaattgttactttagctactttatcttccggcaaaatcctttccaaatttttcctaatcattctgcggggaaccggatttattgcatattcccccactggaatttgaaggccaggttttgttattttaccaacaccctcaccaccagttattatgacactatctccatcactggttttatccaataattcaacagtagcaacaatagccagacctacagtaacatcaggatcattataaggattcttatgagctacagcacaggcagaagaatgagataaccttttgcattcatcaattataatgtctaaagtttttttaggtgttttgactttgacacaatcaatatctgaagtatccaaaatagattccaaagctgcaagagaacaggcagtagctatagttccagtagtaactccagtataattttcatttgtcatgtttacaagttataaaaaaagaagataaaattaaatcaaagatttaactttattaacaagttcatctaaagcaggtgcaccaacaaatgccacttcatcattaatagctattgtaggaacagccataattccaaggccaattgctttttgcctattttcttctgaagcaatattacaaacaataatatccgcagcatcacctaaaacttcttttgcttcattagcaacattaactgcagccggacaatgaggacagctatcagatgtaaatacttctactttcactaccatggtttttatctcctattaaattaattgattgaataatttatgaaaacttatatataactgttagcacaagtttttaagaaaaattattcatcaaatggacactacaaatatttattatatatgaaaaaaataaattttaaatgattactatggaaaatttgtcaaatgatataaaaacaataataaatactgcttatccgtacataaaggaattcaatcccgcgcaaaaagcagtaatcgaatcaggatacttagaagataaatctaattatattatatcaattccaacggccagtggtaaaacagtacttggaattctgcctgctctgaaaactattttaaatggtggaaaagccatttatgcagcaccccttctttcaattcaaaatgaaaaagtaaaagaatttaaagcctttgaagaacatggaattaaagtaggcaaacacccatccaactccgatttatctgttatggtttttgaatcatttgatgcgcttacaagattttcctggaatgtacttcgtgaagtagatacactgattattgacgaattccatatgatcggagaatactcaagaggacccacattagaatcagctattacaagagctaaaattatcaatccaagtttaagaataattgctctttcagctactttaaaaaacatagatgaaattgaacagtggcttgacgggaaaactgtagaacataattacagaccagtgcctttaaataaagaagttttggatgctgaaatgttcaatacaaaaaataaaaacgatgttattgtaaaaattgttgaaaaagctattgaagacaattcacaagcattaagttttgtgtcaacaagaagatttacagaaagcttagctacctatgtcgctaaaaaaatagataaaaaaacaacaaaggaacaaaaacagaaatttaaacaggtagctgataaattactggaagttccaaagaaaaaaggatcacttccaactacaacctgtcttaaactggctgaagctgctgaaaaaggagttgtattccatcatgcaggacttttcaatgaacagaaagaaataattgaagatgaattcagaaacgggaatatactgatgattactgcaactccaagtttgatgtatggtgttaatttgccatcaaaatatgtggtaatcagagaccacacccgatggacaagcaacggtcctgcatcaatacctgtttttgattatgaacagatgtccggaagagccggaagaccgcaatatgatgatgtagggtattcctatttggtagctaaaacaatggatgaggcatttgacctggaagctcgttatgttaacggtgaaattgaattaacaaattcaaaattaatagacaacaaagatgccatctacaaacagattatagcacaaatcgcatcttcactttccaaaaaccttgatgatttaaatgatttctttggaaaaacattatacggattccaaatgaaaaacaatccatccatgtccatgtttgctcaggacagtttaaactgggagcttgaaagcgctcttgaattcctgcttcaaaatggaataataagagccaccccagaaggacttaaaacaacagacttcggtaatctaatagctaaatcaaactatgcagttgaaacagctgtaaaaattaaggaatatgtttcaactatggaaaaattaaaccctgcagaaatgatttatgcattagctgaaactcctgatttaccattaatttcatttaaaggaagaaaaagcaaagaccctgttcgtgacaaactgtctgaatgcggcctttttgcagttgatataggaaaccccgaagccactgccgtttctttaatcgaatggattgatgagcgaaatgagtatgaaattgaaaatgcatacaatgtttattcagcatctaccagaagatcagcttatgaagcttcccgtttagttaaatttgctaaaaacacacttgaagttcttggcaattattccaacctgaaagacatggattatttatctgccagattatattacggagtaaaagaagatataatcccccttgttgtaggagttaaaagacttggaagaaaaagagcaagacttcttatgaaaacattcggcgataatttaagtgaagccagtgaaaaagatttacaaaaagtagaaggtatcggtccaaaacttgcaggtaaagttaaaatatttactatgaatcattaaaaaaagaaaggatgaaactatcctccaccattagctgcactggaagatatttcaacatcctcaaacattttttcagagtttttaatggcttcaatatctatatccttatcatcatgataagttttagttttaaaatcttcatcatttaataattctaatttatttgcaagataccataaattagttttatcgattttaacccaggaagcatcattttccactttactgtcagtaacctcaccaacagttccagtatctacatatcttacatgtgatccaagatctatttccctatttcttgcatcaacaatcatttttaaaaacccctttttaagaatacttatttattcttctttttctacttcaactttttgagcttcaacttcttcttcagcttcttcaggtttaggtaattctttagctaaaataacatatccaccaatggtttcaatgtcttcgaaaggtacttcaagttcttctttagaaaatactcctttttttaaagaaacaatcatggaattgatagttccttctttttgatcaatatcaaaatcacttacagttccaacttcatatgcgtttttatctaaaactttagagtttaaaacttctttaatattcatagttatcacattatttttagatattttaaagaaaatatcttctataaaacagtaaatattataattatatcaatataaataattaactattaaatttataaaaggttagaataatatggaaaatgcttgtcgcataataattgaggacattttaaaaaacaagataaacaccagaaaagagctggaagtcaaaaaaagacagttatgtcgtgacttaaagctatccagatttatgagcaatgcagatattttggaatatgcaactccccaagaaaaagaaattgtttcaaacatcttaaagaaaaaacctacccgaacaatgtccggtgttgcaatagttgctgtaatgtgccatcctcatgaatgccctcacggaaggtgtttttactgtccaaaaaataacaatgcaccaccaagttataccggtgaagaacctgcagccctaagaggtagaatgtatgaatttcatccatatatacaatgttttaaccgtttgaaacagcttaaaaaaataggacacccaattgataaagtggaactcatcataatgggcggaacattcccttccagagacttatgttatcaggaatggtttgtatcacaatgtctaaaggcaatggttgattttggattgatacttaaaaacaaacctgaagacaacgaatacaatttagatcctgcagaaataaaatgctttgaaaaagatattcttaaaagctatgaaccaagcaattatgtacttattgatgatgttcaaaaagccaatgaaaattccaaagtaagatgtgtcggaatgacatttgaaacacgtcctgactactgtaaaaaagaacacataaatagaatgcttgattttggagttacaagagttgaattaggtgttcaaactttatctgacgaattatacactaaaattaaaagaggccatacaatagctgatgtaatagaatcaaatacacttcttcgtgacagtgccgtaaaagtagcaatgcatatgatgcctggattgtttgtaagtcctgatgaagatttaaatatgttcaaaaagctatttagcgatgataattttaaaccggacatgcttaagatttacccgtgtcttgttaccaaaggcagcgagttatatgacctgtggaaagaaggaaaatataatccgtatactgatgaagaagctgttgatttaattgttaaaattaaacagattcttccaaaatgggttagaaccatgagaattcaaagagacattccatcaacattaattgaagcaggagttcaaaaatccaaccttggagaactggtttacaacaaattaaaagaacatgacattaactgccaatgtatccgctgccgcgaaataggtcataaaaaaacaagtcaggaatatagtttagatgattttaaattatttaaagaatcatacaatgcatgcggcggtgaagaaacctttttatcaattgaagataaaaacgaagaaagtatcgcaggatttttaagattcagaattccttcaccaaatcactacagacctgaaatcagcgatgaaactgcacttatacgtgaattgcacgtctatggaaatatgattaaaataggtggtaaaaatccaaaaataggtcaacacacaggatttggagaaaaactattaaaagaagctgaaaaattagctatcaagaaaggaaaagatgaaatagctataattagcggaatcggaaccagaaattattatcgtaaatttggatatgaaagaaaaggtccatatatggctaaaaaattaatctgaaaaaatcaagacaaaagtattatatagattattcgtaatattactaattaaattacttatataggagtgttatataatgtataaaataaaaaactcaaaagagttagcaagccttatcaattgtataaacttaaataacatgataagtgaagaagaaatggaagaatatttagataaattgggagaactaaactttaattccattacaataagtccgacatatgtatcattagctaaagaaaaattagctgacagtactacaaaaataagtactgttgttggatttcctttaggttttgaaacaacagaaggtaaagtagcacaagcagctaaagctcttgaagacggagcagatgaaattgaagcagtaatcaatttaaaccacctaaaagatcataaatataacttaatccatgaagaactcagccagttaagagaacttttaggagataaaaccttaaaagtcattgttgaaatgcaggcaatagaagacagtgaaaaagcaagtattgcaaaagtactggaagaaaataaagtggatttcatcaaaacatccacaggattcattgccccagacaatatttattcaaaagttaatgatattaacataatccaaaaatatgcaccacaacttaaaattgaaatttatggtggcgtagatacatataaattagctaatcagcttttaacaggtggggctgatttaatcggcagtgacaacggatacgaaattgtagataaataccgtactttaagagaaaacactcaagtaacaccaaaaccaataagattcgattagaatcttaatccatcactttttttaaatttaaataaaaaataactttttttaataaataacaatattttaaaaaaatagtcagttcaaataaagataataaatattttaaaagtagttaatgccatgggccggacttgaaccagcgacatccagatcttcagtctggcgttctcccaactgaactaccatggcatatggaccgaacgagattcgaactcgtgatctcctccatgtcaaggaggaatcatacccctagaccaccggtcctatgcaacattacttattttatttaacatagtatataaagttatctgttacaataaaaaccgatgaaaaataaaaatataaaaaattgaccaagaaaatggccaatagatttaataaattgttaaaaagcctatttgatagctaatttgatatcttcagcttttacagtttttctaccagcgtggcgtgcgaaatttacagctttttgtgcaattgcgtcacctttttcttctaatgcttcagctaatgcaatttttgcatcatcactaattctttgtgcgccagcattttttaagatacgaccgactggtgcgattggtaattcactcataatgacacctccaattaaaacatagtaccatatagtatataaatgtatcggcaataatggctatttaccctttatacaataaccataaacataatagtatatcattttccaaattggaaaatttaaaaaacaaagttaataattgaagaacaaaaataagcaatgatagaaaaataaaccataacagaaaaataaaaaattattttgacacaacatcacccttaaggtaagtagctgttgcatcagtgattttaaccttaataaagtctcctaaattaacaccgtcaacaattactggaatataagaatctgttttagctataaatccacctttagaacctacttccacaacaacggcattttgaacagaaccaactaattctttgttttcttcttcagtaatttcagttttgattctagacaaattcctagacctttttttcatgacttcatggggaatttccttaagagaagatgaaactgcacctttcctatgctgatattttgacaaatgaatcaaacttggttttatatttctaagtaaatcaacagttaactggaaatcttcatcactttcagttggatatccgacaataatatctaccgccaaggtcaaatccggaatttcacttttaaattttgaaacaatatccagatactgatccagtgtatggcctcttctcatttcagataaaactttattgcttcctgtttgtacaggcaaatgaatgaaattatataccttcggatgtttaattgcatcaattatttcatcaacattatttaaaatgtttttaggatgcatcattccaacacgaacacgaaattctccatccaaattagccacttctttaattaaatcagacagtttttcgccactatcatatccgaaagcggcagtgtcctgagcagtaagctgaatttcaacagcaccatcatcaatagcttttttagcttcggcaactatatccttaatcggataactgtttaatggtcctcttgcaaaacgagtacagcaaaaagtacatgctcccaaacagccctcagctatttgaattatgtgaattaaagaaccatcagaaactttaggaaccccaactttactgtcttttgaaaatccgcactcacgaataaccctgccacaataagttccgttaactacatctgctgttttattaagttgatgaggtcctatccagctgcagtcaggagctactttttctaatttttcaggatcaatttcaaccatgcacccgcttacgataacttttttatctggaaatttttcctgcaactgctgaattttataaactaccttattttcagtcgggagctttacataacatgtatttacaattataacatctgccagttcaggagaatcaaccaaatcaatatgattttcttttaaaactccccccattatctgagcgtcggctttattgaatgtacagccatatgtgtcaatatatactttcatgaaacttactcgcttaatgttttcttaacaatatatttggttaaatcataatcgaaattattgaatttaacaggttttccataaactcttttaattacttcagctcttgcaaatccggaagtaattttacgttcctgtgttttaataacatgtattctaacaatgtgcttatcaattttaacaatatcttctgtagatatctggaaatccctgtccaaatccaatttatatgaatcgacttcaccatgcaaatcaacagaaaatcctatacgtgcaggaatttcaactgaattggcccatattgtaacaatatcttcaactaaagcttttttaacacgtttattttcagtttcaatacttgttatttcaacctgaccttcttcagtaagcaaactatctccaacagccaattcatcattaggggataattcgatgaatgtttttatagattcaccctgctttgaaataataaccctatacaattgaggttttttagatgaaacaacatttttaaaaacatgaccgcaatctacacattttaataaatattcttccgtaatcttctttttagatgatttctgctttgaatttaaaatatcaaaatcatcagaaccgcaaattggacactccattattaatgcctccaaaaaataaaaattattgtttttcttttagataatgattaacaagaccattatcttctaaaatatctaacataaactctttaaaaggttcaaaagtaactgattcaccagtagtttcattagttaatattccttttgacaaatcaatgtttataatatctccgtcttttgcctgaatatcacaaacaattactggcaatccaatgttaattgcatttctgtaaaaaattctggcgaaagatttagccacaatagcatctacacctgcagttttaatagctactggagcctgctctcttgatgaaccgcaaccaaaattttcatcagctactattatgtctccttttttaacattctttgtaaaatctggacgttctccttcaagtacatgatcagccaaatcttgaggattaaaggttctcaaatatcttccgggaataataacatccgtatcaatattttcaccaaaagtccatgtttttcctttaattatatccatatataccacttatttttggatttcatgaccataattttgtgctttagttgtaagaactatgcctctgtttccgacatactctttaatctcttcaactatgtgtttattatttttatcaaatactgaataaactgtaggtccaaaagagctcatacctacaccataagctccaatttcccttaatttatccgtcaaatccctgatttgttgagactgaagcgaaacttccacatttttaaatcctcttttttgaatttcatcaattgaatggccaaatgctggcaaatccctttcaagtaaaaaaggaatcatattcataaatataatgtgggaagtttgttccacttcatttttaggaacaggacagtaatcctgaaatatgtttacttccttttgaccgtttactgtatttttggaatcaagaataaccagtaaaatctcccaatcatcaggaaaatcatagtgagccaataattgaggaggtttagcttgtgaagcagatgatggtaaaaatgatgattttgattttaagctatgtccaccatctacaataaatcccccaaaatcaaatgaaaacacaccaattccggaagttcctccacgtccgataatttctcctaaagaatatccgtttgaataagcaccaatatgttcagcaataagctttccggttgataaacccatttgagttccagaacctaaaccagaatgaggaagataagctttatccactctaaaataaaatccttcgtcaatatcaaaatggtcaattactttttgtgctgcagaagttattttagatacacattcattacgaatcacatcgttaaattgagtattatccttgaaatcaacagtgattcctttttctgccggttctccgtataagacaaagttagggtctttaattgtaagacctattcctccatctatccttccataagacccattcatatcaattaaagttaaatgaagtcttgaaggtgacttaataatcatgtatttaaaccctcagtttttatcttcttttaaaggtgttgagaattcttcttccacactttcacgatacatggaattcatagtacagaacggaataattctaccgtctggagttgcataatgaataatacattttttaactctatcttcatcaaaattaaatggatccataaagtgcatacaggaaataagcatagcatcttttgaaaattctcctaaagcatcataagatcttttagtaaatacatttaacaatattttcttaatatccaaaccttcaggtacttcattagtattaatcaatttgggaaggtttttcacagcactagcttcaacccttttcttaattccaaatccacctttttcaagtttgtcggaatatttgtccaataattcaaataacccttcaacatcaatgaatttagtaataggaatcaaattgtttaatgtatttttcccttcagtttcttccataaacacataagtagctattccacagtgctgattacagtttaaagtaacacccggactttcgccttcaagagcaccgataaaacgtgcaaatggttctacagaagatggaggataaaaatcatcaacatttacatcaccatgagtttgtttagcaatctcattaacaaaatcaggaatagttatcctttgttcttcaacctgacttgcaggagttcttcctgaaaatgaaaccggctggaaattgactccataaacattttccctatgatcaaatgcaaatttaataatttcaccgatttgctgatcattgacacctttaattaatgttggaacaagaactacaccaagacctgcttttctacaattttcaatagcctgaatcttttgaggaagtaaatttttacctctgttattgatatatggttcaggagttacaccatcaaaagccaagtatactgtgtttaaaccagcatcttttaattcttttgcaaaattttcttttctagctaatcttaaaccattagtagctatttgaacatgagtaaaaccttcttctttagccatagctacaagttcgaccaaatccttcctaacagtcggttcaccacccgcatattgaatagctggagttggatgaggttttaaattcctcaggttccttaacatttccctaatttcatcctgtgtaggttcatacaaacgtccggaaacagccgcatttgcaaaacaaacaggacatcttaaattacatctatttgtaacatcaattaaacctaacacagtggaggtttcatggtcttcacaaagcccacaattattaggacaatctccgaatttctctacagaagggttttcaactgaagttattgtaggttcaaattgtttaaccctattataaagcttatcatcactccaatatgtatttacaaactcaccatgttcatcacaggtttttttaatcaagattttaccgtcttcatcaaaaacctctgcatcaagtggtttgaaacaaattggacacaaactttttgtcatttttattctcacaaaatcaccctttgctaataattaataaactattaaccattcattacataatataaatatattaactcaatttaatatttaaagttaattaatgttttaacattaaatataaaagataacacatacaaagataaaacttaataaaaaaatgaggaacatatatggttgataatacccaaatttttataatggcttgtattactatcctatactttatattgcctgcttatgtgtcaaacggttctgcattagtctttggaggaggccttcctttagatttcaaaaaaacagacaaaaatggcaaccgatggataggtaacggagttacatggagaggattaatcggtgggacaattatgggaacccttatgggagcaattcagggattgcttgggccaataatacttgaaaactttggagaatttatttatactcccatctgtacaaatttagtagaaggaataatagtaggatttttacttggattcggtgcaatggttggggatgcagtaggaagttttttaaaaagaagagtgggaattggacagggaaaacctgcccccattttagaccagattgattttcttattgttgctttaatattcagttcagtaatggtaagcttttccataacaattattgcaatagctgttgtattaacattgattatacatttagtggccaataccggagcttacttaataggaataaaagatgtatggtattaaaccacacatttaaactttttttaatttaaaaatttgttcatcatcactgcagtaccaactgccggtgcaacaacacattcttcatcagttaaaatggtatccatagatttaacttcaagacctaagaattctgcagcttttttatctaaaatatcttttccaagaccagtagttacaattaaatccaaattttgagtttcagatacctgttttaaagcatctgcaatttgttcaacctgcttttgatgagtgaatttagctaattcaacaacatcatcttcacttaatgaatccaaatcagcacacaatactcttgctattcttttcatacaactttttttagacttgttttcaccatcaaaagtatcgcaaacataatcatctaaagttattaaatccaaaacagtataaacatctgcagtttgtgcaaataactcggaagctaccctgtattcttttccatgtaactgaaccttatccaagaagctggccaaattggttcttaatgttcctgtatataccagttcgccggtagccagtctttcaaaatctgatcttccaattgcacattcttttccgtctttaattggaataatatcagttgttgtacttccagtatctatgaaaatacaattatcacttattaatgtagctatttgggcagtagctatccagttagcagctgctgcctttaaaggagttttttcaatttcttcttttgataacatcccatcaattccaacataagctgtcggacactcaaaagtttcctcacattttttaacaacatctaaaactccgtctttttttgtatcatatgcatccaccaattctgcagtcatagatattcctacagcatcaatttcatcaatcggacaaatattttcaatcaattcagttaaaactttaggtaatgcttcattattgctccacatcggaagataagcaaaatccacttcaatattttttacttcattattttcaaaatcaacaactgccaagtcagtgtttgcaccgccaatatcaaaacctgctactttcattcttaaatactcctaattactaaattatcccctgattttttaaattcaatttttccatttaaatctattttttcatttaaatctttaatatctacatttttatcaatcaaatcaatgatagatgaaccaatattaatattggctatttttttaagacctgcgtaaggagtggtgaatctggaattaatttcaaggacataaacatcctcaatgtctttttcatcattgctgattaccaaatccacaccaacaaatccttttaagccatcaattgattcaactgctttaatggctgttttaaaagccaaatctttaaatttgctttcaaatgggatttgtccccctaaataagttcccttatcaccagttaaatctataatctgtttatttaaacttattggaatagctgtactgccgtcacaaagcaaactaacactaatatctgttccttcgataaattcctgaactattactctggaacctggaagaaatattttttccaaactataatccaaatcatcaatgccatttattattttaatattttcacaatccacaccaacaagaggtttgattataagttttaaatcatccaatggtttttcagcatgccattttttataaaggttttccaatgctcttttccaatatcccactttgtctatttttaatttaaaagttctaggctgtggaacaatattgtataacaattcataagaaacaaatttgtcagaggaattgtaacatgcttcagaagaggaattataaatttttacattattctcttctaaaatttttgtaatattgtataggctattattattttctgcagctatgaaaatagcttttttaaaactagctgcatttttttcaagccaggaaattatatcttcattaataaatattggtgtaacattatcataatcctctataatctccttgtaagattcattaagaacaactgttacattataatcttttaaatcatctaaaagtgaaaatattaaagcttctgcttctgaaataatacatttatctttttcaccggaagctgtaaaatattcgaacagtaaaattgaatcatcattgatagacatcataagtaatcatcataccttttaaatttaaattattcaatgggaaaatcattttttcaccatcaaaaaccatatgcactaatgcattttcattttcttcaaattccttaacagaaacatcttcattaatttttatcattttacggtcaaatgatgacattatattttcaggggctttaatatccaataaaccattattatatgcttcttcgattgcatcaatagttttaatagctgcatccccttttccataaggatttttagcatttttcattttatttgcaaattcttcatcattgagaatcttttcagcgttttctaaaatattatttttattagctcccaccaaaatatttccccctgcactgactgtttcaggcctttcagtattataccttaaagttaaaacaggaacatccaaagtaattgcttcttcctgaagacctccggaatctgttaaaattaaagtagaatgtgaagttaaaattaaaaagtccaaatatcccaacggtttaataatatggacattgtccaattcatttaattcatcaaataaattaaagttctccaaagtctttttagttcttggatgaatcggaaaaataatattcatgtctttaagttcttttaaagaagaaataatatttattaacctttccttatcatcaacattttctgccctatgcatagtcaaagttaaaatattatccatattttcaatgtccaagttagccaaagactcttcctgaattcccgctttgtttgctatttccaaatgcctgaaacaggcatcaactacagtatttcctgtaataaatagtttttttcttgaaattccttcagctaaaagattaattgcagattcttcagtcggaataaaatacattaaagaacaggcatctgcagccatcctatttaattcttcaggcatcgtaatatcaaatgatctgagtcccgcttcaacatgtccaacagcaatatgtaatttagaagccaccagtgctcctgcaagaactgcatttgtatctccctgaacaagaactatatccggtttttcatcaagcaaaacttcttcgataccctgcatcatcaaaccagtttgttttccatgggaaccagaaccaacgtgaatattataatctggagatttgatttccaagtctttaaagaaattatccgacatttctttatcataatgttggccagtatgaataagacaggaagttatacctcgcttttcaatttcatcaataattggagccattttaataatttccggcctagttccaagtataatagctattttcattttatcgacctatataaaattagttaatcatgaataataaatgttggttatttaaatagtataaacttctactaatacacattggggtgattattatgaccgaccttgataaagaaattgaagaaaaaatatacgatatattaaaaaaatatcacaaagacgaagactacaatttaaattatcttattacagatgatattgtaaccttctttttaagtataaatgaaggtaatttagttaccatggaagatttatacaaaatttcagggattttgaatgctaaaatcaaagacatggttcttgtaaatcaagaatacagattttcatttgaaatggaaaaatagaatttgggacatcttatttcccgaattcttcttttttatcaaaacttatttttaatgcagaattttttcataataaactcaagtaacaataaaaattacctgttttttagtttatccgttccagatcttccaaactttttatcatggattcccttatagcatattttctttgcaaatcgcctagtgaatcaactaaatttcttttaaagcgttcacaggcataatcatcataaacaaatttaaccccatcatatttaatatccattaaaatcagataatccggatccaaaactttaatattggctctagggtcattctctgcaggatttaataattcttcaactttttccaaagataacttcccaatagctacatcaacaaaaacacgcatcattttacgaaccatgttccataagaagctttccccataaatatctacaaaaacaggtgaaagtgtgtcatgcaaatttggaaattcctttttatgataatcattgagatttgctttggtgattttaatatcatcaattgttctggttgttgttttttggaatcgtttagtaaaattagtaaaattatgagttcctttaaaaatttcagctacttcattcagtttatacaaatccaaatcagacctgaataaaacataacgatactgtctcatttcagcatacctcggtttaaaaccaaatcttaccggagctttagccagtatctgaatatcatcaggcaaactgttattgatttcattaactctaacttctttttcagactggaaactgattacattacctaaactatgaactcctgcatcagttctgccggctattctaaatctggacttttttaaatcatcaatataacctagtttacgtaaatggtaaatcagctcttcttcaacagttcttaaatcaggttgtctttgaaaaccatgaaaattagttccgatatagccaatttttaaagctgtcctcttcataataatatattattataaatattaattaaaataaattttgcaaaaataaaaaaaagtaaaaggttattcaacaccttttaatgattcaaccatatttaattttctaatttttcctgaaaacattaagttaaccactatggataatgaaaatgttattataaaacttaacattaagtttccaggacttaaggttataggaaattggaatgaaggtcctgcagaatccgtcattgatttcattaagagataaccgaatggaattcccaaaacaaaacccattgaagtaaaccataaattttgcgtcaataataactttctcaaattatttgtttcaaatcctataacttttaaggtagctatttcccgctcaatttctgtaaatgacaacaatcccaaattataaaggacaataacagccaataatgctgcaaagaatattaaaatagataccattgaaagcattgattcagatatctcattccaatttgaaacagctgtatctaaagtatttactgctttgattccattataatctgaagttacattctgagatgtaacaatacttgttggagtataattcaatcccaaatcttcaaaataatcaggagtcattattaatccctgagatatagggtctgcatgaatagagcttactttggtagatacccatttgtcatttcctacaatatgccatttgattgtgtctcctttttcaacacccaaattatcagccatcttcatggaaatggaaacaccgtcatcaggaatttctgtcggatttctatgtttatctgttggagttaccaaactgcttttatttaaaaccagcagcgaacctgaatccctatggtcattaacatcaaattctattctgccttccattaattgagtacctttaacctcatcagttatgctgttgatttgactaattgatgcatcattatcaacaattaatttagaggaataatgattaatgtcttcatattcccagtcacgcaagtcattcattccgtcatacattccaaatgctgaaacaagcagtgcagtacatcctgcaacacctacaattgtcattagtgaccttgttctatttctttttgcatccctataattccagcgtgcattaaagctgaattttttccatatctttgacttttccagcaatcctgaaactgcaactttaggagattttggcctgattgaatttgcaggattttctttagaaatacttcttgttgcccagtaagaagctattaatgatacaccaaccattaatgctgcaactatgacaaaactaatactgtatccaacactccatccaggtaatgtataaacagcctgcattgattctaaaaacaattttggaatagtcaatggccccaatattaatcccaaaatacttcctgccaaaactagccagaaaccgtacgaaatatagtggagcattatagttctgtctttaaaacctaccgcttttaaaacaccaatctgagttctctgatgattaattatccttgccattgtagttaacagagttaaaacagcaatcaatatgaaaacaaccgggaaaatatcacccatcattttatgctgatccagttcctcattaaattgagaaacactttgatgatctgcctgttttacaaatgaactgtaatttccaccaataactgaatccaaatcagctacataatcattcggatttccattaaaatcaacaagcaatacattatactgtatttgtgctggaaatgccttataagacaggtaagcataacctgttttattgaaatctgtaataattgaagtatctgaaggagtataaacattttcaggagaataaccaagacctttaatttctttattaatggttaatccattaactgaaaatgaaatgttatccccaacatttaaatgtttagcatcggcaaaacgtttatctaaccacacaccatcttcatcatcaatatcaacatcttttccttcaacaagataaaatttagaaatatcattattttctacaaagtgcagcgtcacatcagggtcattatcaaaatcacctaccgaattaataaccagctgtctttcactggctgtagttgcacttagattatcaactttatctacagtagaattatccagatgactgctataaatccatccatccgctaaatttgtagcatcataataatcatttacactttgctcaaaaccagtgtattccccaccgattcctgcaaatacaaatactcctaaaaaagccattaaaaagattgaaagaaattgagatttatgatttttaatatccctaatcatctttttagacaacataaaatcaccattccaaatcagttacttttttagggttttcattaattgttatgctttcaattttaccatttttaattcttataaccttgtctgcagcttcagcaagaattgcattatgtgtaacaataactacagtggaattgttgttaacactcatattctgaagtaaattcaaaattgaaacacctgttttagaatccagtgctccagtaggttcatcacataaaagcatagacggttttttagcaacagccctagctattgaaactctttgttgttctccacctgacaactgtgaaggaaactgattagcatgcctgtccaatccaacagatgccagaactttcattccatcaatatcaacatctacaatatccttcataagttcaacattttcaagagcagtcaaattgggaattaagttataaaattgaaatatgaaaccaacgtttttagctcggtacttagtcagctgattgtcattgaagctttcaatattgtttccatctacaataattttaccactggtgacagtgtctaaacctcctaaaaggtttaaaagagttgattttccagctcccgaaggacctaaaataacaacaaattcaccttcttcaatagtaaaatcgatatgatcaatagctgttaaaatatgctctccggatttatactccttgaccacattttcaaattttacaatatcactcatattaaatcacttaataagatattaattaaaatattatataaaaatattatataaatatttagtcatacctaaatttattattggcaatatcatatatattttttccaaaaaagatttgcatttaacagtaactattaaaccatattaattataaaaatattataaaccaaaaaatttagtaatggagttataaatgtcatttaaaaaagatgaaatgttaataatgcctgcagttgatattaaaaatggcaaatgtgtacagctagtccagggacaacccggaagtgaaatgatagctattgaaaaccctgaaaatgttgcaaaacactgggaagatttgggagctgaaaatttacatattattgatttggacggcacgattgacggaaaaaccagcctcgatgtaattaaaaaaatattaaaggaagttagtgtacctatacaattaggcggaggcataagaagcattgattatgccaaaagacttctcgatttagacatagaaagattaattatcggaactatgggcattgaacatcctgaaaccataaccaaactgtctgatgaatacggatcagaacgaataatgatttcacttgacagtaaagacaaccgggttgtaattaaaggatggcaggaaaagattgataaaagtccggcagaactttcaaatgaatttaaagaacatggagctggaagtattctttttaccaatgttgatgttgaaggtttattaggaggattttatactgagccggttattgagcttaaaaactctgttgacttgccgattgtttattcaggaggaataaccagtatttccgatgttaaacaattaaatgaaagtggtgttgaaggtatcgtaattggttctgcactttacaaagataaaatcgatttaaaagaagctttaaaataccaaaacaggtagtgaaattatgaaaaaagtaatggcaacaggtacattcgatttattgcatccgggacatggaatttaccttaacgaagctaaaaaacttggaggcgaagacgctaaactttatgtagtaattgctcgtgattcaactgttgaaaaaagaaaaagataccccatagttggagaacaacaacgtttagagttaataaagatgataaaaggagtggatgaagcttatcttggtaatgaaaatggagacttccttaaaattgtagaagaaattaatcctgacataatagctattggtgctgatcaaagacatgacattactaaattacaaaaagctattaacaaaagaggattaaaagctaaagtggaacgtgtgaaagcataccacaatgcagaattagacagcagctgtaaaattattaaaaaaataaaaaaaatggatttcaaaggaaaaataaacgataattgtgattagtgaggtaaataaatatgtataatgtagcaatagtaggagcaagcggatatactggtggagaacttctcagaatgttattaaatcatagcgaagtagaagtaaataacattacttcaagaaaatatgacggaacacctgcacataaaatacacccgcacataagagattccggattagttttcaaaaataaacagccaagtgaattggatgcagatataatatttacagccacccctcacggagcatcaatgaaaatagttccggacttgcttgaaaccggaactaaagttattgacttaagcggagattacagataccgtgacaccaaagtttatgaaaaatggtacggattggaacataccagtgacattaaaggtgtttatggtcttccggaaatttacagagatgaaattaaaaaagctgatttggtaggaaatcctggatgtttcccaacaggagcaatattatcctcttaccctttagtagataatgatttggttgacagaatagtcattgattcaaaaacaggagttagcggagcaggagtaaatccttcaagtaccacacattacccaaatattgcagataatgtcaatccctacaaaatttcttcacacagacatgtttctgaaattcagcaggaattacatgggtttgaagatgttaaagtttcatttaccccacatttagttccagttattcgaggaatccaaacaacaagccatagcttcttaagagaagagcattcagacattactcctgatgaattaagaaaattctatgaaaaaacatacggtaaagaatacttcattaaattaatggatgatggagaaattcctcatttaagttctgttagaggatccaattttgttcatattggaggatttgaaattgatgataccggaagaattgtaatgctgtcctgtatcgataatcttgttagaggtgcatcaggtcaagctatacaaaatatgaacataatgcttggattagatgaaacaacaggattaaaccattttggacttaatccataaaatatataacaccctaaaacaaacaaataaaatcaaagagagggagataatatgaaaactttaataatttattattcccaacacggaagtacagaagttgtagctagaacacttgcaaaagagttaaaaactgatatactcgaggttactgatttaaaaaatagaagtggatttaaaaataaactaacttcctgtattgactcaattaaagaaacaaaaactgaaatagctccttctgaagtggatttaacagaatataattcaatctacataggaactccaacttgggcaggaaaaccaacacctgcaattataacattaattgacagatgcaatttaagaggaaaagacctatacctctttgcaacaatgaccggcagaggggggcaggctacagtagacagaatggctgaaaaagtaaaagcacgcggagccagagttattgaaacatttacattaaacacaaaggataaagatattgaaactttaatcaatgatactgaagtaattattgacatattagacttaaaaatgtacagtgggtaaattatgagtgttgataaaaaatctgaattaaaaattagagctattgaaaatggtacagtaattgaccatattactgcaaacaagtcattacatatccttaaaatactagggcttccagacagtgaaactaaaaatgttacagtagctatgaatgtttcatcaaaagaaattggtagaaaggacatagttaaaattgaaaacagagaattaaaccacgaagaacttgaccaaattgcattaattgcacctaaagccagtgttaacattatcagagactacaaaccagtgaaaaaagataaaattatactgcctaatacaattactggaattatcaaatgtaccaactcaaaatgcataaccaattatgcaaatgaacctatagctcctaaatttaatgttataaacaaccatccgccagttgtcagatgccattactgtgaaaaattaattaaaacagaagatatcgaaaaacaattcgaataatcttcaaattctttttttataagtaaccatttggttactaagttacccaatagttacaaaaagcttttaaaatacttcaatcataatattaattacatttattgcaataaataaccaaaaaaggaagtatatattatgaatgatgtaataaaatttttaaatgaaaatccattaatttatttagcaactgaaggtttagacggaaatgcaaaagtaagaccaatattatattactttgaagaaaacaacaaaccttatttttgtacaagcaataaaaaaccaatgtacaaagaattagaaaaaaatcctaactgtgaaattacaacagcaactgctgaatttgcatggatcagaataagtggaaaagtagagtttacttcaaatttagaacttaaacaaaaagttatcgaatcaaacgaactagtaaaaacattataccaaagtggagataatcctgaattcgaagtattcaccatctccggtgatgctacaatagctgacttttcaggaaaccctccaaaaaattataaaatttaattttaaatattaagagcttgtttaaaattgtttttaatctgatttttaacttcttcatctttatactcaacaaaatcagattcatctaaaataaatacagcaagctcatatattaccctatttaatttttttccatactctgttaaatgatattcgctagaaataggtgtcgtatttaaaacctttttttcaacaagcccgttattttctaattccttaagtctttgtgacaaaactttattacttaaatcaggtttatcttcttgaaactctttaaattgttttttaccaaaaaacatatccctaattaattggatagtccattttttattaaacaatacaactgctttatcaatagggcatgcgcattcagatttcataattaaagatatttatgtaaaatcatataaatttttagtttataaaaaaaatcagccaattaaataatcagccaatcttttagataatgccatgatagttaaaatcggaggttttcctggagaaattggtaacacacttgcatcatcaacaaacaaacctttaatttcagtttccaggttgctgtctacaaattttccaatagctgcactgccgccgggatgtgctcctctgtaaactgtagaagctattgtagccggattaacacctgctttttccagaataaaacctgcagcagctgcaccttcagccaaatacctgatatcattaatagtgtttattttaacaacatccccgtcatcagttatgtatcctttgcattcatcagatgttttaaccatgatactcaatatatctttaggttcagcatccccccctattttagacggaatgaatgatgagtaatgaggtgacagaacaaagtttttgccaacaacaagacccgccatctgaacttcagtgttgaagttaatgtcttttataactcctcctactgaaacaaagggatcaaagaacagttctcttccggcatcaatccctatttttcttaaaattaaagcagaaccaatagctccggcagacaataccactgtatcagagtgcaatatttcctcttttccatttttaataaatttgactccttttatccgattatcttcagttatcaagccagtgatttcagcttcatcaatgaattctacaccattttcaatagctatgtcaacaaagtgttttcctgtccattttgcatcaacaggacatccaaatgcacactgaccgcactgaatacatttttcttcataaatagctttcggcattttaatcggatttaaacccagctcttcagctgcatccaaaaataattgtgttcctttgcctatatgagtgtcatccaaaccatgaaccttaatcagattttcaacataatcatattcttctgaaagatcaattccataatcatataactcctcatctaatgccctaaccatgttagccattgaaaccattgttgaacctccaacacatgtagctgtaagcaaatcaacactgccattgtatttatcataataattaaaagcatctttagagtcaatatattttcctttttcgattatggttactggcacattagatttagccaattccattgctaatattgctcctcctgctccagaacctacaattattaccatttaatcaccttataacttttaaaaaaaatctataacatgagttatattttttattgtatttaaacacaaaggatatatttggaaaaagaaataaaaaaagaattccctttattacaacacatatattaaacttaaactctaaaaatagataataatatattatcatggatatgaaacaatgaatgaaaatcttgatttatttgaaaaagtcattaacaaaaccattcccaaagtagattatgtggatatcagaggcggaaacggaaataacacctccataatcatgaaagatggagaagtacaggaaatcaacacaggaaactctttaggtataagaataagagttttaaataatggtgcatggggatttgcttatacaaatgatttatcaaaattagatgaaatagcacaaacttctataaagatatcaaactcccttaaaggagatgaatcattgtctaaagcagatataattcaggataaagtatctactgatgttaaaatacctttcagtgatgtttcaatagaagaaaaaaaagaaataatgtctgaagccagcaaagctgccagtttaaaagaagtaaccagcactactgtttcctattccgattcacaaagccaggaagttatcttaagcagtgaaggtacaagcattgaaatgaacacaaatagggttgcaatgtttttaaatgctgctgcaagtgatggaaccatgatgcaaatcggacacaacagtattggtggagtaaaaggctttgaagctataaatgacgaagacattgaagcttttggaagaaaaataggtgaaaaggctgtaagattattgaaagctgaaagtgcaccttcaggaagattcccaattattgctgaccctaatttaaccggagtatttgttcatgaagcattaggtcatgcagtagaaggagatctgattttgcaaaatgattcaattcttaaagataaattaggaagcaaaataggttcagaaatagtcaatatctacgatgatgcaagtttaaaagacggattcggatattatccttatgatgtggaaggagttaaaaccaaacctaatcatctagtaaaagacggtaaattaatatctcttttaaattcaagagaaaccgcatcaaaattaaatatgaaatcttcaggaaatgcaagatcaataatagctgacaaaccaattgtaagaatgagtaacacttacttaaaacctggagagatgtcttttgaagagctgatagaagatattcctgacggaatttatcttaaaggctcaagaggcggacaagttgataccggaaaaggaatattccagttcaatgctgcagaaggatttaaaatagaaaacggagaaataaccactccgttaagagatgtttcattatccggaaatatattagaaaccctaaaaaatgttgacgctatcggcaatgactttgaactaagtgttggattctgtggaaaagacggtcagactgcaccagtaggtgacggcggaccacatacaagaattttaaatgctttagttggcggaagtagctaataaagaggtgtaataaaaatgataagccaagaacatggagaatatttgttaaatatagctaaaaaagcggtaaaaacttatcttgaaaccggcgaacaaattcttgttcctgaagactgtcctgaagaacttaaagaaaaattaggtgtttttgtaactttaaacaaaaataatcagttaagaggatgtatcggatatcccgaacctattgaaagtgcaattcaggcaacaatcagtgtagcaattgcagcggcatctgaagacccaagatttccgcaggtaattcctgaagaatacgataatctggaatttgaggttacagttttaacaaaaccccaattaatggaaattgcgcatccaagtgaatatctaaacaatatcaaaatcggcaaagacggattaatgattaaaaaaggatattcaaaaggattgctgcttcctcaagtagcaactgaaaataactttgatgtagaaacttttttagaacatacctgtatgaaagcaggaattagtgcagacagctatttagacgaaagctgtgatgtatacacattccagggacaaatatttaaatagtgataacttctggcaagaagtattaaaagcatgcaacgaaaataaagacaaataataatctaaagtgttatgtggaaataccatttatccacatcaactcttttaggctgtttttcattagctattttttcatagcctccagtgaatgccactacgcagtcatcgtgaatagcttcatttggatatgctgttattttttctaaatcattgatatttcataaatatccgaatattaatgaattgccgttagaaaatgtcgatttccatacacatttcgaagaatagtttatctttagcatctcaatgtcaaaagcattttttgttatcttgtcaagattgtcaagtcctgttttaatgtctgtaacctgttgctgaagaattgtatcaatagctatatttatacttcttgatgaacattaatgtcagttatttgtctttgtttatagagtgtattatattatttatacaatatagtcattgtattttttttcttcaaaatttcatcatgaaaaatcaacatatcttgttaaaaatctaattaaaattatttagaaatatgttcaaattatcccgtatgttctaataatagtatattttccctagaaagatttattttaaaatcttcaataaaattagaaataacatacttactgccattagttttataccaaaaaattaatttatttatgaatttactttcaatttcaggtgttgcatacacccataaacatttaaaaacatttaatgttttttctaatgaatatgatccataataaacttcaattattggaataaattttaataaaaaatcttggacaacattttcatcaatctcgccaatgtcgattacttcttttctaaaatactctgcgataaaataataaaaaggagccctacactcataaccctctgttgaaattggatttaaaaattgacagccatgtttcaagaatttgtttaaattaaacttattttttaaatatgtaggatataaaaaataaatattctttatatactctatatggaaattataatttcgatatacacctaagcaactgtttataataatgtttaaccaacttttaatttcatgaatctaagacattatccacaagtttaattaagcatcctagctaaagaatattatataaatattgaaagagaagcagtataagtaactgatatttaaagtgataacaatgatgatacctacaatacccactcctgatgaattacttgataaaggatttagcagagggaaaaagcaagcagatttaatgagaacacagaaaataccaaaacatctgaaaggaaaaagaattgaagaaagaagagttataacttcttgtcaggtaatcaaagacaaattaaaatccattttagatagtgttccggatatagaagaccttcccccattttatcaggattacattgatattactgttggtgtggatgatatgaaacaggctcttggaggacttaactgggcttatggtattttaacacaacttgaaaaagaatacggaagtaaaatcaggaaaaatccgtcagaaaaggcaactacccttcaaaaacaggcatacggtagaattgcatctgttgtaaacaaaatcaaaaaggatttggattttctggattttgcaaaagctaacttaagaaacatgcctacaattgactttgatgcaacaacaattgtaattgctggatttccaaatgtgggaaaatccacacttcttaaccagatatctggagcagacccccaaatagccaactatccttttacaactaaaggtattcaaatagggcatgtggaaagacattggaaaagtattcaaattattgacactcccggacttttagacagaccggttttagaaatgaatgatattgaattaaatgcaatagtggctttggaacatttggcggatgctattttatttattttcgatgcatctgaaacctgcggatttggtctggaaagtcagtacaatttattaaaacagattgaaaaaatatttgacaacattcctgtaatctacctatttaataaaatggatcttattgaagacaccagctatgtggaacagtatgttgatgaattagataactccattttcatatcagctattgaaggagaaggtattgataaaataaataaagttttagactctgttaaaaaaatagaaagaaatgaagaagaggaatattaaagatacctttatatattaaaagtccataataacaattaaatttaattaaacataatggagtcacaaatatggtagagaaagatataatcgaaaccaaaattagcgaaggcaaagaaaaagctgaagaaaaaattgacgaacacaaagaaaaggctgaagaaaaaatcaattaccgcaaggaaaaattaaacgaaaaaagggaacagacaaaaaatatggctggaaaaatgacagaagatttatccagaggctttgatgatcttcaagaaggtattaaatcaatccaaaaaataattgatcagaaaattgatgattataaaaaagcaaccatccacagcttagacgttgatttaatagaaactgaagaaaaatactacttgaaagtagatgttccaggtattgaaaaagaagaaattgatattgaagctggagacaaagacatctcaattgtagctactttcaaaccgtatactgaagaaattgaagaagaagataaaactgttttaatttcagatataaaacaaggaaaatgcagcaaaagcatcagattcagcaacaatattgaaattgataaaatcagtgcaaaattcaacaacggaacagttttaataactattcctaaattaaaaacaccaaaaaataaaattaatgtagaataaattttctacatatttctttttttgagtctgtaaaattttataggcttatttgattttaatgtgtttttcagtccaattttgcatttgatagtctaaaaatgtcaggattccatttttggttttgtatattttctttattttttcaggattggtttgtctgtagtaattttcgactttatttgatgttttttctatattttcatcatcaagatattctacgtatctgtggaagtgatttatgatatgttttcttatgaaatcttttaaaacaactggtatggccgtatatttttgtaaatattgtttaaattgttctattgcttctttttttgagttttgtctgaaacagttttttaattcttgtgcattttcgtaaatatggtctctttgttttccattaatcttgtttcttctacaatatacttttaatttatggtttattgtttgaaacagatgaaatatgcacaattgatgttttacttctatttcatctgctacattacgatacattgggaataaatcggttgttaggcaaatgaatggtttattttctgttgattctaagataaattttttcgtgttttttggtattctgcgacgtactattcgttctgtgactggaatattgagtattgcatcaaataaagttaatctgtagtgtctagttccattaagtcttaaaaattgctcatcatataaataatagccagaatattcaaatttttcattgctgatgctttcttcgtgatttttgtcagaccagttcttgattgtttgatgagatattctgattccaaggaatatttcaaagtatttacttattttacgaagtgattggtaccctattttcattattcctggaattttatccattatttcttgtaaaaattgtttattttcaccaattaatggattattgtatattccgaatttttttccacattttttgcattgatattgctgttctttgaattctgttgtttttccattagtattttgtttgtttttctttattgtgccttttttgattattttgtggcttccacaaactggacaaatgggattatcatatttaaaagtattattttcatctaaaaatagtttatgattagtattttcaaaattaggtgttttattcaatctttttgaaataattttttcttgatcaattttttcatcaaaaaaatcataaagtttaagttgtatgaagtctatattactattgagggcagatttgttttgtttggtcataaaatattatttgtcctcacttattaaagtattttactatttttaaatcatttatattaaaattaaagaaaaattagaatgaaatttcatcaaaatgaaagttcaactgtaaaaaattaaaaaacaaataagcctataaaattttacagactcctttttttaaaaaaaattaatatctgacttttccgatatgtcttgtagcaccaggatcttcaccattaaaatgtgccaaataataaacaaaccattctaaaggaactacaaatattaatggagataataacagattgatatctgcataatcttccaaattataaacaatagacttcaattctaaatttttagaaaattcaatagctttgtcagttatttcatctgattcaaaacctgaacgcaggaaaataattggaacatctttttctgcacgttctattaaaccgtgcctaaattccgcagagtaaacaggacatgcatgtttaattgctccttccataagcatagtcatagctaatttaaatgaaaggccgaagttaggtccgctgcctaaacagtagaagatatcttcatccttaaactcttcagctaattttttattgtcttcttctgttgtttttaataattcttcaataatatcaggaatatgtttcaaatcatctaacagttcatctgccttgccatagttggatcctttaaataaaatctgataaagacaggctaactgagttacatatgttttagttccaagaattgctgtttccctttcacattgtgttataattggagttttagcttcttttatcattgaactatcaggttcattagaaattgaaacagtgtgaattccatattcattagctcttttaagagatgctaaagtatctgcagtttcaccggattgtgatgtgaaaatagctattgaattttctccgtcagttaattttttattataataaaattcatagcctgtaaatacttctacactcatatcacaggacattctcaatgcatccctaacactataacatgtagaaatagaactgccacaaccaattaaataaattttatctgcttttgatacagcttctgaaacactatccattttagacatttcgcttgcaaatgtccttctaagtgaatcaggttgctccatcatttcatcatacattttatagttcattgcttaaactccttaaaattaatatataatacttatactattgtttattaacatataaaaatgttttttaaaaatcgatactttaattaagtaaatattatcaaacttataattatggaaataaatttatcttcagttggaatggaaaaaggaagacaatatgaaacagtaataactacactaagccctgagggcaaaagaaatgcagcgccaattggagttatatgtaccggaaaagacagtataatatgccgtatattcaaaggaagcaccactttagaaaacattatttctcaaaaagaatttactgtaaatattactgaaaatccacaactttttacactttccacaattgataaccttccagaaacttattttgatgaaaacaattccattaaaaatattgaaagctatttcaaatgtgaagttactgacttgatagaagctgttaaaagaagcgacccaattaaaagtgactcaaaagccattgtcataaaagctaaagttacctcacatgtaatcaataaaaatataaaagctattaaccgtgctatggggctgcttatagaaaccttagttaattttacaagaatagacatggttgatgagaaacagcaagaatattatctcggaagatttagggaagcaaaaagagtaataaataaagtcggatcaaaagaagagcaaaaagcaattcatgaaataaaaaaagaattaataaaaaaagggtattcaccctaatttttaattacatcaataaattcaaagtttatacagtcaaataaacctttatcagatattttgatagctggaattaccaaaagagccataaatgacatggtcataaacggagaatccagtttgcatccgaaatcagcagctgttttatgcaatttctctaatttttcagctacttcatgactgtcttcattagtcatcaatcctgcaataggcaatgccaaagaatcttcaaaatcaccgtcaacaatagcaaaaccgccttcattatcaattaaacagttgactgcatttgccatgtcctcactatttgttcctacaactacaatattatgggaatcatgagctacagaagaggctattgccccttttttaagattgaatcctgttataaatccgttggctattgaatttccaccataacgctcaacaacagctatttttaaaatatcctcttccaaatcaggctgtacaaatccttttttagtttccaatgttgcactttcagcttcagttattaattccccgttgaaacatcgaattacattaacatctgctgaaggttcatcacatgaaatttcaaaatcttcagattcttttttggaaacatcaaatgtatttttgaattccgtttcttccacatcaaataaaacattttcaccatcaaaaacacatttgcctgcaacatatgtctttaaaatattcaaatcattcagattatctacaacaacataatctgcctgcattccttttacaatagcaccagtatttaaattataatgtgttgacggattaactgtaaccatttcaatagcacttatcggactgacttccaaatcaatggcttttttaatggattcatttaaatgacctttaattaagtcagtggtgtgtttgtcatcacttactataaaatcaaaaataggaagatgtattcttttttccagaacttcattgggcatttttccgaaactttcgtgatttttccagtagtctaacctgtcgctaaaatcaaaaagagcttccatatttttagcagaagacccctcacgaaccattattttcatacctttttcttttttttcaatagcttctgcaaaattactgcattcatgatcagtagatatatgttcagccatatatttatccaaatcttttcctgaaagcagaggcgcatgaccgtctataggttttccaagttcttttgctttttccagtttggccaaaacttccccatccccatttatcacacctggaaaattcatcatttcaccaagtgcaacagcttcatcttttttaagaagttctccgatagtttcgctgtccaaaatagctcctgatgtttcaaaacaggttgcaggaacacatgatggaattgaaaaataaaaattaaaaggaacagattttgaattttcaatcatgaaatctatcccgtcagtacctgcaacattagctatttcatgaggatcacaaacaactgaagtagtaccgaaccttacagccagttttgcaaactgtgcaggagtaagcatggtactttcaatatgaatatgagaatcaataaatcccggaagaataatccctgaaatatccaattcactgtcgtcattaatgacaattggaactatctctttaaaaaatccgccttcaactgaaatacgtgcaggataaattgaatcagttataacgtctaacatatatgcactgaattgcatctaatcactttcatgtagggattcatataaaagaggtaaaaatgtaccaatatctgttacaatactaactacctgagcacttcccctgtcagataatttggtaacagtagcaggattaatatccacacagatacttttaacttttgaaggaagtaaattacccatagctattgaatgcaacatggtagctatcataattaccatatcaacttcctgagcctgtttacgcattaatttttgtgactctgcagtgtcagttattacatcaggcagaggaccgtcatcacgaatagaacctgctaaaacatacggaatgtcctttttaatacattcatacatgattccgccagttaaggtgccatcttcaacagcctgtttaattgatcctgaacggttgattttattaatggccctcatatgatgagtatgtccatgagctataatttctcctgtttccacttcaatacctaaggaagttccaaaaatattgctttcaatatcgtgagtagccagtgcattacctgcaagaagagaatcaatatatccttccctgattaaagcagccagatatttgcctgatcctgtgtgtacaatagcaggacctccaacaatagctattttacctcctttacttttgatttctttaatttcttttgcaattcccctaattaaattcatcaaaggtttttcagaagaaacatcactgttcataaattcaaaggttccacttttttctctggacctttgaggtggtgtaacttttattccgtcacgaccaacaacaatcatatctcctgccttaatttccgctatcggtttaactgatgcacgagaatttttttcatcaacacagattaaacaatccatctcaatgttttcaacaacaatccaattacctttatagagaatgtgagttgtatgatttgaagtagaataaaaaccttccggagcaactttatcttttgaagatgcaactaattcaacctcttttaattcagatattgatgcacctaatactgacaactcatctaaaatagaatttaaaaggtcgatagactctgcataaactgccatcttaaccttactagtatcagtttttcttttacctacatcaaattctaagaaatcaaaatctccacctttatccatgataatatccagagcttttggtaaagttaatgaatcaataacatgaccagaaagttcaattgttctactattcataatttttgctcctaattattaattattaatattgtaattttactttaagctaatatttaaataattccatattaattttttataagaaaagtaataattaactaaaaattttaaaaaataatgaacaaaaaataataaaagttaaattaaattaaaagtaaaaacaatttatcacaataatgataaaaaatcataaattatttttgaagcggaaactgcagtaatatctcccaatctgtcaccagctgtttcaacaacatccatcccgacaacattttttaaagataaagtttgaagcatagcttctatatggccatacgctattccgttgggagttgggttgcctacagtcggagcaatagacggatcaaaaacatccatatcaatagacaaataaattggagtgtcaataatactcaaataatattctatattatccagatgatgaaatacatcattatttttaaatgttgtgatatttgactggtttttaacaaaatcttcctcttcctttgaagctgacctgatgccaatctgaaccaattccttaacacccatttcatgaacccttttcatgacactggcatgggaatacagctctccaataaaagtatctgccagatccctatgagcatccaaatggacaacagtcagatcatcatattttttagttaatgaattaagaacaccaatagtcaaactatgttctccaccaatagtcagaggtttgatttttaaatcagacagttcgttaacagtatcttcaattatgtcacatgtttttttacagtttccaaaaacaacatttacgtctccgaaatcgtaaaaaatattgtccaattgtgtattaaaaatagtattatatttttcaaacccataggaagcttctctaactactatgggtccaaaacgtgaaccaggatgataagatgttgtactgtcaaacggaacaccaattattccccaagcaccctctttaaggttgttaaaatcagtttcttcctgggaaaaagcaaatttccatggttcatatgtgtttaaaagcataataaatcaaaaaagaactaaataaaattatttagttctcataattttcatatttcctaaagctacgatgtaatctacttcaataccttcagtgatttggtcttttaattcttcaggcataggtaaatctaaagtgtcgtagttttccatatccattaactgaacattgttaccttggatagataatacctgaccaacccttttatcgataattggaatatctactttggtatctacaggtttaacaatacttcttttttggttatcgaaaatacctacagcttctaatctagctttagcagcaccatgtttacctggggatgaagtagttaaacttgtgattttagatgcttccccacctaatacgatatatttaccaacttttaatgttttaatctctacaacttttgttgacattaattttcctccataaattaaaaaatagatttaaataagtaatctataataagaattattttagattaataataattctatccaacattttatataaattattcgttttaacaagtaggacttcaataataaatattaaatagaaattacaaatttaaaacaaagtgataaaaatgaaaatagctattgtatcaggaaaagatgagggtccaacaaggttaaatgcatttgacaatgcactaactgctgctggaataggagacgtcaatttaattaaagtatcaagtatgcttggaaaaaacactcaagttaaagacctgccaaaactcaaacctggagctatggttaattgtgtactttcttcagttacctcaagcaagcctggagatacaataactgcagttgttgcagtagctattggggaaaaattaggctgtgtagttgaaacaactggaacaaacaaggacccgcaggatttgattggtgaagctaacttcatggtaaactacatgatggaaaaacgtgaagtggaaattaaagatattataattgagtccgccagtacaactgttgaaaatatagcttcagttgtagcttcagttgtttatttgaatgatgaaataattgagggataaaatatggatgcgaaagataaaaaaatagctacagacctttgttacgatattataaaagaggtaggaagagctatcagaccatatgtcggaaaacctgaatcaggagaaaaagttaaaatgggggctgacggcactccaacatcatatattgatgttatagctgaagatcaagtaattaacattttaaaaaatgctcctatacgctcatacatcattagtgaagaaattggagaactgaaagttggatacggaaaaaaagaaagtgttgttttaactcaggaacttagaagaactgatttaactccggaacaaaaacccaaattcatattcttaatagaccctattgacggtacaagcaatgcaattaaggaaatacctgcatatggaatttcaatagctgttgcaaatgttcctgatggcagattagctactttaaatgatgttgaattaggttttatcagcaacttcggaaacggcaatttctttgaagctgaaaaaggaaaaggatgctggttgaataatgaagaggtgcacccctcagatattgtaaacatcagtgatatgtctcttggaggatttactaaaagcggaaccaaagcagcttccaaattagttgacaatgcaaggcgcatgcgtgttttaggttctgttgttttggaactttcatatgtagccagcggaagatatgatgcatttcttgatttgagaggcagcagaataatagatattgcagcttccaaattgattgttgaagaagccggaggaatcatcaccaacaaatacggtgaaaaactggacaataaattaagtatctatgaaagaacaattgttgttgcagcaaataacaatatactccacaaacagataatcgatatcttaaatgacaatgaaagtgatgttatcggagaagttggggtagtaagccgtgtagatgaataccatgcaatattattctctgtaaaaatcatagattatcttttgaataacggtattgatgtagtcattgaaaggacactggccagaaagcttgaaaaacttaaaaaagaccctaatttgaaaaatataattaacacaaccataaaagagcatcctgaattaaaggaccagttgaaaaatttaaactttaacattgaatttaaattgctctcacaaagtatacaagactttaaaagcgatatggcaattattcttggtggagacggaacccttttaagaacacagactaaaatgactgaagaaataccaatatttggaattaatatgggtacagtaggatttttaactgaaattgaagttaatgaaacatttgattcacttaaaaaaatattaaaaggagaatattaccttgaaaaaagaacaaaattagttgtttcccatgaaaaccaccattattctgcactgaatgaagttgttgtaatgactgacgaaccttcaaaaatgcttcatttccaggttcaggtagacggagaaatcattgaagaattcagagctgacggtcttatcatatcaactccaagcggttctacagcatattccatgtctgcaggaggtccgattgttgatccgaatgtaggaggatttatcatcatcccaatttgtccgtataaattaggtgtaaggccatttatcgtgtctgatgaaagtgaaattattgtcaaattacttaaaaaaggtaaaaccgcagtatttgtaatggacggccaaataaatgaggaagcagaatatcaggaagaaatcagattcaaaaaatcagacaaacacgtttacttcataagaaactcaaataaatgtttctataaaaaagttaaagacaagttaaatgagggaggcatcaacaactaatgaacagcctcgtaattgacatgactcacggaggagtgaaaatagccgtcagtcttgcaaaaaaagatgaaacagtctatgcctatgacatttacaacactttgaaaagtgttgataaaaaaatgttagcggtttataatgttaaaattatagatttggactatttaaaaaacttaaacggaaatttaagagttatctatcctgttcatttacctttaactaaaagagatattgaaaagtataatccctctttaaattatacttttttaacccatcacgaaataattaaagaacttctgaaaaactggggcaatgacattcccaaaattgaagttacaggagttaaaggaaaaaccagctgcgtttttatgcttaaagaaatcttaattgataaaaacccactaattttatccagcttaggtgcattattatatgaaaatggagtgaaaaaaacattaaaacaaaatatatcaattactcctgcaaatattaaagaaacaattgaccttgcatataaaatagctaaccctgtatgcgaaatagctgcagggaaatgcgatagccaaaatcttaaaaaatatgggtgtgcaatttttgaaagttcacttggagccagcggaattggagatgtagggcttttgacaaacatagttgaaaattatccaatagctaaaaataaaagaacagccagtgaagctaaaagtcagatattcaattgcagcatcgtagctatccaaaaagaaacattagatgaattctacaaaaacatcgaacataaaaagataaatactttttccctaaataacaatgctgacgtaactgttaaaaatatagaatatgatttggataaaacactgtttgatataagttataacaatataataactgccaacggtgaggtaatctccggagaatttaaggttgaaacatttgctccaggaaaacatcatgtaaaaaatgttttgggagttattgcaacttgtttatcattaaacattccaaaagaaaaaataatcaaaggactggccaattataaaggaattaaaggaagaaccaataaaaaaatcattgaaaattcaacaataatagaagaaatcaatcccggaatcaatacaaaagctattgaagagtccataaacatgataagaaatttggatgattattacatagccattggtggagattacggaataacatgtgaagaaattgatgaatctaaagtcagcacttatctggacactcttgattacaatatcattttaaccggagaagtaggtgaaggaattttaaaaaaaatgaataaaccggtaaaatattcaaaaaacttccaggatgtttataaacaagctatacacaacaataaaaacctgcttttgatttatcgctcagattacagaaaacttaataaaagataatcaaaaatgtaacattagttttacataaaattgaaacatttaataaatattagctaaatattataatttgtaatttaatgatagttatatgttaaaatttattattaaattagaaataatacttttaaattggagattatattttgaatgttggaacaagaggaagtcaattagcacttgcacaaactaatcaagtttgtaaagatttagcatcaattactaatgaaaatattgatgttaacataattaaaacaaaaggcgacaaaataactaattctcaattatataacatggatgcaaaaggtctttttactaaagaacttgataaagcattgcttgaagaagaaatagattttgcagtacatagttttaaagatttaccaactgaattagatgaagaacttgaaatagcagcagttccaaaacgtgtagctccaaatgaagtactgatctctaataaaaactgggatgaactaggccctaattccaaacttggaactagcagcctcagaagagaagctttttgtaattaccacaataaatgctttgaactcaaaccaattagaggcaatattgaaaccagaatcagcaaagttaacggtagcgatttagatgcaacacttatggctcaggcaggactaataagattaaatcttacacaacacataaaaacagtgtttcccctagattatatcacacctgcagcaggtcagggtgcattagccatcataacccgaaaagattctgataaaaaagaaattatttctaaattaaatgactatcaatcccggcaagaagtatttgctgaaaaacaagtgcttgaagaactaggtgtaggttgtcaatggccaattggtgctatagcccaaatgaaggacaaacaattttgtatatactcaatcctattaaccaaagaaggagaagttctaaaagaacatactgaaaaaggatcaataagagatgctgtccaatttggtaaaaaaataggaaaagtttttaaggattatgtttaattggaggaataaaattgagaacagtaaatgtaggagttattggagtaggtgcaatgggatacaaccatgcacgtgtatattataaattagaagaagctaatttagttgctgttagtgatgtaagtgaaagaactttaaataaagtagctaaaaaatatgatgcaaaaggtttcactgattatgaagatttactcaaagatcctgaaatagaagtagttagcgtatgtgttccaactaccttccaccatgatgttgtaatggaagctattaaacatggaaaacatgtattagttgaaaaaccaatagcttttaccctaaaagaagcagaagatatgattgctgctgcaaaagaagctggagttattttagcaacaggacatgtggaaagattcaatccggctgttcaaaaagctaaagaactcattgataatgatgttattggagatatcgtatctgcatctgcaaaaagagtaggaccattccctccaagaataaaagatgttggagtaactattgatttagctattcatgatttggatgtaatgaactacttatttgatgaggatgttattcaggtttacggaaccatgaacagtatcctggaaaaatgtgaatttgaagaccatgctgaaatcatgattaacttcaaaaatgaatctacaggaattctggaagtaaactggttaactccatacaaaaggagacaaattgaaattacaggaactgacggaatcatttcagtagactatatcgaacaaagcattgacgtatacggtaaattcgctcaggatattgatattaaacatgaagaaccattaaaagaagaattaaggtcctttttaaatgcagttgttaatggaactgaacctgaaattaccggtgaagacggtcttaaagcacttaaaatggtaatagctgctacaaaatcctccagagaacataaacctattagctttgatgaaattgaataggtgattttaatgaaacaaaaattaattaaaaaagctcaagagcttagacaacatggttttacaactggtgaaatagctgatgaacttaatgtaagtatggatactgccagatggttaactctccaaaaacctgctgaagaaaaaccagaagctcctgttgacttttttataaattggaaaagtttaggtggaaattcaacccgtttaagatatgtttccggagctttaagtgatatggcattatcacatggagaagctgaagtaattcttggaatagctgtcagcggaataccatttgcaactatgatggctgactttctagaagacatgagtggagttgaaacttcccttgcagtataccaccctcacaaacacagaaaagaaaaagacgacggcgaaggagctataagtaccaatttcggatctgttgaaggtaaaaaagttgtaattgttgatgatgttataaccagcggtaaaactgtaaaagaagttattcatgcagtaaaagaccatggtggagaacctatagctgttactgtattaatcgacaaatcaggactttctgaaattgaagaagttcctatcgaatctttaattaaagtaggtagattataaacctacatttttactattttttataaaaaaagaaaaagaatagtcataaagactaatcataattttaaattattcttcgtttaattttctgcgtttgtatccaacaaatattaacaaagcaacgattataattaatataatagaagcaataattgtattcggattacttttcattatatttttatcaatttcatatgcttttacagatttggagtcatcacctgcagaacttccagcactttttgcatttgatcctgaagaggattttgtgctacttgctggagatggatttccgtcaaggcttggactgtcactagatgaagtactgctatttgtacgaacagttccaccatatgaattggatcttgagtctccagtgtctgtatttgaattcaagaaattaatcaaagcatcaagtaaacttacacctaatttgttagaatttttatctgtactactagtgccgttagacggattttttgatcctccatcatcaccagataaatcagggacatccacataacctgcatcaccgtcaggtctatctggaacatttggatttttatcatcaccatcgtcaggagttacaataacactacttccgtcaccaggtttaggaagtaaaggatttctattagggaaatcagggaaccatggttttatttttgaaccatcaaccttatttgtcaaattgttcacattggtaggagtcgtataattaaattcagaacctccgtcaacatgattgtaaatttccgcataataatcaaatgcattgactacacgattattataatatgaagtattataaaattttcctttcgtattgaatgcatcataactggctttcgcatctttcctagtagatattaataaattatcaacaataaccgaattctcagcacttattagagaaatcgcatattttgcatcactagtaactgtattatttttaattacaaatgtatggttacctttagttgattgagaataacttataccgtacatattgtcattgtccttaacttccgcaacactatgaacttcaattgtattattaataatagtatcgttagaatcctgaacttctatacctgcaacaagtgcccagctatcattacctgccaatcctgtcacgttaatcttattatgagcaatatacaattgtgtatcaccataataattttgtgaatagattcctatgtttggcccgttagatattgaatacaaatcattattagttatatttatcttcttagaaggtccggtaatttgtatagggtatgcagtaccggcagataacattccgccagtagttaaaatagctatattattagaatctaatgtcaaactatttacacgccatacatcaataccataaagataattattaagacctgggaaagttaagaaatcttccatatacaaagtattgtttttaacaagacaatcatttgaatcggcaataattataccgtccaatgtagggaaaggacttcctggccttttattaacaatacttgcaacaatatttccgataaatgttaaattattactgtactcaatacctacacttgccacataattagaatttaaatcagctccaactgctccgaaattaacatccctcaacggaagctgagtataaatactgttatttgcaattaatgcattaggacagttacttacttttaaagcataattataggtatttgccttataattatggccttcaaagttgattatacagttaataacttccaaaccactaattggagcaattcttcttccaactgcagaaatgccgtaaccttcactatcacgaggaacattataatttataacacaatcacgtatatgcgtattattggccaatgtaagaattgccgcaccatcagcatctttgaaatcaaaatcattaactaatgtgaaattagctaaggtaacatctttaccattaatcaaaaatgcaacattttgcaaagtaaaattattacctaaaatagttacattatttgcttcaatttttaaaagacctaaattatcaaagttttgagttaatacaaatttggtattagaatgctcaacccccaaagtaccgtcaacaaaatattcatcgatgttaaatatggtcaaattaactgtatcagaatcattttgatcatcaatgtccggattatcaggatcaactggaaaatccggaatatctggaatgtcaggcacatctggaacttctggtgcatcaccaacaattataatattaggcacagtagtattttcacctaatgttgataaatcatttgcagaaacgcatcccataatcacgaaaaataacattaacaaagatgtaattattatttttcgacttaatttaatctttttcacctctttttagttttaataaaatcttttaaaactaaaataagtcattttataagattaaaaaaaacttatttaaagttcaaactaaaagacaattaagtatatgtaaaaaatagtttatatatttatccttaaaataaaatcaaaagagattaattgaataatctcttttttaaaatattcgtattgtgtttcctgtttggaaattgttccagcaggaagttatgatgtattctccatgcatcaatctaatgtttaatttggccataccgttattgtctgtgactttatagtaaaatactccgtttacattaaatgatacgttttggttagccagtggttttccctgaccgtctaatgtctgtgcagtaaagctgcttccgtccaggtatttcatgttcaagtttttagtaaccaatgtaggcaatacactgactttgtttccaataaccaatccgtcaaacatagttgtaatgatatattctccaggccttagagatattcccagacttgcaacaccattactgtcagttgtcctgtgataaaacacaccattgatgttaaaagtcacttccttatttacagccaagctcccatccttgttataaatggttgcttcaaatcttgaagcatttaaatagtacttggttaaatccttttgaacaatcaatgagtttacagtaataatattgcttgattgctcacctgtaacaagatttatcacagttataacatacttgccaggatttaagttaatgcccatcatagctattcccttatcgttggtggttttggtgtaaaagacaccattgatattgaactgaacgtttttgtttttaaggaaattaccatgagaatcagtaaatattgcataatattgtgtgctgtttctaaacattttaacaacatccaatcctttaacagttggttcaatagtgacatttgcatgcttggttattggagtatagtttaataatcctttaaatttaacaacaacagaatatattccactgtccagattcaaacccaaactcacactacctttctcatcagttatcttatcataacttcttccattgataattatttcaattgcagcaccaccaataggatttccctgtttgtctgttagggttgctacaaatctggtgccgtcatgataaatcattttaacatcaggagcatttaaaataacattgtaatcaacaggcaggacttcaaaaacaccagtatctacagctcgagaaattttatcagttcctttataagttgcagaatatgtgtatttaccaactgaaggtttttcaatgcttcttacaccaattccgtcaactacaacgattttataaaatttagtgttaatttccaaagttacattgcctgtaatcagctgaccgtccagagttttaagaattgcagtaactaccatgtcatcttcatatacttcaacatttaccttcaaaacacttacagtttgatttactgaaataaccatagttgtatttgagcttaaatagttattatcaccattatatgtagccacaacaacatatgaaccactatttaaaggtgaaataagccatgacgcattgcctccaacaatagtcttatttcttggtgaatataatcccaaaatcctgaaagtaacatttccagttgcatcatcatttacaacagcccaaatcctaacatttttattaaattctatttcaccagtgataatttcaatatttgaattagctttggctacatcaaatgatttttcatcagatgatttggaataaacagaatttcccaaataatctgccctaacactataagttcctgcatttaacttattaaaagtagctattgctttgccgtttataatttctactgttttagttaaatttccaaggataaaagtaacattacccgttgctccagaggttacactggccagtacagttatattttcaccataaacagtattgtttacatcaatgacagtttctgaaagtgaatttttaatattgaatgtcatgtcggcagtactgctgttgtaattagcatctccagaatacattacttttaaactatgatttcctaaagtcaaatcaggaattgcaattgcagctattccattattaagtgtttttgtatatgttgttccatctacaataaatgtaatttctcctgttgcatcatttggaagagttactgtaattacttcatcctgtcctgcgagaacatccttaatgtccacatctaattttggagtgcctttggatactgtgaatgtagctgtttttgatagtttggaattataaacagcttctacagtataagtacccagttttaatccgctcaaactatatctggcatttcctgagattacatcaacagttttgtttaaatgatttttaattataaatgtaacagttccgttaattaaagcattgaaattagcattgataattgcattttcaccatatcctatatcagctactgttaaattaaaatcaagaggtttgactgtaatggtgttgtatactgttgtataatcatatgtagcagatattgtgtaatttccggaagtcagattgagaggaagtgaagccttacctgcattatttgtagttaccttatatgttgtgccgttaacttcaattaaaacaatcacataagtaaagggatttccgtccagatcagttactttaactgtgtatttggatccgtcttcttcaaccattataatgtcctcaccggttaagatacattttgcagatatatttaccgttgtattccatgacgcatcatcataatagctatctccaggatagtatacataaacataattagttccttttgtaaagttaacagaaacattagctattccattaaccagctttgcctgataaagtacattatttacataaactccaataagaccagtacaattacccgggtttgtttttatattgacaatacctgtaaggtcatcattttgaataacatcaacagtcaaattgcagctttcttttaaaaccacaaatgacgttgatgccgttgaaccggcatatttattgtcaccaggataaatgacagttacatcatattttccgccggttaaattatggagtgtaatctcagttatttcatcttttaaaaatattttgctttcaacaccatttataataagtgttgcttcccctttaacatctttagggtttattttaatagttattgttgcattttcacctgctttaacatcactggcattaacactcagatttgtatcatatttatttactttcaataatccgctgactgaagccatttcataaagctgttcatcaagttcactgccccatgtttcaattgtaatgttgtacacgccagctccaccataatttctaattgtaacctgaatatcctccttatttataacaatcatctgtacacgtttaccgttaatacttaaatatgcataaatttgaactcctttaggagatgtatgtatattgacctttgcaatttccccaacattaatttcaggaattgaaatgtttaaattaatagggcatttatttactgtgacagttttatgaacaaatgatctgaaatattcgtcatttcccatataaacaagatttaatgtatgatttccggcaagcaaatcaggtatgttaaaagttgccttaccattgactaagttttcagtgtatgtttttccaccaattataagtgaaacatttccttcaggcaaaattgaatctatgccatttacggctacatcaacaacaagagtttcagtataattgatgtcattgacacttacagtcatatttgatacaagtttacctacatcaaccaatactttttgagtaaaattccttaaactgattgaaacttcataacttcctttcttttgagtccagttatagcttataacagcgcttccattatccagttttttggttattgtctgtgcagttccattaacccatgtattaaatgaaacatcaaaaatagggaataaactaatatcaacaggctttccactgcttgatttccaaatagctgaaatatcagttgactcgtttatattaagagcactgtattccggagaccctaccaacatcagccaggaatttactttatcaacattggatttgttcaccggctttttattggatccccaccaattattgtccagacaaatgttttcaccaccgtctgcaaagaaatcagcataactttcagccagcggcttgttatttaaaaatgcagaatagcttatgtctatttcccctacagtgtaaatattgacagtacctttataaacaggaatagcactatcttttatacctccattatttgcaaaaatacatccaacagcttttaaactaccttcattataaataacaccataaagagtattgaataaagctctagttacaaaagaatccttaatagtagaatttatcatagtacaatttccggaattaaaaagaactgctcccttaacctgctgagcagtactactaccagacattacaactctggttaatgttaaattaccattattagaaattgatcctccgaatgcaaagtctccaacatatgaacccttaaatgtggaatcaaagatttttaaagtaccattattgtaaacatcacttccatgcgcagaattacgtgcttcagaagtcattgaattactgttgaatctggaattaataattgtcatattaccagaattactaatggctgctccgtaattgtccttacttatagatgaagtatgttcaatacggttattgttaaatgcacaattgctaataaagactgttgcttttttaacatccaacactgcaccatatacgcttttctggtcataataaagatccgcttttttaaatgcattaataaaagttatattgctaatactgacagttacaccatcggaaattgtaaaaaaatagtttttgtttaatccgtcaaatacagtgttaacagaacctacaatatttacagacttggctatattaatttttgaatttgcagaaccgctgtatgttccattatctatgtaaatcgtagtattgtctttagctaaatatattgcccaatccaatgagttagtggcactgccccatgaagtagcattagcatagctattaccatttacactaacataaagacaatcgccgttattttcctcgccaactgcatggttattattaatttcaccaattacaggatcaccctgaaaatcatcaagtgtatcattagttaaatcggcagcactgacactagccaaacccagcaaactgcataaaatcaatattaatacagcagttaacaacctaccatgtttcaatttttcaaacctcctttaaaatacaatttattttatattttataaaatatatttgactaatgataattaaagttatcaaaaaatgaacaggcatctaaaaaaaattatcattaattaaacatcatctttattatatcaaatatattaaagaatacaattaaaagttttagtataaaaatatataaaattaacgataaattgaaattattattttccaatacagattaatgtttttttatttttagataataattttgaagatgcattttgtttatattgttttttaaaaattagttatttatattttcaaataacaataaaaattgcttaaacttgttttatgaaaagattatcattttatttaaaaaaagaaaaataagtaatgaaattatacagtttaaacattacttgtatcaatagatttaattataatatttacaggattgtcactattggaaacatcccaatcggatggatcatttgcggcacaaacaatataactggaaccatctacttcacaaacatacccatatattggcataccgtctttatcataagcttgctcaaatacttttatatcaccgaatccggaaacatctttttgacttttgaaagtgtaaccttttgattcaagagttttttttgcatcatcaggacttttagcatcactagctaaaacaataattgcaagatcatctttaactaaagcagtattcccgtcaccatcatcttgaactgtaaaaccgtcaggaactgtaaaagttgccccgtcaggtaaagtaagatcttcagcagccaccatacctacagtaattgcagctacaacacacaaaagcaatgcaaccactatttttgaatttaacttcatttaaatcattatctccaaattattaaaaataatttacttttattctaataaaaatgtataaaattcaaaaattaaaaacatctttttaaattcattgcatttccatttttattgaatatctatgttttaatatatttcaagtaaaaaacacgattatttcatcaattcagctaaaaaaaacagaatttttcaataaatccttatgaaaaaggattattatataaaatttactgccattaaaaatattaatagtttggcaaaaatcagatggtgttaaatattgatttaatcaccctaacaccaattataaacattttctttaaaaaaaagtaaaaatttgtaaaaaataaaagcagctatgaaaaatagctgcttaatgtactaataaaacatcttttttaaaggagtgaataactttttcagctacacttccaataaagaattttgtaactctacctttaccagatgatgaaatagctattaatccaacatcctcttcttctgcaactttaacaatagtttctgcaggaaaaccaacaagaactttagttgtaacattaagatttggatcaaatttagctttcattttatccacattaaattgagcttcatctaagaaagattgatttaatttatcaatatcttctttactttggaattggtgtggagtcaattcagatgcaactgacaatatgatgatttcaccatcttcagcaagtaaatctccaactttttcaacttctttttctgcagcttctgatccatcagtaggaactaaaatttttttatacataatttttcacctcatgaaaaatgtttagttcatgcattttttattttaatttaaactatttaataaatattatgaaaataatttttagctatagaagtaatttattataataattaagaaaacccggaatttgtacaatatcacaaattaaaagctgaaaaataaaatttagccagtcaaatagacaaaaaacaatgtttttatgaaatttttcttaaaaaaaagttaaaagctatagaattaactatagccaagttaaataaatctaaacgattccttgagcattcattgcatctactactttttcaaaaccagctatgtttgcaccgactacgtaatttttctcaaatccataggttttagctgcttcatcaacattagcaaagatgttttccataatgactttaagtcttttatcaactttatcaaagtcccatgagaatctttgagagttttgagccatttctaatgcagaagtagctacaccaccagcattggaagcttttcctggtccaaataatacatcattgtcttgtaagtattcagtagcttcaatagaagtaggcatgtttgcaccttcagcaactgcaacaacaccattagctactaactgtttagcatcatctaaaagtaattcgttttgagttgcacatggaagagcaatatcacatttaacagaccatacacctttaccttcgtgatattctgcacttggtcttgcttcagcatattcagttagtcttgcacgttttacttcttttacttcttttacttcttttaataattctacatcaattccttcaggatcataaatccaaccggtagaatcagaacaggttacaggattaccgcctaattgttgtgctttttcaatagcataaatagctacattacctgcaccggatactgcaatagtttttcctttaatatcaatgtcatttgcttttaacattgcatcagtaaagtataataatccgtatcctgtagcttcagttcttgctaatgaaccaccataagataatgctttaccagttaatactccttcagataatcccctaatccttttgtattgaccatataagaaaccaatttctctaccaccaacaccaatatctcctgctggaacatcagtgtctgcaccaatgtatttgaataattcagtcatgaaactttgacagaatgccatgatttccctgtcagattttcctttaggatcaaagtcggaacctcctttacctccaccaattgcaaggcctgttaaggagtttttgaaaatttgttcaaaacctaagaatttaataatacccacatttactgaagggtggaaacgtaatccacctttgtaaggcccaattgcactgttgaattgtacacggtatccagtatttacttgtacttgtccattgtcatctacccatggaacacggaattttaattgtctttccgggttaactaacctttcaagaagtgcattctttttatattcttcttcatttgcttcaataacaacccttaaagattccaatacttcttttacagcctgatggaattctggttcagaagggttctgttttacagttaattctattacatcatctacgtaagacataatatttctcctccgttaattaaaatatataattacggaattttctagaaattgattaaaaaattcaaaaatctatttgaataaataataatattttctaaaaatttccaacacttgttcagtgtatatcattaaataacattcagattttgacctggaataaccaagaatatttaacaatatgataattactatatattttctattattaaaaactttcacttttctaaataaaaataaaaaaatattcaatacaattaataaatgaattggacaaaattatatgtttacaaaaaaacagtaggtatttatatagtactttttacataataatctacgaaaacaggtaaaaatcatttttcagtagacaaaaaataaaaacgatgaatgatttttaaaattttctaaataaatattataataactaaacaaacatacaaaattaaataaaaaaaattaaaaaagagagagttaaaatggctgtatacaaaccaactgatgaaataaaaataccccaatccaaatatgataaattaaaagaggattatttaaaaaatccgaaaactgcttattcactttatgccaaattcaataaggaatatcctatggataaaaaagtatttattgaaatcatagataaaatcaggatagatgaaggtgcaactgcttttaacccgattaaaaaaacaaaaagagcaaataatccatttagctattatgataagcatcctgacagctatatttgtatggaatattcaaaataaaaccacatagtacctataattaaatagtgattttatggtattcattagattaggtggtgaaaaagttgaaggattttatttccataataactggaaagttcaagttgattatggtatgaatatgacagaaataccattttcagattataatgaaattgatgaatcatcattaccttctaaagatgtactttattgtagaggaggtagatctagtgattattttagaatattgaaattattcaaagacggaaaattaataagtgaagttatagaaaagaatcctaattatgttccaagagatactcaattgaaaatgttggaagatcatgtgattattggggaagatgtggaaagagtatttaattttcctaatggttattccgctaaaattgagtattggatttcaccaacagaacgtgattataaacatggattttacacagctaaatatagaaaattaattttatcggatgataaagataatattatttctgatatttttgaagataatcctaattaccgtagttttgataagatttgttgggattattctgatacttcaggtagattctaataccattattttttgaacatttcccccacataaaccaccatatctaattcataaccataaactgaaggttcaccatgactgatgaagaagacagctatgtttgtatggaatattcaaaataaaaaccatgattggaattaaaaatatttatccaacatggtatcttaaaatcgctgcaactccaccaaatgctcttaagagttgcataccttcttcagtttctgtagaaataagctcaacttcagaattcatttcttcagctttttcaacaaaatcttcaattaaagtttgtgaagattcttcttttaaaatttcaccacaattggaacatggtttttcaagtttatctgcttcactttgagatttgacagtaatttcctcttcattgccgcagctaggacatttgaaaactttacgcattgcagttaaatcttcagataataataatgtgtcaactgcacccataattaagttagtcctgacttccctttcaccataagaagcaagccctttatctttaactaactcatggaggaatttttgaactacttttttctcctgcataacatccaaatcatttaaaatatctgcagatttgtctattacttccctaataccaaattccccagtatatgaagtatctacagtagctatgattttatctttaatttcgtagttaagataatcaccttttacaaattcttcttttgtaaaacctggacctccaataataactccttcaagttcttccaaagctaagaaatcttcattcatgtgttctccgatacgttttttaaactcatgagcagccaaatcaattacacgatcaaaccttctttgtgattgacctcctgctttgtgttttcccggaacaccacttgtcaaatggtttaaaatgtttacttttttacctcttaaagtagctattgtagcttcttttctgtcaataactgccaaaccataagtttccctttcttcaatcatatactcaagaggttctaagaaaaactcattgttacactggtaccagtaagttgtaataggttccggaggttcaaaaacataagtttccattttttcagttcctggacctcctcttggaatcatacctacaaaaagaaccagtccattttcaggagctgctttaaataatcttatcctttgcataattacttcaatagctgactgtacattctttcttgtttgcttactcttgatgttagcactttgtccgagttcatccctcatttgtttaccaacatcactaatttgtttatcatgaggaatataaacggaaacaagctctgtacctctaccttttttctctgataactcttttaaagtttttttaaatttatataattcttttgatgatacttctgccatgttaatcccttaaattaatataataatatatttatgtaatttcaccttataaataattaatgaaagaactttaaatactataaatactaactattaataacgaagatgataatatggttttaagaagatgtccaaactgtcgctcaacatgtgatgaccaatacggattttgtatcaaatgcggatatgagttcccgaaaataacagaaagtgaaaatgcttgtccttactgtggatttgcaaatcctgatgaagctacattttgtgttaaatgtggtacaccactaattttcaaaaaccaattaaacggagttaacacaacactaaacccaatagttatcaaaaaagaaatcagcaaaaattccatgaaacaagaggaatataaacctaccagcaaaataataatcattttaggttatatcttttctttacttggaggactaattggagtaatactggcaatttaccttgcaacaagaaaagatcctgtagctaaaaaacacggatatatccaactaacaattttagtattatatggaattttaatattaacactatacttaactggaaatcttgatttgactgcaattgataatgctacccaaatgttaagcaataatttaaccagcattaaaccttaaccggcagatacataacgatagcaccatcaccgttattgtaataatgtggaacttttctatccacttcaaaattaaattttttataaaattcaatagctccttcattattttcatttacttccaaaagtattttgtttattttaaataatgacaggacatttatagctttcagcagcaattttgttcctgcttgttttctttgataatctttatcaactgccagagatatgatgtggccttcattttcatattttatccaaaacaagacataacctacaacataaccatcatcttcagctactaaaaaacctgcaccaatatcatacaactgcttaaacatgtttagctcataagactcatcaaaagacatcttttctatttcacaaacacgtttcaaatcatttgggacaaattctctaattatcatctataaacctataatttaaattaatcttgaaagatatatatcattagataaatatataatttttgaggttagaaaaatgtgggatgatttcgcagagttcattttaacacaggcaactgaaaatccgacaagaatagtggaaatagccgtcgggaaatttgacggagtataccaatacctaaagagaaacgaaaatatagaaattatcaaaaccgatattttgccaaatgatgatgaagtaataaaagatgacattacaaatcctaacttggaattatatgaaaatgccgatattatatattccattcgcccaccaagtgaattgcaaccccatatagaaagactgtcacgaaaagttgacggaacttttatcataaaacctttgtgtaatgaagatttaaatataagttcacacaaagtgaaattgaaaaattataaaaaagcaagtttttacatattataggtgtgtctttaatggaagaatttttaaaaaaatacaatacttcagaagaagggctgagttctaatgaagtaacaaaacgccaaaatcaaaatgggctgaatgaattaaaagaaaaaaagaaaaaaagtgcggttatgctctttttagaacagttcattgatgttttaatagctctccttattgttgcagccattgcagcatattttgttggagacgttatcgactcatgtgtaattttaatagctgtacttttaaatacagtaatcggattcatacaggaataccgttcagaaaaagcaattgaaatgcttaaaagcgttacaacatcatatgcagttgttaaaagagatgggcaggtgcaaaaaattgatgcaaaagaattaaccatcggagatattgtaattcttgaagagggagacaagattcctgcagatttagtacttattgaaaccaacagactgaaagttgatgaatcaaatttgaccggagaatctgtacctgttgaaaaatctccaaaagaagaagcatatatggattcaaatgtaactttaggaaacggagtgggaattgtaactgccataggtatggacacatcaataggaaaaatagctgaagtgattcaggaagaaaagggagaaactcctcttcaaaagaaaatggacaaacttggaaaaacactttccgtaatagctattattgtttgtgtatttatattcatttttgaattattcagaggaattcctattgttggaacatttttaacagcagtttcacttgcagtagctgctatacctgaaggtttgcctgcagttttaacattgacattagctttgggaatgcaacaactgaccaaatccaatgcaattgtccgcagactgctttcagtagaaactttaggttcatgtactgttatctgcagtgacaaaacaggaacattaactgaaaataaaatgactgtcagagatgcatttttctataatgaaaacaaatctttagaaatcaatgcactttgtaacaattccacaatcagagacggcaaaactatcggagatccgacagacggtgctgttttaaaatacagtcaggacaataactattttaaagaggatttgcaggaaaaattccctagagttgatgaaatcccattagacagcagccgtaaaatgatgaccactatacatgaaaatggtgaaaagtatttggttctcactaaaggtgctccagaaatcattatcggcaaatgtaaacacatagataacaatggaagtgttgaaattcttgatgattctgtaaaggaaacactaactgaaaaaataaatgaaatgagtgataatgcattaagagttttgggaattgcatataaaaataccgaaaatattggagacaatgtagaaaatgatttgatatttacaggacttgtcggaataattgatcctccaaaggaaaatgttgacaaatcaatagctgcatgtaaaaaagctggaattaaagtaagaatgataacaggagaccatctaaaaacagcagcatctattgcccgcgaaattggaatcctgacagacgggaaagtaattgacggtgaaactctggataaattaagtgatgaagagtactttgagatggtagacgacatacaagtttatgcaagagtaaaaccagagcagaaaatgagaattgttgaaaccctaaagcaaaaaggcgaaattgtttcaatgacaggggatggagtaaacgatgctcctgcacttaaaaatgcatctataggagtggctatgggatcaggtactgatgttgcaaaagaatcaggagatatgattattcaggacgacaactttgaaacaatagtaactgccattcgtgaagggcgtaaaatatacgacaacattaaaagatttgtcaaattccaggtatcaacaaatgtcggagctattttaacaattgtcggaacaagtattttcatgcttccggtgccatttaaccctgtacaactgctttggattaacattgtaatggacggacctcctgcccaaactttaggaatggaaggtagcgaaagaaatattatgacaagacagcctgaaacaggagatattctgaataaaaaggtattgataaaaatatttattgcaggtcttgtaatggcaataggttcaatagcgctgttcagctacaaattggcaattggcgcaagtcaaaagcaggcaatgactgtagcatttaccttatttgtaatgtaccagttattcaatgcatacaattcaaaatcaaattccgccaaaaaaagcacttacctttatttggccattatagcatgtttcatattgcaggtattgattgtatatatacctgagctgcaaataatattcagaacaaccagcatcggacttacagactggatattaatattcataattgcagctacaatattagtgtcaaacagaatagcaaacaaaattgtggtagaatgaaaaaactaaacatcctccttattggcggaacaaaggacgcaagcaacataacaaaacacataaaggaaaaatatgattcatatatcctgactacaacaactacagaatacggatcaaaattagctattgagtctggaagtgatgacacaatagctaaaccacttttaaaagatgaattcataacacttattgaaaataatgaattcaatcttttaattgatgcaactcatccttatgcatcacacatcacccaaactactgttagcctatccaaattattcagcatagcttatattcgctttgaaagaccaccatcaaaccttgataatgttgacacatcaagagttcgtgaagtaacttcccttgatgaagcaggacaattaatagctaacgagtttacttcaggaaacgtgttgcatcttgcaggagccaataccatggaacctattttaaaatatgttcctgtaaacaggttttatgcaagaattttaaaagttccgaaatctgtggaaaaatgcaaaatgctaaatcttcctgaggaacatatcataccaatgaaaggtacatccagcttagaggaaaacctaaaaataattgaagaaacacaagcaagtgttatgataacaaaagaaagtggtgatatcggaggagtaactaataaaattaatgctgctaatttaaaagatataggtgtcatcatgttaaaacgtccaaaaatcagagatttaaataaaaatgacattgtttctaatttagacgaattagatgaaaaaataaataactgtttttaaattaaaaagaacgccgagactgggatttgaacccaggcggagaaactccacaggatttcaagtcctgcgccttaccagactagactatctcggcaaaaaatacactgttaaaaaaattagaaaaaatatataaaaagtaaaaaagataacgccgagactgggatttgaacccaggcggagaaactccacaggatttcaagtcctgcgccttaccagactagactatctcggcatgataacagaaaaaatatttagaaaaaatctaaatatttatcctttaagttctatttcaatacttacattatccggaacattaactttcatgacttgtctcatagcacgttcgtcagcaccaattccaactaaacgtttatgaattctaagttcccatttttcccaggaagcttttccttctccatccggagattttcttgtaggtactactaattttttagtaggtaatggaataggaccagacaaatcaacaccagttctttcagcgatttttttaagttgatcacagacataagctaatttttctggatcagttcctgtaagcttaattcttgcttgatgcattattatcctccaaaaataaaaataaaaaagaaaggaacaacccctttcttttaattaactacttacaaatctatttagctggggtaacgtcaatacataatccagcagcaacagtttgacccatatccctaatagcaaatctacccatttgagggatttttttagcgttttcgattaccataggtttggttggtttaacttttacgaatgctgcgttaccagtttttaagaagtcagggttttcttcagctacttgaccagttgcagggtctaattttgcagttaattctaagaaagtacatgcaacttgagaagtgtgacagtggaatacaggagtgtatccaacagtgattacaccagggtgttgtaaaacaacaatttgtgcatcaaattctttagctacagcaggagcatcgtctacatgaccagctacgtctcctctcctgatatcgtttttacctacacctcttacattgaatccgatgttgtcaccaggttcagcagtttcaaaggtttcgtggtgcatttcgatagattttacttctccagaagctccagcaggttcgaagattacgttttctccttttttcataacaccggtttctactcttcctacaggtacagtacctacaccagtaatggagtaaacatcttgaatagggatccttaatggtaaggatacaggtttttcaggagcagctaaattatctaaagcttgcattaaagtgtcacctttgtaccaggaggtgttaggacttgcatctttaatgttgtctccttcaaatgcagaaacagggatgaaaggaacatcagcagggttgaatccaacagttttaattaaagcagatacttcgtcttttaattcgttgaattttgcttcatcataatctactaaatcgattttgttgattgcaacgattaattggttaatacctaaagttttggataagaaaacgtgttctttggtttgtggcattacaccgtcgtctgcagctactactaatacaccagcatctgcttgggaagcaccagtaatcatatttttaacgaagtctctgtgtccaggacagtctacaacagtgtagtcgtattttttggtggagaatttttggtgagcaaggtcgatagttactcctctttccctttcttctcctaatttatccataacaaatctgaatttgttttctccatcatctaattgttgttcagcgattgcacctgcttttaataacaagtgtccaactaatgtggattttccgtggtcaacgtgtccgataaatgctaaattaatatgttctttagtttttgccataataatacctcttttcgtataaatcgaaataacattcattaagcttataattttagcttaatttaaattttaattattcacatataaatatgtaatgtttttttcgtaattttaaataaaaaatataaaaaaattaaaaattaaattttaattatcctacataatgttcaggaccataaggttctggagataagccttttctttgcctaatctctttaacgatttgattttgcatttcacgtggtaatctttcaaatccagacatttcagtagaccataaacatctaccttcagcagcggatctgatatcaccagcaaaaccaaacatttcagctacaggaactttagattcaatagtagccatgtctccttcttgacccatgtcaactatttgacctctcctgttttggatttccctggtacatggacccatgtaatcttgtggagtgttaatgaacactttttgcataggttcaagtaaagtaggaccagcagacatcatagatgcataaattgcatttctaatagctggcaatacttgtgcaggtcctctgtgaactgcatcttcgtgaagttttgcatcgtggagtttgaattttaatcccatagcaatttctttagctaaaggtccgtcattaagtgcggattcaaatccttcaattaaaagctcttttacttcatctaagtattggataccacgggtagcattgatgaatacgcttctgttgtaaacatcccatacttttctcgcttcttctttatctaaaccgtattccatgaagtcattagcagattctttacctttaactttaccttctttaagttttccttcttgtaatgctttgaaaagttcatcttctaaaggttcaacagtaatgtagaatctgttatgtttgtttggagatttaccttcaacttgtggagataattgagatacggtttccctgtatacaacaataggttctgaagtttggatttcaacacctttatctttaattctgtaactgataacttctaaatgaagttctcccatacctgaaactaaatgttcaccggtttcttcgttaatttcaactttaatggttgggtcttctttagctacttgtcttaatacttcaattaattttggtaaatctttagtatttttagcttctacagcaacagtaactacaggttcagaaatgtggtctaatccttcaaactctttgattttgtcttcaggagaacagatagtttccccagcgattgcaccttttgcaccagcaacatatacaatgttacctgcaggtacagcatcagtgttaactctttcaggtccgaagtatacacctacttgctgaactctggatttggaatgagatccaactaagtatacttctgtacctttttcaattgatcctccgtaaaccctaccggtagcaatttcaccagcgtgtttgtctacagatacgttagtaaccattacagctaaaggtccgtcaggacttgtagtaatcataccttgacctgcaggagattcaatgtcaccttcccagatgttaggtaccctgtattcttgagatactttaggagaaggcaagtgttctactaccataccgagtaatacttcagacaatggtactttttgagctaattctttttgtttatcatcattacaataatcaatgatgtctttgaagttaactccagtttcttgcatcattggaacgttaatagcccaattgtgataagctgaaccgaaagctacactaccatcagtgaaatcaacagcccattcttcttttttatcttcaggagccatgtttttgattaatttgttagcttccatgtaaatgttaatgaaccttttttgtaattcttcaggttctaattttaactcgttgattaatctgtcaactttgttaatgaacaaaacaggtttaacattttcttttaaagcttgtctaagtacagtttcagtttgaggcatgataccttcaacagcacaaacaacaacaactgcaccatctacagctctcatagcacgagttacgtccccaccaaagtcaacgtgacctggagtatcaattaagttgattaagtattcttcatctttgtaattgtgaaccattgatacgtttgctgcatcaatagtaataccacgtgcttgttcttgttcatcaaaatctaaaaacctttgatcaccagcaagttcttcggaaatcattcctgcacctgctaaaaggttatcggataatgtagttttaccgtggtcaatgtgagcacagataccaatattcctgatggaatctggtttatacattaaatccttaatttttgcaatcattttctctcttctactcaaagaaatcaccttatataaatatgattagtgtgctgcttttgcaactctttctttttcttcttttttctgtaaagcaaaacttctggaatcttcttcagaagcaagaattaattcatcagctaaacattcagcaacagattttctgtttttaaatgctgattgtaaagttcctctagttaagaatcctaatgaaagatctactcttctttgtggagaaatgtccactgctacttggtatccgataccaccgtatttaatacgagtagtttcttcacgaggggaagtattttcaactgcagtaactaaaacttgaacagggttctttttagttcttttgttgataatatccaatgcatcttttacaatattgtaagctttgtttttcttacctgagttgatgtgagtcctcatgattttattcattaatctttcaatgatagatactttagattttgcaaactgtctttttacatgtctacctgaagtgtgaggaacaagagtttcatctaagcagatgtattttactaaacctaaatcttcgattttgacttcatcgagttcccatttatcaaataatttactcataaaaataccatccttatcttacaggtttttctatttttccacttaccatctcggataaagctacgttgttaactttagatactttccaacgaactccaggaatatctcccatagatcttccagatggtccaccaattccttcaatcatgacttcatcgtgctcatcgataaatccaatagctccgtcacctggtgcgaaagcagttaattgtttaccgtttttgattaattgaacacgaacacatttacgtatagcagagttaggttgttttgcttctatccctactttttcgattacaattcctctagcttgaggagctccttcaagagggtctgctttaacatctaatcttaaagctttccttttgtaatctacatctttccacttaaaattttgtctattttttttaagtttttttgcagcaaaaagtcctggcataatatttcctctaaacttttattaaacatatctaagaatccaccgctgcgatttatacagctaaaaatagctaatacaatctaaattcaaagatataactagttaataatataataattaattagacaattaaattatctaaaaatgaagatatcatgattttttattggaagcatagtaaaaagcacacacaactatgttccattaattgtcgatatcttatgatgatttatcttttttaacattaataaaggtatctattttgacttgttgaaagtcagttttgattaaataaaaaatatttcaaagatttatttgaatattatttgctttgtttttattgcttatattagttttcctctacatacaaaataaactctatatcctgttttttagagccggtatttttgttgtaacaaaaacatgaaaacctgatttttcaatagagaatttcaaaattaagataaagaaaaaacaataaatttaaagtaaaaaaaagaaaaaagaagagaattattttgcaggaattataatatccctttcaccgtccggctcaaattctcttaatgctcctcttgcaatctcttttctaggatgtttaaaatcaaaagataatgcatcatctgcaaatgcaatttttattaaaggattaacagaaaatgcatcttttcttgcagcatgaggtgcctgtgcaatacctgcatattctggctggtgacctacattcatagcatagttcggatagtttggtcctcttaattcatgaattaaaccttcatcacttctaatagataatgaattagcagaaccgcactggtcttgcaagtcatatccatagaatcctaatcttgaatgtccttccttatgtaaaagcatacttaaataccagccatttacaccagcattggaatttgctgttgcaaaagctgtggaacatcctgcagctgcagatataactgatgccctttgtgaacctccgaaatgagtttcaagaagagtaggtatttcatattgttctaaaccataaagtgttacttctgttgaaatatcccttacaacatccatagttttttcagcctgacataaaccgtagttatcctcaacataatccaaaccataataaacaaagtcatctaaaatatcatcagtataagttgcacttgcatactgagtgaaacctacacctcctgacatgtaagaacctaaccaaacctgatcatatagcgcagcagcacctgcaataacctccaatgttacttcagcaggatcatcagaaattcttgaagtttgaatcatatctgaaaaagcaccaaatgaaacgcctccaggctcatttggtcctctcgcacgcctagcaggtaaaaatgaagccataccaataacatctgcatgtttagcagcataagaaaaatctgcaatagctgcttcaccagcacataatttatatgcattaataaaactcataccaatctgcatagcagaccatctggatacagtacctccgtcacatgcccttacaactaatgtaggcactctactaacctgatatgttttgtttccgagataatctttaagcatttgtgcctgatcttccgggaactctttattaatatcaattaatactcttttatctatttcatcagccaactcatcattacctgtgaaaatttttgcataacagtcactaactaaaccaggatgcacttcaaccatatgttcctgaactactgctccaccaggaagtgcatgattgatattctccatatattcattgattgtttcaggagttacttccacacctaatctttcctgcaaaacagagtgtgcagtatccatacctacaataattgttcttttaatatcgtcaaccaattgttgaatagctgcattgttacaaaaatgcaaatcatcgccttcaacataatcatcagttccggaaattttataagtcattaaacttctctgacctaaaggaacaccaatatccggattataaaaaggcatattcctatctttagctaatttttctgcagcatcattaaactctctttttcttggagactgcttccacccatcaaaacaatagaaactggtgtggttactttcattatcttcacctttaaatttttgatttaaagctttgaagaatactttttcctcattctccatcatattcacctaatctcatttttaaatctttactgaaaactcctaaaccataaccgccttttgtacgagatgaatgaatagtttcaacaatatcaacagcttcatcatctgacctcaaacctacattatcttcccgatatattgttgtaatatcttttaaataatcttcttctaacggaacaccaacatctactgcttcatcaagaggtctgccgacttgatctttaacatacatgatatgtccgctttcctcatcaaaaacatatctttgaagggcatcgaacatcaaaccattttcatcaagccttaatgaatggccatgtactgttgctcccctcataccggattttgcaggatcaaaaatatctgtttcaacaagctctttagaaattttttccaaatcctgttcccttatttcaattacttgtcttccagataatgttccagtatctacacccctatatctccacatataagttcttgctctatcatatggctgtgcaggagcattatacatggaatctgcaaattgaatatatctaactctaataccttgttttgcaccaggagtaggttctaccatttctctaattatgtctccacccatatccatttcatctaacggaggatgaacagttttataattttctccaggattacggtgtcccaatattcttactaaaccctcatcagacacttcccttatctttttaaatttatgagtaggatccatatgttttcttctattttcagctatttttgtttcaccaggagtgaattgtgctttatatgacataatatacaccaacattatttaattatacttattgattcagaacttcttgcacgagaatctattaaacctatatatcttttatcaataagattttcaaatccaataccatatttgagatagtcagaaattgttgatgttgttcttgtaaaaattcccactaacaaagaatactcgacagacaaagtttctgttaaaatatcttccaactgattcatgaaatcattgaatttatccaattccacagtaattataatttctccaaccatcacttttaaatcaatgccatttccattgactaaaatactcttcctatcaccgtgatttacatcatgccctttaccaggaccataaaaaacttttttaggcaaagatggtccatgaattaaaaatctaacataaccttctaatccacatattttatttaataataattcagtagtttttggctttaaaaatctattcggataaattttaatgtcaatgacattaatttcatcatgaagtttatcagattcacacatgcttaatcaccttatattttaagttcacctgcggatttggctacattaataataggatttctaagattatctatagtaccataaacagttccaatcaatgaagaagttctttgaactgaaaacatttgagttccagcatccaaacacatagcagcagatgcacatggaattgcacaacctttactgtgtctagtaacaacatggttaccgtggaatgtacctggtcctccacccccataaatggaatgagagaagaaactgaaacctacaccaacacccatagttctaccaaaatcaacactaggaagtcccgtttcatattccaatatatcattataataaagaaccgtggatgcaactgcttgagcagctcttgcagcacccacattaacaataaccgcagctaataatcctgcagcagcataagcattccataatgcccaatcaacaggttcataattaataaacccagagttcatttttctagatgctttaatgacattatcttcaatagctcgcccaactagactttgaataactgttcctacagtccctttgacattttcttttaccaaatcaaaaacaagattatctgcatttaaaccctgataagctaaagtcaataagtgcattctttcaaaagcacctgaagcatcaccagtttcaaacattgcagtttgttccattatagaagataacgctgcggcatttaaagtatttttattagtaattgctacaacatgatttgccatgacatttctaagaccataacctaaaccttccaaaagaaccggaggccccaataatgcactaatattagctcccgccaaatcaacagtttgaggatatgctcccatgaccgcagttttaattgtagacgcatcaaacatattgatatcaaatgtatcaattattgactgaattgtagcagaacctgaaagcaaagatgcaatactgtaatcagcagctacccttaacctttcattaggcaattgtattaataattgctgaccgttattaatcaaactaacattagtcgcatcatcctcatttacctggacaattctttttattttatctgcaattaattccgcattttcaacaattggcaaatccaattccctaccaggaatgaaaacagatttaccacccatagcccctgtccttaatcctttctcaatacttgctaaattaacagcacatgatcttttaatatcaaaaatcattttagcaatagctggatttttaagtgggctaattgcatccaatgaaacttcactttttagaagttttccatcttgaccatacaaatcaattttatcattgtaaatttgcattagtaatctccattttaaataaattaaaatattaaaaaaataacaaatatgagctaataaaaattcaaagtttgatgatatagaattgtaatgtttttaaatgaatatatttgttaattttttttaatattgcaaaattgtaacttgatttttttaaataaataaaaacttaacatgattaaataccaaacatgtgttttaaaaaaaacataatttattttattcaaatattattaaatcgcgttacatgattattaagttctaacaatcaattcaatattaatagtaatacttatttaaatgttactttattttaaaagctcaaattaacgtttaaataattaaataaaagttattaatcatttaaaaaaataaaaaacaaatgacaagtttaaaaaattaaaacaaaatgcatttaatacttattaacaataaagtaataaaaaactaatctgaaaaacactattaaaaatacataaaatccgaatacaaccattaataaaagccaatataataattaaataccaattattaaaaaaatataaaaaatatgcaatttaaagcctagctatactctttatagaacatatataaaaaaataaaaaacgtaataattattaataacaatgtaatatttaattgataaaaataaaaaattaaactttataaaaagcccgtttccaatagtaaaattaaagattattaaaaaatataagtggaaaaacaataaaatttaaagaaaaataatttctatgaaaaaaatatgaaataacaaacagtccattaattaaaaattatggtaagttttacaaaaaacagataaaatatttgaaataatgaaaatcagacacatttaccacaaagtatattcaaaaagtgtgtgcgggtttaataaaataatgaaaaatcgaactggttttcatttgattatcaaaaaagtaaaaataaatagctaaattaatagctattttaaaataatgttgtttatattgtgttgtctttttgcaattaacttagctctttcgatattaacgccgtttttaccaatagcaatacgtttgttggtattatctgctgtaacagtagctattttttcacctgattccttctgaagtactttaacaccttgtacttctgcaggggataaaagatttttaataaattgaatcgaatcgtcggacaattcaacgatttcaattcctttatctactgctctttgaactttggaaacagtgcttccgccttttccaatagctaatcccatatcaccgtttttcacgacaaatgtgactttaccatgttcatcatcgataatacaatctttaaccattgctccagtcatgttttcaaaaagagctatgtatctaatttcatttgcagtgaatttaatagacatatgaatctacctcaaatcatctaatatagtagaatctcctggatcgttaacgattaatgtagcaactgtaaatggtttaccacagacagaacccaattctacacttgaaccttcgtaagtgtatgatgggatatctgaaagatttgtataatattcaacatcttcaacaatatctttaggagtgtttgcagcaacaattacaagctgaccttttcctaattttaaagattgaattgatttttcagagcctaatgtcacatcaccagtatcgacagctaccctgatacttctatctacgtccatcatctagcctcctattcatttttatttgccattttgacaccgattgaaccggtaccaagaggtattggttgtccaataataatattttcgatgataccagttaaatcatcaacttcaccacgaatacttgcacgaagtaaatgtttaccagtttcttcaaaagctgcacgagctaaaacgcttgatttttcaccactaataccatgtctaccaatggattttacttctccttcagaagtcataatatctgcaactaacataatgtgtctaacatcaacactaagaccttggttttcaagagtatttcttgcttcgttaataattgattgacgagctgcttcaatacccaatacagtttctatctcatgaatatcatttgtagtagttctgtatgtgtcaataccttccatagagagaatatctttaagattagaaccttcagtgtgcataatccattctctttcatctttacggataatgacttttccaatgtctttaataccacttatctgtaaatcacggaatttgtctgctaaaagacggagttccctaatttcacgttttggcggttcgacaataatcttgagattatccttaatatcagcttttttaaagtttttctgaattttagcaagaatttcatcaagatcaagtcttttatcttcaatttttctttcgtctaaaactgcttcaactttcatatcagcataatttaaactgaaatcactgagaacatcgtttacagtacttttaccaattttattagctaaagttttaacgaattcttcattatgacgtttttcttcagtaaaataaatatccattgttggagtagctattttttttcttgcgtcaacgatttcaataagtcttggaagacctaatgttacgtttaattccattacccctgcatagtgaaaagtacgcatagtcatctgagtacccggttcacctacagattgtgcagctactgttccaacagcctcaccagcttcaacatgagctcgttcataggcagttttaagctctccaataagcatatctaattcatcatcagataaatgcctgttaacataagcagatgctaaatcatccacatatttttcagggaactttacacgacttgatgggtcaataattccattttcaacaattcttgcatcaaagtttatttcagctttaagtaaagcatcttccacttttttaattattgcatcatccatagttacacctatttaccctcttgttcaacacttgaatcatagtttggattagcatctcctaacctattttcatcaatgattttatttaagtcagctgctttaccaaagtcacttttagctggatctactccatcttcaccaaacataagttggataaccattccctgattatcagtaacaagtcctgacggtttaacctgtaaatcctgaagcgcatttaccagtcttctttgcatataaccggattgtgctgtacgaatcgctgtatctacaagaccttctcttcctcccatagcgtggaagaagaattcaattggatccaaaccttttttataacttgaatgtacaaatccttttgcctttgcacctaactcatttttacggaaatgaggtaaagtcctgtcaatataacccctgtggatacgaccaccacgaacagattgctgtcctacacaggaagtaatctgagtaaggttcaacatagatgccctagcaccagtacgtgccataactacagaatggttgtgttccatagtaaggtagttttctgcaatttgaccagatacgtccctagcttccccaagcacttgcataatcttcatttctaaagtttcttcaaggcttctaccgggtaaagcttcaagataatcgttttcatatgcttcaactaatttatctaccttattttcagattctcttaaatgctcattaattctttcctgagcttcttcaggaatttcttcatcatttgtacttgtggtgattcctgttttcataattccgcagatagctaaatcagtagacctgtctaagaattctctggctctagcagggccatactctttaacgattttatctaaaatacgtcctgagaaagaaccgtaagctttttcatcaatgacaccatgtttaagttcaccgtcttcaattacaacataagcatcaatgtcacaagcttcttctttacagacatcacatttctgacaaatctcagctttataaacaagattcaaatcatcaggcagtaataaagagaataactctttaccagtccagtttttatgtttacgttttaagtgtttaggatcaacattttcattattgaacaaatgtgattttctgattatctgcagtgcctgttcttcgctaaattcagatcctggttttgttaaaagatatgctccggaaatgtggtcgtgaatagcaccaataataggtccaccaaaccttggagataaaatatgttcctgtacacgcattaaagacttagcctcagcacgggactcatcagtttggaaaacgtgcatgttcatttcgtccccatcgaaatctgcattgtaaggaggacatacacataaattaagacggaaagtcttataaggtaaaactcttacctcatgagccatcatagacattctgtgaagagaaggctgacggttgaataaaaccatatcaccatctttcaggtgtctttcaataatataaccaggttctaacttctctaaaatcatgtctttagtttcatcataaaccctgattttccttccgtcagttcttataacatagttggctccaggatgaacattaggaccgttttcaatatatgttctcatttcatccatgttccagtcatttacataagcaggtacagtaacctcttttgcaatcatttcaggaacaccaacttcattaatactaatgtttggatctggtgaaattacagtacgggcagagaaattaacccttttaccagacaaattacttctgaatctaccttctttaccttttaacctttgagctaaagtttttaaaggtcttccagaccggtgtcttgcaggaggaacaccactagcttcattatcgaagtaagtagttacatggtattgcaataactcccataaatcttcaacaataagttgaggagcacctgcttccatgttttcaattagtctttgattaatacgtaaaatatcaacaagtttgtgagttaaatcatcttcagacctttcaccagtatctaaagtaatagaaggccttacagtaactggaggaacaggtaaaacagttaacactaaccattctggcctagctacttcaggattaacacctaaaacaaaagcatcttcatcagaaatcctttcaagcctttcacgaacttcactagcagttaatttataatcttcaccttccattttttgaacaatggaaaccggcttatcaatagtaatatcatcctgagctgcttcacagtgaggacaaacatcacgacgagcttcattataaatctcttttaaaatcttagttaaattttcatgatgattttgagcatctttaatcttttcagtgtatttgaagatttcatcatcagttaataaaacacgaccacattcattacatgttgaacgtaaaattttgtgaattatatcaccaaaaccaacatgaataacaggtctggccaactcaatactaccgaagtgtccttgacactctccacctctgtaaccacaagacctacattttaaacttggatcaataacccctaaatgaggatccattaaaccattttcaataggataaccatcctcatcgtaagtatcaggagtttcaattttaactactgacatttcacgaatatcctcaggagacataagcccaaagttaatttgtttgattttttttataaatcctttcaaaatattgactccttcatattatataattatgttttgtctcctaaaactaatttagggaaaatacataaactcttaagttcatctaataataatttaaatgcgtatgaaatttctatcggataagtttcaacatctccacaaattggacagtactttttatttttattcttatcatatactgctaacataccacaattttcacagacaatagcttcatatttgtcagactcatctaaaagtctttcttttaaggtaagagctgcaccgtgtgcaataagacaatctctttccatttctccaaaccttaaaccaccttcacgagctcttccttcagtaggctgacgggtaagaacttgtacaggacctcttgaacgagcataaactttatcagtagtcatgtggtgtaatttttggtaatatgccacaccaacaaatatttcagcttcgattctttctccggttacaccattatataatgattcgcaacctgcagattcaaatccgtgatttttaagctgttgtttgatttctttttcaagttctgtattgaatggagttccgtcaacacgttcaccttcaagacagcctgctttacctgctaccatttcaagcacttgtcctacagacatcctggaaggaatagcgtgagggttaacaattaaatcaggaacaacaccagattctgtgaaaggaacatcttcaggagataatattaaaccaagaacccctttctgaccgtgccttgatgcaaatttatccccaaattcaggttgcctggtatctcttactctaattttagccaatctgcttccttcaacagtttcagttaaaagaacagcatcaacgatacctttttcaccgtgtcttactgttacagaagtttcccttcttttttcagctacagttccgaattcgtcgatttcttccaagaatcttggtggtgaagttttaccgattaatacatcaccagattcaacatatgattccgggttaacaacaccgtcatcatctaagtgcctataagcatcttcggaacggtaacctttaatgtttttatcaggaacctcaaatttatcctcttgtccaccaggataccttttttcagcagtatcataagctctgaaaaatgaagacctagccaatcctctttcaagagaacctttgttaataaccattgcatcttccatgttatatccttcgtaagacataagagctacaacaaagttctgacctgatggtcttttgtcataattagttgaatcaataatacgtgtttttacaataggagtttgcgggtggtgtaataagtgagcccttgtatctgtacgtaatgcatagttagaaacatataatcctaatgcttgttttgtcatacctgcttccatagtattccttggtgaagaattgtgatcggaaaacggaataatacctgcacaaattccaagcatagtagccgggtcaatttccaaatgagtatgttcctcatttaaatcagcaatactcatagcaatataggagttttcttcctcttcagcatccaagtattcaataaaaccattgtctattaaatcatcccattttaattcgcctttagctactttttctaaatgtttatcactaagaactggtttaccatctttaacaatgattaatggtcttcttgccctacctgggtcattgaatatataaatctcattatttttatcataataagtaatattcatttcatgagaaacctcaccatttctccttttttctctcatttcattggtgaaactttcagggtctttacaatatcctaaaagttctccattaatataaattttagcactatccatattatcgttcctttaatcctctaaaacattcatctttttaataacatcaatgatttcttgttcatcagaaccttcagaaatattacacattaaagctaaattctttaccagaccacagttaggaccctctggggtttcattcggacaaatcttaccaaattgtgttgggtgcaaatcccttgcttcaaagtgaggttgacttcttgttaaaggagatacaacacgtcttaaatgagaaagagttcccatataactagtcctatctaataattgacttacacctgctcttccaccaacccagttaccagttgcaatagcatgtttaatattttcagttaaaacatcactacgaactgcctgtttgattgaaagctctttaccacgggaaatacttctttcaagttgataactcatatctctggttaaacttgtaaaagcaactctgaataaatcttccattaaatctccagatactctgagtcttttatttgtgtaatggtccttatcgtgaggttctctttgttcatcaataacctgaagcaacatttcagtcatttcagctaaataagtagctttagcttcacgtctttctgattcaatacccatgtgaggtaataagtaacggttaattacatcttcagcacgtttaatacggtattcttcagtcatacctttagctacacgattacctatgtatttaatagcagccaattgtaaatattgtcttctttcttctttatccatgccgtccatttctttttgatctaatttcaattgagaaagggatacctgaatatcatctgcaataatcatttggaaatttggatcattggaaattgcagtaataatttcctgacctgtagccaaaccaagagctcttaataaaataacaagtggaatttcccctggaacataagggaaagaaattcttaaaaatactccgcttttacgtggttttttatattcaagagaaattcttgctctgaaaccacttttaatagaagttacaatagccttagctcttctgtcttcaacatcaccaatacgctcaagaataattttatttggtgcaatttcttccattgttacaacagctctttcagaaccgtttacaatgaagtaaccacctaaatcttgagggtcttcaccctgttcaattaattcttcatcactaagaccatgaagatgacaaatatctgatttaagcattactggcaattcaccaatatatactttttctaaaggattgtcttctccttcttcatttaatgccatctcaagatacatgtgtgcagaataatttaaattcctaagtcttgcttcagcaggataaatcatacttttggaaccgtctgcttctttagtgaatggcttttcaataaagagtttaccggtttttaaagtatatttaccgttttctaaagtaataggttcagtaatatctatgatattttgaatcccactatttataaaatcgttgtatgatttaatatgatggtcaactaaatcatatttatcaaaaaatgcatcaactaatttccagttattctctgtcatggacttcctccagcattctataaaacaccttaaaaataattaactaaataaaaataagattaggaaacctaattaaaattcttcatttgattattattcttaatttactcctaactatctccattaagataattcctctcaaactaagttcaaatttattataatgaatttccaaaaaacaataaaaaaatacagaaataaacttattatactaaattttactattctaacattataactaactttttacaatacgataagtaacaaaagtacctgcagtatcactttcacgagtaattcttaaaatatcattttctttagcatcaatatcttttacaacaggatcatcaactttaattctaggaagattttcaatatcatagtcagcactattttttaaatcttcaatttcagaatcagtcattatttcatgcttaggtacaagcatatgttcttgaatattaattgtcaatatataattcctccagctagaaaagttaaaatataaaattagaaaacgggcccgacgggaattgaacccgcggccgcttggttaaaagccaagcgctctgccagactgagctacgggccctcacatacaacatttaaatattaagcgccttggccgggatttgaacccgagtcgcgggctcgacaggcccacatgatagcccctacaccaccaaggcaggaaatacttaaaatacagtatagctaatcaaacagtattaaccatacaccattaattactatatttaacatcatatataaaggtttcggaaaaattaattttccataaccacaaatataatcaatttaataaagtaatcaaatcccgcctgccggacttgaaccagcaacatttggatctacagtccaacgctctgccaaattgagctaaggcgggacataaaaatgggaccgcccggatttgaaccggagtctcaggctcccaaagcccaaaggatcgaccaagctaccctacggtcccactaatacagacatgatgcataacaatacatcatacattacctattttatacctcatagtatataaatgttatggattacatgattttaaaaaaaaatgcaaccataatatgtgtactaaaaaacacaaaatagaaagccccgaacgggaattgaacccgcgaccacgagattacaagtctcgcgctccaccagactgagctatcgaggcaggatgaaattaagataacaaataaacttttgtataaacttatttaaatacttttctaatacttaattaagactctttcaaaataacatacaaaaattatagataatgaaaattcatatagggaaaaaaatatttttcaaaatactaaaaaatacaaatacccacggaagtaaccccatataattatttgtatatccttttacaaataaaaaataaatccaacataccactaaaacaacaataagaaccatagcaaaaacacaacaattaaaacccaattcataccatccgaaataatgacaacgattaataacgtattcaatacaaatttccaataaaacaccaacataacacaacatagttacaattaactctttagactccattaaaatccactcccccacaatttaattcacaaatcttaaaaaaatatccatttataataacagaaaattgctaagaaccatataacatatatgcaacacattaactcaaattttaacctaaataacaaccaaatataaacccattaaactgcaccaacaatatatactgattataaactaaacaaattactaaaataatttaaatctccatctatttaagtattccaataaaaaaatattaacatcattcacatccacgattccatttaataaattttctaaaataaaccatgcgctcattatatgcaagctctttcaatttataatgtgccctataacctccaacattaaaaggtcgtgaaactttaacatggccatcatgtattaaatagaaaggatatcccttaaaacgcatcatcatagctactttgccatgcataacccatttaggtgtaggattttttaaaatatcttcatttaaagacatgcgtgcagaataatacctgcccaaattataaaatgcctcaaacctttttaaataaagccaatcattattatctcccccatcaattgctttatcaaaatatacaatggctttttcataatcttttaaatcaaaatatatcaatcccaaattaaccaaaaatccagaaaaactaggataaacctgaaaacctttattaaaataatttattgcttttttataatttttattatttttagctttaatccctattgaaaagaaataacggccaaatattaatttataaaatgaaagaaaaaaattactaaccatacctaccaatgcaatcacataataatctgaaacaaaacaatatacagttacaataacacaaaatccattcaccaacaaaataattacatctttatccatccaaacaccataaattaaattacatgagaatattctaaatttaaatactgaagaattaaatataaatataattctaaatgtacaaaaaacaatttatttataaaaattaaaggtaaaggaagaccaacaaccacttgcagtcttatttcactaacagtagtatctttaattggagtagataatatttctttcaaacttttagacatttcaatactccccattattaattatattgttaaactaatattaaatacattatttttcagtaataacaatttatttacaataaaaattttatatttatattaatttaaaagttaaataactacaattacaaatttcctacaccatataaaacattttaataatattaaatacaaaataaatctcaaattatgctggaaataaaataaaaactttaaaaaaatagttgctgtagaaaattagctgtaaaaaaattagaaaaaatcaaaaaatcatgaaattaaacaaagaaggtttaaaaataatatcaactgttcaattaaaaataaaaaatcactagctaaattaaaattaattcaaaaaatatttacatcaaatattaaatactaaaagatttataattataaatcatgacaaataaagaaaaattacttcaaaaaataccagaattattaaatgaagtaaaaagtaaaaaccctttaactcactgtataactaattttgtaactgtaaatgattgtgcaaatgcagtattggctattggtgcttccccaattatgtctgaagatattgaagaagtagcagaagttgtttcaatagctgatgctttagtaataaacattggaaaattaagtcatgagcaagttgaagctatgaaaatcagttctgctcaagcaaataaaataaacactccagttattcttgatcctgtcggagtaggaataagccaattaagaaataaagtaactttagaaattattgaaaattataaattagctgcaatccgaggaaacataactgaaataaaaacaatagctaaattaaccggaataatttccgaatcaaatactgcaaaaggtgtagacgtatctgaaagtgacatcataacccaagacaatttaaatgaaaatgcagatgttatttcaaaacttgcagctaaattagatactgtaatattagccagcggaccaatagacatattatccgacggtgaaactacaatagctattgacaatggtgatgaaatgatgccctacattacaggcagcggatgtatgttgtcatcaattgtaggaagctgtattggagcaaccaaccctcttgaaggaacaatggttgcagcattattaatgacaatagccggtgaaaaggcaagatctaaagtagattctgaaaatgcaggaaccggaagcttcagagcatatttaattgactatttgtataaattagatggtcaaactttaattaacaaaagcaacattgagatattatgaataacttagacttgtcactttatcttgtaaccaacaacagcgaagatgaagaaaaatttttaaacattatagaagagtccctaaaaggtggagttagtgtagttcagcttagagaaaaaaaagctgaaacattagacttctataatctggccttgaaagttaaggaaattacacaaaaatataatgtgcctctaataatcaacgacagaattgatattgcactagctattgatgctgacggcgtgcatgttgggcaaagcgacatgcctgcaaaaacagcaaggtcaatgattggtgaagataaaattttaggagtatctgctgcaaatatcaaagaagcaaaaaaagctcagagggagagtgcagattacattggtgttggtgcagtttatccgacaaatacaaaagacgatgcaacatcagtacctaaaaaagagttaaaagaaatagtaaaatctgttgatattccagttgtagctattggaggaatcactcaggaaaatgcacatgaattaaatgattgcggaattgatggattatctgttgttagtgcaatcatggaagctaaaaacccaaaaatagctagtgaaaatttattaaaagaatttaaagcgaaaaatagttaatttttactattttttgctgaatcccttaatgcctgaacggcagccagttttttacctgcaagcatactgatgcaagctccgccaccactacttaaatgactcatttgatcttcataacctaaagctgaagtagccgcagcaatatggcctccgccaatcagtgtaaatgcatttgatttagccatagcattaatcaaatcttcagtgcccattgcaaatttagggtcttcaaatacacctgcaggaccgtttgcaaatactgtttttgaatcacgaattatttttgcataataactgattgtttttacaccaatgtcaaaaatagattcattaggaatttctccacagtcaacatcctttctttcaccatctttttcaatagctacatcaatagggtattttactttatttccgaatttttcaataagttcctcagctttagaaaccattgattcatatcctttgcttattatgaaattcttgtttacctcaccgatatccacacctgcagcccaaagaacaatgtttcctacaatacctgttgttaagatagaatctgcagtaccgttacttaatacattttccataacatctattgaatcatcaggtttcattcctccaagcaggaatacacagggatgttccacattatccagtgcattttgaattacagtcagttctttttccattaccctgcctgcagctgaaggagtgttgagagtaaaacctactaaagatgcctgagatctatgagctgctgcaaatgcatcattaacaaaataatcaatcacaggagacagttgcctaacaagtaatgtttctgcctgagcttcagcaggtctggataaagattcttcagaaaagaaccttacattttcaagtaaaagaatttcatgaggttttaactgtttaatagcttcttttgcagcttttgaaaaaatagagtctatgtactttactcttaaattcaaaaggtcagataatgcattagcatgctgggacaaatctgtgaaatcttttttacccggacggctttgatgagcaagcaatacaactttagctcctttattagacaattctttaattgttttagcatgtaattttaatcttgtatcatccaatatgattccagaactaggatcaaccggagaattaatatcaattctaaccagcacagttttattttcaacatcaaagtcatcaattgtattaaatttatcagccatcatttcactcaaaatattaaatatagatatttataaaaatacaagtttttataatttactaaccaaatcaagtaaagcttctttaggatttttagccttaacaatacctgaagctaataaaactccatctgcacctaaatccattgcggctttcatatcatcaccagttgatattcctgcaccgcataagactttgatttttttgttgattgatttaactcctttaacagagtcttcaacaacttcaggctgtgcctgagatactggaatacctgtaccaataagttccggaggttctacagctactgcatcgggactgaaagtagctattgctttactagttgcaatattgtttgtacaaacacaggattcaatatcattttgcttacacaattgtataacttcatcaatatcagccagtttcattctattttcagagtggttaattaaactaccgcttatacctgcttcaattaaagtttcaattaaattagaacctgtatgtcctccaggagtaattggatcaatgtgctgtgcaaaaataggtaaagaaatttgatcctgaatcctataaatatctgccgcttgtggagctgcaaccatagttataccagattcttcagaagcactttttaatgcacgagctaactccaatgcattttccccgctagattccaaataagttttataatttaatattacaattggcgtattcataaataattccccaaatcattgatttaattaatatttttgatttgaaataatttaaatttaaccaaaatacttttggataatatccaaatatacacaaaatatatatgttttccaagataaaatgaaacacatgaacaaagcagccaaactttgtatagttttagctgcaattatatgcttattcagcattacagcttacgaatcaaacaccccaactaaagaggagactttaaattcaagtgatgaatatctcccacctacaaccaacatcagcgacagctatctaaacagcagtgctgataaaaaagaaaataaccaccataccccaagtccaatacaccacactacaaccagctattcttatgactacgacaactcatatgatgatgccataggtgatgattactactacgatgatgcatactatgatgacaggtacggagacagctgggaatattatgacgaatagcagctcaaattattgagactgctaaataggatgtccactatatgttcttccatcacccctatcttcccatacatgttttccattatacattattccattatcccctctttcaccgaatctctcaaataattcgccgtcagacatttcaggatatttggcttttaattgttcacaggacaaatgatcatcttcataataagaagatgatttttgattagatgtatctttaaatccattatttccatcttgaactacattactaataacacttacattttgagttacattagtacttttatagttcccatccccatcaaaaacacaattaatagaataattaccaacaccacttatattaaaactaattaacccttcattatcagtaatatatttaaaattagattttaatcctttttcatcagttaaagttacattaactgttttattagatattccaagaccattttcatcagttagcttaaccgtacaattatctccatcatataaagttgcattacttgtaattgttaatgatgattcttcctgcggatttataaaaacaaaagcagaaacaataactgctaaaattagtataactgcacaaacaagaactaaaattttattatccataataaataatatggttaaataattattaaaacataacttttttcaaacaatactttttgatatacatgaattaaaaagttagtcaacaaacaaaatattaaattagtataataccctaaataaattcatagcattaaggatttttaaaaatatgtcattaaataaaaaacaagtagaaaaattagagtcaagcggatacagatttgttggcagccacaatcatgcagctgctaaaatatgtcactggaccaaacaaagtatcttagataagggagtttgttataaagagaaattttatggtattgaaagtcacagatgtcttcaaatggctcctgcagtacctaactgtcagcaaaaatgtgagttttgctggagagatttgtcatatacccaaacccaatgggaaggagaatacgatgatccgaaaaccataattgatgaagctgttaaagctcaaaataatttactttgcggtttttttggaaatgataaagcaaataaagaaaaattagaagaatccaaaactcctacaaatgcagctatttcactggctggagaaccgatgttatatcctgaaattgatgaattaatagctgaatttaatcgccgtaatttcacaacatttgttgtcagcaatggtcagtgcgtagacaaattaaaaaacttagaaaatgaaccttaccagctgtatctttccttagatgctcctacaaagaaaatatataatgatgtttgccgacctcaaattagtgaaggctgggataatttaaaccaatcacttgatacactagctagttttaactcccgtacatgcataagaacaacatgcgttaagggaagaaatatgactaatcctgaaaagtatgctgaactgattaaaaaagccagcccagattttgtagaaataaaagcatacatgtgtgtgggatcatcaagacacagattaacccctgacaatatgccaacatttgatgaagtcaaaagttttgcccaaaaaataggagaaaattgcggtaaaaaaatagttaacgaatctgaagtcagccgcgttgttttgcttcaatagctattttttctcctaatttaaatgcattttccaaatcaatcggaaactgcattttacgtgtttttaatttttcatcttcagtaaaaagatccattttatactttgaataatcaaactgataggtgtcgtaggaataaagatgaaacggttttgtaaacatcttttccaaaacaaattcatttttatcgaataaatcatggtagccaaattgtcttgcagtttcctcatcaagattcatagtgtaaatacatccaatagccatcttttttggagctaagctagtcatatcctcatcataaacaaagaatggaaagataaaacgctctaaaaagcacctcattaccccacttacatcaccaaagtaaactggagatcccagtattacaccgtctgcctgaacaatttcttccaaaattggtttaaagtcatctttataaacacattttccataatgacgaccattaatctttttacatgcaaaacagcttttgcagccattaaaaggaacatcatataaattaactgattcaatttcagcatcactgcaaactgattttattccttccaaagctttttctaaaagctgagcagtatttccatcttttctgtgactaccatttatggcaaaaaatttcattcttcagccttaattttattacaaagctcaacagcttttttagctgctttttccattgaaatttcatatggaattcctgcttcttcaagtattctttgaccttcttcctcattagtaccggttaacctaattacaattgatactaagcttttggattccttaatagcatcaacaacaccatgagcaacatcatctgctttagtaattcctcctaaaacatttaaaaatactactttaactggttcataatttagtactatgttaagggattttttaatactttcttctgaagctcccccaccgatatctaagaaagtagcaggttctccaccgtggaatttaatcatgtccatacctgtcaatgttaaacctgcaccattaccgataactgcaatatccccatctaatttaacgaaatctactgcttttttcttataacgtgcaagttttaccaaatcaggatgtctgtataatgagtcattttccacaacgaattttgcatcagcagctattaatccttcgtcagtcaataccaatggattgatttcagcggtttctgcatcatatttctcaaataatttatataatttgtatattacatcacccatcggagatattaactctgatggaacacccattttacgagctatttcacgggattcatatggtaaaaattcaattaaaggatttggatgatatttaattatcttttcaggatttgttttagctaaattttcaatttcaaccccaccttcattacttaccataataaccggttttttattggctctgtcaatggatatacttaagaaaaattctttaataatgtttgcttttttctcaattaaaagctgatgtactctttcaccattaattgtattaccaatcaatgaatcagcaactttgtatgcttcaccagagttatctgcaaatttaatacctccggctttacctctaccaccaactaatacttgagattttattgcaacaggtacacccatatctgatgcaatagatgttgcttcttcagcagaattggcaacatgcccttctaaaattggaattccttcctcgttaaaaattctttttgccatatattcgaaaaatttcattataacacctaattagaaattatatcctgcttcaaaagcagctatgtttttatcttcagttcctgcaggaacactagctttaattgattcaatagccgcatctttagatataactcctgtaatttttgtaatagctccaaccataacaatattagctacaattttaagaccaatatcatccattgcggttttggttgccggagcattataaactttaatattatgttcatcaataaaatcctgaacatcttcgatagttgttgttccaggatcaacaattaaaattccattatcctttaaatcaacaatatatttaagtaatgcttcatgagacattgctactaaaatatcaggactttgaactttaggataatcaattttttcatcactaataacaacttcacatttggaagctcccccacgagcttcaggaccataagactgggtttgaactgcttcatttttatcaaaaagacaagcagcttttcctaaaataattcctgcaagaattactccttgtcctccaaacccgccgattcttaattcttttctcatattatcctccagtttataaatctgattcatatgcagaattaacaagagttctgctacctgatttgtcttcgcttaatttttcaatattttcactaaattccggtcttgatttattggcaaattcaccagtgacaatttttccgattaattcatcatcactcataccttcagcatcttcttttgacaatgtatttattttcatagttactgccatagctgttggggttttgagattgtttttacgaccataataagttggacattgggaaacaacttcaataaatgaaaatcctggattttttagagctgttttaatagaatctaccagttcatcaacctgaacagttgtccatcttgctgcataagttgcaccagcagctgcaacaagttctgctaatttaaatggataatcaccatttccataaggtgcagttgttccaaaactgccttttggagaagttggactaatctgaccaccagtcattccataaatattgttgttaatacaaataacagttaaattaatgtttcttctagctgcatggattaaatgattacctccaatggaagcggcatcaccgtctccggtaaatacaacaatatccaaatcagagttggacacttttaaaccagttgcaaaactaagtgctcttccgtgagttgtgtgtaatgaatcacatttaacataacccggaactcttgaagaacatccaatacctgaaaccatagctatattatcaaaatccatttcagcttcttccattcctttgaaaaaagcattcataatactaccatttccacaacccggacaaaagatatgaggaagcctgtcttctctcatataaggaataaatttgtttccattaggatctttttcgactgacatttagtttcctccaatctcttcaatttttgataaaatttcttcaggagttggcaataatcctccaataacacctaaaagatgagtattagctgtagcgttaactgccctatctacttcataatacatttgacctaaattcatttcaacaactaaaacatcatttgcatttttagttaattgttttatttgttcatctgggaacggccatggagtatcaattttaatataacctacttttttgccattagctctggcttctttagtagcagttataacagacctaaccggagcaccataagatactataacaatatctgcatcttcacaattttcagtctggatagaacaaattttatctttattttttaacactttattgcataaacgtttaacaagagtttgatgagtttccggagagttagtatccggataacctctttcatcatgagttaaacctgttacatgtatattgaaacctgctccaaaagaaggcatcggattaacactttctgaatttttaaatggcaggaagtcatctttatcttcaggcatttctctggaaataacttcaatatcatcttcaacaacgattttttccctcatgtgtccaataacttcatcagctaaaacaaatactggagttctgtactgttcagctaagttaaaagcttttatagtgaaatcaaaaaattcctgaacactggatggagataaagctatcggttcatagtctccgtgagatccccaacgggcctgcatcatatcagcctgagcagccattgttggctgaccagtagatggagaacctctttgaacattaacaataacaattggagtctctgaaataaatgcataacctatattttcctgcattaaagaaatacccggtcctgaagttgcagtcatagatttggatcctccccatgaaccaccaataatagcgcctgctgatgcaatttcatcttccatttgaacaaaagctcccccgacttttggaagttcacgagctaaagtttcagctacttcagtagatggagtaataggataacctgcaaaaaatctgcaacctgccttcaatgcaccttttgcacatgcttcatttccttgaataaaaaattcttctgacatgataaatcctcctattcaccctctaaatcatttactgtgatagcctgatcaggacaagctatttcacatttaccacatttgtcacacctatctccaaaattaacatacggcaattgtacgctttttttattaggttcagaagatattgcgtaaacattctgcggacacatatataaacaaaggtgacaccctttgcataaattttcgtcaataataatcattcacaatctcctaaaaaattataataaattaaaatagattatgtattatatatgttttaatacatttaaaaagtttattataaatcatgataatttataggaaaataaaaaataaaagtatacagtaaaaacagattaataattaaacaaacaagtgttaattaagaaattttaaagtaaaatttgaacaaaaacaaaatttaaaagcattaacttgtttaaaattataaaattgtgagaaatatgaaaaaaataaaaacaccgataagcgatgaagaaataagtgaacttcaaattggagacaaaattttactctccggagtaatgtataccggaagggatgctgcactgccgcaacttgtagaactgataaaaaaaggaaaaactcccatcaatacaaatggaatagctataatgcatactgcagttagtgatgccggaatagctccaacaacaagcaataaagaagaaatagaatccacaattccttttttaagtgaaaatggtgttaaaatccatatcggcaaaggaatgttaaatgacgaaacaaaaaaagctttaaataaaaacaattccattttcgtaataactccacctgtagccgcactgcttacaaacaatgttttagaaaaagagtgtgttgcttttgaaaatgaaggcattgaagctttatataaattaaaagtagaaaatatccctggaatagtagctattgcccatggaaaaagtatttagaagaagaattattcttctgcttcttcttcatcttcttcttgttttttctcgaaggaatcaacaaagttgactttttcaaagtccatgttttcccagatgtctttagctattctgaatctagcaaaggttacatccatgtaagatttttgatcgaatttagcaacatcatctaaagttatgtttacaacatccccgtcaatatcaattacggttttgttaatatccatattaggagctgcgtaatgtaactcaatcatacttttaattttgtcttcgtcattgtcaatgatttcagtaacatcaacatcaaaaattaaatctttacctgctaattcatggttgaagtccacttttactcttccaccgttaacagttaagattttaccagtgcttccttcagaagtaattttcatacccggtacaggagtcataccttgtcttttgaattctttcattgggattaattgaattaattgtttgtttctaggtccgaaagcattttcactatcaatttcgatagttttggaatcgcctgcttctaatccaacaatagcttcttcaatagcaggtaataaatgatttccacctacaataattggaataggtttgtattctttgttttcatcaaataaacctgcttctttagctacatcttcaaaagtagtatcaaatatttcatcgttttctttaatttttccagtaaaatttaatcttacaaaatctccgttattaatagccataataaacgctcctaaataaattttaatgtgtaaactatgttaacattataacatttattaattttataaataatagtttattaatgttttcatgaatcattaacattacttaacaactgctcttataaaacttattaatacacttaaaattaaaaatataaattatgcaaaaaaagggatctgtcaatttaccacttcacggaggccatccgccaaaatggctgttttcaagaatggtgaaactgtcctgtgcaattacagaagttattcttgatgaatacggacctcacgagtttttaaatagaatatcaaatccatactggtttcagtcattttcctgcgtattaggctttgactggcactcctcaggaacaactacaacaactctcggagctctaaaacaatctattaaacccgaagaacatggattatatcttagcggaggcaaaggagaaaaatcccgtaaaactccagaaggaatacaacgagccggagaaatattcaatttaaaaacaaaaactgtcgaagaaatggtaaaaggaagcaaattatctgccaaagtagataactcctgcattcaagacggatacaccctataccagcataattttttcattacagaaaaaggagactgggctgttgttcaacaaggattaaacaccgaaaacaaatatgccagacgttatcactggatgagcgatactgcaatcgattttttggaagatccccatagtgcaatttcatgtgacgttaaaaatcctgaatcactaaacatgactgacaagaaaagtaaggaagctcaaaatatcagtgttgacttaattaatgataatcctgagcatttgcgtagctattttaaaagaaaagataatcagatgctattaacagattttacaatgccctcccaccatccggttttagatatggatatttcagataaggaatttgaagttcttaaaaatgcctgggaaatacagccagaaaactatgaggaattaattttacttaaaggaattggtcccaaaaaaataagagcactggctttaatatctgatttggtttttggagaaagcgcaagctgggaagatcctgtaaaatatagctttacccacggtggaaaagacggatttccataccccgttgataaaaaagtttatgacaattcaataaacacaatgagagatgctattgaccaagccaaattaaaaaaagatgaaaaaattaaagccatcaaaaggttagatgactttattagctaatattatctgttttcatcatgaatattaacatttttaccatgcgctgttggaataacttcaaatacaggattttcaaactccaaatcaaattccttaccgtccataagcaaatgctggaaaacagcaagagaagaaacttcagagtgaggttgtgtagttactgaaacattccaatcggcacttttatatacttttccaggaactttagccccaccaacaacaatcaaaatgtcagcactggatttctgaacttcactaacaatttcatgagcctgagagccatacattgttaagtgaactacttttccaccattgtctttccatttgttaataacacccatataatttttagcatattcaatttcaaaatttcctccccacctatcagcagtgtctctaacattttccataagtttatggtcttcttcaccacttaaatagattttactagctccaaaagctctagaagtcaaacatacatgagtggttatacgtgtatctcttccaattctatggtccaatcttaaaacatttacattcatcatatcacttcataaaaagaacaaagccactgacataaataacaatgccatcagccttccaacttcattagacattcccaaaacatcaccattagctataacaaaattgcgtttagcaataaatgctattaaagctcctgcaacaatagctccagccaaacctataactccaacaacatcaccaaccaaataagcaataactgctacaataactgtagaaagtatataattcaatatattggttgaataaataaagtaacatccaataccctgatccgaaggagttgaaagcaaagctgttgttaaaattgaagatttagataccatttcacaaatgattattgcagctatacattcataatccaaaacattgtaaagtcctgcgattgttaaaatagctactaaaaataaagttgcaactccaccagcacctactgatgaatctttcattacacttatttttctttgggggtcaccatgaaccatgactccatctgccatgtccattacaccatccaaatgattatatcctgttattaacattaaaaatgcataaataagtgctgctgtgaaaaatggatttaaatgcaacacatctgcacaaactattccaaacacagctgctaaaatacctacaactaaatgaatgaaaggccagcaccaaaccaaccttgtcatatattctattgaagtatactgtttaactggaataatagttgaaaaagacaaaagtcctaacagagatttgattggtgaaaatctttcatgttcattattttccatattttatctactcctcaaaaatttttgacatacatcccgcaattaaaccggcaaatatgtcatctaccataggtcctaaaccaccaataattccaggttttgcttcatcatagcgtttaaagttaaatgttgctttagttcccgcaatctgattagaaatagctaatcccaacacttcatcagtgtagagatatgccggatcatcacttacatcaacttcccttattcttccaccggtaaaatcagcttccgtcctgatagctgccatcaacaaagcaataacattaatatcacataatgattttaagatttgtgcctcaagtttttctgaaatttcttcagtaacttccacacctgcaacaagtgccaatcctgcttccaccaaatcccctaacaaaataccttcagatacaaagtaatccaatattccaaaagacaattcaagcttttctattgcgtcttcacagctgattataactgcttcctcaattgaagtagccaactcttcaaaaatcagctggtcatcttcatattgattatttataatatccacactgttttcatcaattaagctagtttgagccacattacaaagcactgccagaaaatcatttttatttaaaatattttctatatgtaacggtaggcaaagaccacgtaaaaactctgctttagctttaacaacagttttataaatttttaacaacattccaggagataaagttttattaatatataaaacatgatttatatcaattctggcatctgcgaaacctttaggagaattggctactttaagattttcagtgaaatcttcaataaccacatcattagccataaaagtaaataatgttaaatccccataagtatttgaaaaataatcaattgaattaactgcctgtgcaatatatgatccttcagaatggttgaaagcttctgcttttttagcagttttctcaaaatcatctttactttttaaaatattgacattttcaacaatgtcaataccatcactaacagtaaagtcgctaaatgctagaaaataatcagaattattaatacatatcccataatctttagtgataatattcaaattagtattttccatgatttaacctgttattatttatatgtagtatatggtatatagtaattcttaatataaattttttaataatgaaaataaataagaaatataggggaaaaatcatgacacttattatcgacccacaaaccggaggaatagctggaaatatgattataggtgctttagttgatttgggagccaatcctaaagaacttaaagaaattatggaatcagttacctcccaatttggaaaagtgaaagtgagctttaataaagtaaacaaatgcggaattgattcaacttactgtaatgtagaattactaagtgaaaataaacacatccactataaagatttaatatccaaaattgacaatttggaactggatgaaaaagtaaaggaaacttctaaaaatatttttaaaagaatagctattgcagaatcaaaagttcatggtgaaagcttagatgaaattcattttcatgaagttggatcaagtgatgcagtagcagatgttatcggatcagtttatggattctacagtttaaatttagacaaagaagaagtaatcggactgcctgtagctttaggcggtggccgaattaaaacaacacacggaatattgcctgttccagcacctgcagtgctggaaattctaaaagatataaactgtatcggaggacctgttgagagtgaactggctacacctacaggctgtgcaatttatgctgaactatgcagtgaatttaaaaaatttattccacaatgtaaaacctcaaaaatagcttatggtgcaggaaaaaaagattttgatttccctaatgtattaagaataattaaaactaaagaaataactgaaagcgataggatagatgttattgaaacaaatattgaccatttaaccggtgaagaaataggttatttatttgacaaattacttgacgaaggagcctctgacgtgtcagttactccaattataatgaagaaaaacagacagggaagccttttaaaagtaatagctaaccgcagcaaaagaaatcatttaattgatgtgatgtttaaagaaataggtacattaggtattagaatatctccaaatttacatagaggaatagctaaaagagaattcattaaaaaatccgttgaaattaacggaaacatctttgatgtaacctttaaggttgcatatgtaaacggagaaattatttccggcagaccggagtatgaagatttgttaaaaatagccaataaaacagatatacctttaatagaagtaaaaaaaatagtagggaattatgatgactaaaaaagcaataacagttttatctggaggactggactcctgtgtagcaacatgtgtttatgccgaagactatgaaattcatggaataactttcaattacggtcagaaaagttttaaacaggaattgaaagcatccgaagaaatctgtaaaaaaatgggttttacccacgaagttattgacttgccttggcttaataaaataagcaattcatcacttacaagtgataatgaaattccaactttaacccatgaagaattggatgatttagacatatgtgaagacacagcaagcagcgtttgggttccgggaagaaatattgtatttacatccatagccacatcatatgctgaaagtataggtgctgaaataataattgttggatgggacaaagaagaagctgcaacatttccagacaactccaaagaatttttagaaagtttcaacaatatgctaaatgtgggatcaccgcaaaatattgaaattaaagcacctgccattgacttgaacaaagatgaaattgtaaaactaggagatgaaattaaagctcctatggaattaagttattcctgctatacaggacatgaaaaacattgcggtgtttgtgaaagctgcatgagaagaaaaagagcttttaagttagccgacgttaaagatccaagtgagtacaatgaatagaatagcaccattaattcaaaaaatgattgcatataatcatggagatgcaaaaagaataagccatgcacttaaagtccacaattatgcaaaaacaatagctattttggaaaaagttaatgaatatgatttatttaatttggaaagtgctgctattttacatgatattggaattaaagtttgtgagaaaaaatataattcaactgaaggaaaattacaggaaaaagaagggcatgcagttgcaagagaaatattggaaaacctggattataaaaacatcaataggatactgtttttaataggacaccaccacacatacattaatgtttcagggctagattaccaaatactaattgaagctgacttattagttaattttgaagaagaaaacacttccaaggaagatataaaaaaggtttatgaaaatatttttaaaacaaaaacaggaaaagaattttgcagagagatatttgatatttctccctaaattgtatggatgtcgaaagtaaatccgtctggcttttgaggaagttttgtagtggtattcacactaaaatctttaaaactgtcaccagttactactgtatcattagttccaattaatttaccgtccttatagaatgccaatgtaacttttaaaacatcatagcttccgccatcattggaagcaaaattctgaaacacactgcattcctgtgttgtatcattccaatctatttgagaatctccaacaaggttaaaattaccattaattattattttatcattatcataatttataattgcaaatactgcaacaattaaaattacggcagctattgcaattcccacaattaacctcttatccaaaacacatcatcaaataagattatttctcattaagtatataaatattcttatttagtgaacttataaaagaaaaaaaattaaatggttatcctattcaataaccattagaatatcaccggaattaactgcatctccagcttctacaaagatttcttttacaacaccgtcttcttcagcctgaatatcattttccattttcatagcttcaatgaccgccacagttgatcctttagttactttatccccaacatttacggtaagtttaataaccataccctgcatagttgaaattaatccaccttcaacaggagtgaatggtcctttttcagtttcttcaacttccataaatccggtaggcatgattttaacttcatatacgtctccgtcaacttcaacattatattgagttggaattccaatttcattatcgcttggaagagcaacacttttaagttcttcttcaactgcttctcctttaaggaattttggagcgattgatggatataaggcataagtaagtgcatcttcatcagatttgacaaaacctttttgttccccttctgttttatatttgtcaaattcatcttcaagtaaatctgcaggcctgcaggtaataacttcttcatcaccaataattttattagctattttagcattaactggtgcaggaggtttaccatagaaacctttcatatattcttttacttcattggaaactgttttgtacctttctccacctaatacattcattacagcctggatacctacaatttgactagttggagttacaagaggtgggtaacccatgtcttttcttacacgaggcatttcatcaagtacatcattatatctatctaaagcattttgttctttaagctgtgaaattaagtttgaaagcattcctccagggatttgatacattaaaacatcagtatcaatactttcagcaataggatcaattaaagccaaatatttttctttaatttgatcaaagtatttcttaatagcggttaatgattttaaatccaattcagtatcataaggagttccctgtaatgcagcaaccatactttcagtaggcggctggcttgttcctccggaaagtggggaaatagctgtgtctaaaacatctacacctgcctgacaagctgcataataactgatttgagtcattccactagtacagtgacaatgcaaatcaaccaataaatcagtttcttcttttaatctgcttactaattcataagctgctgaaggagttattaaaccagccatatctttaatagatactgaatcacagtcaagagcttcaagttctttagctaaatccacaaaatcatctaaagtatgaacaggacttaaagtataacttatagtcccttgtacatgagctccttgatctttagcaactttaattgtttgtttcatgttacgaacatcatttaaagcatcaaaaactctaaatatgtcaacaccattttcataggatttttctacaaattttgtaacaatgtcatcaggataatgtttatatcctactaaattttgtcccctaattaacatctgaattggagttttagtaaattcagattttaagcttcttaacctttcccatgggtcttcgtttaaatatcttatacatgtatcaaaagtagctccaccccatgcttcaacagagaaaaaacctattttatccatttcttcagcaataggaatcatatccctggttctcatcctagttgcaagtaaggattggtgagcatcacgaagtgcagtttcggtaaatcttactttagtcatagattaacacctctcattaattgttttttataaatcgataagtagaataaattataccaaatattatatattattttaactagtattaatatgtttgtttaaaaatataaaaaaaagaaaatgaaaaattatctttccaaatcgccagaaataaatttttcaacattttcataagcttcatcatcagtaacttggactggaggatgtttcattacataagaagaaattgaagttaactgaccgccaatacccctttctaaaccaagcttacagcatctaacagcatcaataacacatcctgcagagtttggagagtcttcaacacttaatctaagttcaatattcattggaacatcaccaaaagtacgaccttccatcctaaggaaacataacttgttatcatcctgccatggaacataatcactaggcccaatatgaatatccctgtcatccattctttcagctacaacagcctggacagcttcagttttagattcttttttagagtctaatctgtccctgttaagcatgtttaaaaagtcagtgtttccgcctgtgttaatctgataagtcctgtccagcttaactcctctatctttaaataaattagctaatgttctgtgagttattgtagctccaatttgtgccttaatatcatccccaacaataggaattcctttttgtctgaatttagcatcccactcactatcacttacaataaaaacaggcatacaattcacataagcaattcccgcatcaagagcacattgtgcatagaaccttgctgccttttcagatccaactggcaaataattcactaaaatttcagcaccgcttttctttaaaacttcaacaacatcaactggttcttcatcactaacaacaaaagtgtaatcatcgtcataattagacatatgtggtgcaacaccatccaaaacatgccccatacttacgcaaacatcatattttgggatttcttcttgaaaaatagttgtacaatttggttttgcaaaaatagcttcatcaatgctcttacctacttttctagcatcaatatcaaaagctgcaacaacatcaatatctgaaggtgaatatcctccgatatcccaatgcatcaatcctattgcatcatcaggattttttccatcataataatgtattccttgaataagggaacttgcacaattccccattcccacaattgctattttaattttattcacaataacaccagcctattttaattaaccataaatattaatatagttattttaccttaatatagtttataaaagtatttattaaagaggaaaaattatgaatccatatgttgaaataatccgcccaggaaatgtaataatggcaataatagcagttattttagtagctattcttgcaaaaagtgttgatattcccataatattagccatgttagctgtattttttgctatgagtgctggaaatgtaattaacgattattttgactataaaatagatttaatcaacaaacctcaaagacccatcccttcaggaagaatttcacttgacaatgcaaaaaactatgcatatcttttatttattcttgcggcaattgttgggtttttaatatcctgtttggtagacacatggattccctgcacaatagtaatcttttcagacattatactttacctctatgcatataaattaaaatccacaccactaataggtaatttaactgtcggattcatgacaggattatgctttatatttgcaggatacacctttaatgaaggattgataatttatgaatcatatttgcttgcatttttcgcactgataatgactactgcccgtgaaataacaaaagatattgaagatatggaaggggacatggcagaaggagccaaaacatttccaatattatacggtccaaaaatatctgcaattattgcaattagcctaataatcatcgattgtgcattatgtcctctgctctatatttatcatatttttaacatcaattatctgattgttgtaagtatagctgtgttaatattcctttatggagctgtattacttagaaatcaggattcaaaaacagcaaataaagtttcaaaatacttaaaaaccggaatgctaattgcatttattgcatttgctattggaacatttacaataactttttaaaaaataaattataaaaaaattatttaatgatttttaatgatttaaatttaaaaagtaatgatgctaagtttatattagtcgtccttataatcagttcattattagttgcttattacatccagtttacagaatcaatcggaatatactgttctgatgtttttgtttacttgttaaatgcactgtattactccggagccaatataaactcaacatcaacgatttatttatatcctttaatctcatttataacttcattattatttgatttgggatttaaaagcgaactttctatttatttagttactggtgtattcgcaatacttggaaatatcggattttatattttgcttagaaccagatttgatgaagtattgagtttaactggaactataatgtatgctacttttgcacttaatttagcatggttagctaatggaactttggatatacctgcggtggctgtaaccatatggtgtgttcttatctcatatatggctattaaattaaatccaaaatattatgcaatagctatgcctctttttgtaatctgtttatttacaagatacacagcaggactaattctaccggttttaatattatactatgtttatgaaaaaggatttaaaataactcctgaagacaaaccatacatcattaaaggaatcctgtactctataggtatttttgccattgttttaatcatattaactgtaatgagtaattttgaattaccgttaattcatgaaactgcaataagagtagaaggaaaacgcggaatgactgtaaatcaagcatacaatccagatatgaaatattactttaccaatttcccagaattcatttctgcttcaaaaacaacctttgtaaatgctaccccactacttgaaaattcaacagtactttcatggataagtcttggactattagctgttggaactgttcttggagcaatgaaaataagaatcaaacgcaataaagaaagtattggagcagcaattgcatttttaatatctgttgcaatatttacccaggtcagttccattgttacaataataattacatttatcggcctttatttaattggtaaagactcccaacataaagaataccttgcaatgttaggctggatactgtcattttacatattttttacttatttcaatatccgagttaacagatatattattccagcaattcctccaatcatatacttcattatgctaagtatcgaattgattcatgaaaaaattaaaatcaacaaaaatataattccactgattttaattataatgtttgtaattcaaggattcacatttacatcaacttacgaagacattccaaatttcaaagctcccgaagaaatatctaattacataatccaaaataaccctgattatgaaaatcaatcaattggagtttataatttaagaccttacagctggtatttacaaacagacgttgaaggaattccaacaggcaatactacatacatagatcaatccaatgtaacgtattacatttccaacaaagaactaagcaatttaactaattatactcaaataaaaaacatagataacctatatttatatgaaaaaaataagtaatatccactacaaaatgtgaaatattagaaacatatataataaaacagttataaaaattaacacataaaataaggcaaactaaagagggtaatatgaaagttgtatgctgtaagaactgtggtgctaaataccaactcgatgatgatgatgacataagtgcattcgagtgttcttcatgctcaggagatttagaagttgttgaaaattattctgatgacgacaattcctcaaaatctacaattataacttcacaaaagtatgatgattcatatatcgtccaatgtagcgaatgtggattaaaatataaactaaataaaaatgataacatacttgattatgaatgtgatagttgtggcggacctttaagatatttagacgaaaatatgaaccaagaagtagaccgatatcttgaagagagaaaaaatgaagctcctgaaacagtttatgaagaaaccgacagcgctgatgaatatacatctactgaaaagaatacaataacacctatacattctgttacacatagaatagaaaattttttctcagaagatcatatgcaaaaaattgcagatgaagaactggaaaaacaattggaacatcaacctgctccaagaactgcaagaactacaattccacaagcagtactgtccaagtttggaaaagaattttccatacctaaatcaaatgattataatgttttgaaaaaatatctaaaagatgaatttttcaaaggaatggaatcatattatgcagacattccggaaactgaaaaatcacataagtttttagaaaaaataggtgacaaattagcaataaaggaaccaagcactaacatcacatctgtaaatgatgaaaacactcaaataaacgaaattaagaattatagtaacacaaacaacatcattattgcaattggagctataatcttcgttttaagtattgtagaaatattaactattgatagcggatttggtatatttaccttgttaattggtgtattagtattatgttacggaatatataaaactagagacaccaaagaaacagaaacaagaactagaattatcagagaacatttattaactcttccagaggagtattatgttttctacaatgtaaaaatacctgcatcatctacaggtataaaccatgtagttataggaccttcaggaatttatgcacttatttcacaaaaatacaaagcaaaaaataaattagaatcagaaaatgaaaatttaaatttaattgattctattgaaaatgatgacaaaatagaagaaattaactcccattacggcagacgttttaagtatacaactaaacaggcaaaattctcacaggacaataaaataaaacaaaaatcattaatattaggtgaaaacctgattaatttccttaatgaaaacaatataaggcattgttttgttgagcctttagttggtttcataaatcatgaagttgttgtaataaacactccattaactgatgaagatttatttatggaagaactgctgtataaaattgaatacggccctaccaaattaaattctgaaacaatagacaaatgtgcagttttacttaacaaatattctgcagactgttcttcagaattttaactttttttattttttaaattaaatactgttttttaaaaaaaagaattgtaaagaatttatttagcattatccaaattaaattccctatacttagacttaacaacactccaacattcttcaaaaccatgttttaaatcaatttccaacattttgttattcattgcctgtctaagttcaaaatcattagccacaatattaaactgttctataatgtcttcctgagtcaaataagatccaagacccatatttacaaatccgtgttcaggacttccaaatagatttttctcttctctttcatccttacatataacaatacatggaacacctaaagaacagacctgatacatgattcttcccccagaagtgaaaataacatctgcagaaatcatgaagtcactgatagaatttactgttgtataaaactgaacattttgcataagctcatatttagctgacaattcttcaaaattttcatgtcctgaacctaaaataacattgattctgccagaaaacccactagctaaaagagcatccaaaactttttgagacaagttaagtgtatcatttggagcaaaatcaatcaaaacagttttaacatcatttgtaattatttttggctgatgcaaataaaattcatcttttaaaatgtaatattcatgccccacaaagaatttttcatcaccttcatgttcatataatgaatcaaataccagatccgcaagatctgaaccgcttccaaaatcttcaaaattaattatataataacccttatttgtcaaatcgaccatatactcataagaagtattacccacatcattaataataatcttcggatcaaactgttcaaataaaccaagcaactcagatttacctccatatgtttgatatttgtaattatacccttcaataatgtcaattcccaactgatgggttctattaataaagaatactacgtcatggaatacaagttttgatgccattgacaaacagcggtacatatgacctgttccaatctggtcataagcatcaacaacaaaagctatttttattttattaagataattatttgcaatccaccagtcttcataagtatttatttcaacactttcttcacgagaaatctcaatcaggtctatattcaaacctaaacgagatgtttcagttacaaaattacggcgagtagctaatatacctccggtttctttaaaagttttaggaagcaaatccctatataatctttcagaataaaatggaaaataccttccattttcatcatcgaatccccacctcagattcttatcatcaacaacagaaattacactatcaatattaaaatcagcgaatttttcaatagctttatctaatgtttcagtttttagtaacggagaagaaggttgaattgtaattacaatatcatattcgtcaaaagcctgtttttctttttgtaacattgcatcataaataacagtatccaataatgtttcatcagtagctaattctacaggacgcttcacaacactagtaccatacttttcaacaatcgatgcaatttcagaatcctcagtagacaccactacatcatcaacatattttgacgatttagctatatctattgagtaataaataagaggtttttcaccaagtaaacgtaaatttttacgaggaatgttttttgaataacctctagcaggaatcaccaccaatatcttattattttcaaacatataaatccctaaattacaaaatttatttaaacgttactaaataatataataatactaatattaaatcttttaggtgttaatgaatgaaaaatatgacaaaagagttgttagacaaaataaatgaaatagctactccagtaaaaataatgcatgtttgtggttcacatgaacacgcaattatggaaaatggaataaggtctttacttccaccagaagtagaaatcattgcaggacccggctgtccggtatgtgttgtaccttcccgtgaaattgacgaatgtctagaattagtcgacaggggagtgacagtgactacttttggagatatgttgagagttcctggttctgaacgttcacttgcagaagcaaaagcagaaggtggagatgtaagagtagtgtatggaattaataaagctattgaaatagctgaaaaagaggataatgacgttgtatttatggctgcaggatttgaaaccacagcaccaacaactgctgcagaaattttggcagaacctcctgaaaatttctcagtcttatcctgtcatagattaatccccccagctatcgattatttaataaattctggggaaaccaatcttaatgcattaattgaacctggacatgtctgtacaatcataggaaccaagccttttgaatatctttcaacagactatggtatacctcaggcagttgccggatttaatcctttagacattttaatgtctgtttatatgattttaagacaaatacgtgatgatacacctaaaatagataacgaatacaacagagcagttagagacgaaggaaatataatagctcaaaaagttatcgatcaagtatttgatgtaggtagcagagaatggagaggatttccgaaaatacctaattccattctagaaattaaagatgaattcagccagtacaatgcaagagccaaatatgacattgaagtaaaagatgttaaagaagctcctaaaggctgtatttgcggacctattttaagaggattggccagacctgaagactgcaaattatttagaaaatcctgtaaccccctacatccaatcggagcatgtatggtcagtaaagaaggaacctgtaatatagcccacagatattcaagggattaaaatgaatatagatgcaatagctgtagatattgatggaacaataactgataataaaagaagactttgttactcagctatggaagctatacgaaaagcagaagatgcaggagtccctacaattattgtaactggaaatattgtaacttatgcctatgcaacattagtactcctcggagctagcggaggagtagtgggagaaaacggaggagtaatatttaaagaaaattacaataacaaccagataaaaacagtagttgacagaacttatgtaaatgctgctgataaacacttaaaagaaagattaggttcaaagtttgataaaaacatttcaaatgacaacatgtacaggttgactgaaagtgtattttacaaaaccataactaaaaaagagctggaagagggattgaaaggctttgaatacctagataaaatagaattatacgatagtggatttgccctacatgtcacagacaaaagagtaaataaaggaagttcattaaagtatctttgtaatgaaaacggcatcgacatggaaaatgtaatggctatgggagacagcgaaaatgatgaagcattcctgaaagaagccggaatgaaggtggctgttggaaatgctgaagattttctgaaaaaaaatagtgactatgtttgcaaaaataactatggtgacggcgtaaaggaagctattgaaaaatttgtattataagagctgataaaatgatatatgaaatggctgaaaaatgtgaaaaggaagttaaaaaaatctgtgatgattacgaggtatacatcagttctggaaaaacaatagaacttgattctaaaaacgatgaattgaattttgcaaaagaagaaattacccaaggaattggaattagggtactgaaagataataaaatgggatttgcatttacttcagatatggataaaattaatcaaactgcacttcaggccctggaaaatactaaattaaataatcctgatgaaaattatgcattttcacaaaaagaaaaagtaaatgacattgacaaactctatgataaaaaatttgaaaacttggatttggatgaatccattgattttttaaataacatcataacaaaagctaatgaaacccaatgtgatgtaacttcagcaggattttcagcaagccgcggtgaatcacttatcttaaattcaaatggagtttcaattgccaataaaagtactggatttggtgctggattatctgtaaatattgaagcaaaagaaaatgtagctacagcatatgattccatttcttcaagattttatgatttggatggtgataaattagccgaagatgtttgtaaattagctatggattctgttgatacaaaggctattgaaactaaagattacgatgtagttcttgattattatgctgctaccggtcttttatccacttttttagaagcatttaacggagaaaatgttcaaagacaaagatcaattcttcatgacaaaatgaacagcgaaattgtaagtccaaacctatcaataacaaatgatgccactttagaaaaaggaatgtattctacaaagtgtgacggtgaaggaactgtatctaagaaaaccaagcttgtagaaaatggtgtgttaaaatcattcatgtatgatatttacactgcaaataaaggaaatacaacaagtactggaaacggttacagaaactcatacttatctacaccgtcagtcagtccgtcaaatataattcttgattttgatgaaaaaatcgggacagatgaaatatctgaaggagttttaactaccagcgttttaggagcacatactgcaaatcctatttcaggtgatttttcagtagaagcaagtaatgcttttaaaatagaaaatggtgagattagctatcctataaataaagcaatgatttcaggaaatatatttgaaataatgaaaaaatgtgaaggagtcaaatccgaaattaaacaatacggaccgtttatccttccaaaaatcttagtccacaacttaagagttgttggacaacattaaattttttttaattttcgtctgtaattatcaatagtggatgaagaaaaatctgttgataaatatttgcccactaactctttacttttgtcaaagtctttaatttgagtttgagaagctttttcaatttctttttctaaatttttaatcctattatcaaatgttctttcagatttaaggaaatcaacattagttttacgggaaattcttttaatctcttcatcaatgtctatttcttcattctttttagccatgctatgacctacattttaatgattggcaatcttatttcagtaatatattcttcttcgctgtctgcattgtgaatattttttactaaaacttcagtaggtgaaccaataatatcataattgttttcttgagctactttaaccattgtatcatagctatctaaaatattatcaatagaaccttcatgaattccacttaaaacgccatgttcaaataaatccgcagttttaataatatcttttgcttgtgcattaccttcaatagctatacctacatcaaatactgcatccccttgatttacactatgtcttggagagtaatatattataaaaggttccccaattgttttaatttcttctgtttcaacccaatccattaatttggaaagcaatacttccaaatcagaaattggacctttataattaataacagctattttttgatcaggaataattttatcttgaatttgcatttgattcacctttttttatttaatatttttaatttatgttaaataaatatacctcaacttcttctccttcatcaagaagttcaacagattttggaactttaacataaccgtcagcagtagataaagaaaatatagctccagagtctttaaatatcggttggatatcttcaccgtcaacttttactaactgatactgcatcctacccactggagaatgtattcttctggttagtttacctttaactacacttttttcgaaatttttgtcaatacctgccaattttgttaaaggaggagctacaaatgcattaaatatcattaaagcagataccggatttccaggcaatccaataacaattttaccatctacaatacccacaatagtaggttttccaggctggacagaaattccatgaatataaacctgacccagttcatccaaaacatgtttcattacatctcccagacctgcagaagttcctccagatccgattaaaatatccacatcatctaaagattcctgaattttagctttaagttgatcataattatccttaacagttcctaaaaacttagcatcagctccacaggatattgcatcatttttaatcatgtttccattgacatcataaattttaccgtacggcaattcattgccctgaagagtaatttcatttccggttgatatgaccccaacagtaggttttttataaacttcaattgtttcaaatccctgagaaagtaaaacaccaattttaccaggagttaaaacatcacctttctttaaaattaatttggattcttcagtatcagaaccttttttagctacatcctgagtaggagtaacagtagtcaagatattaactgcagaatccattttttcacagtattcaaccattacaactgcatctgccccttcaggcatagctgcaccagtacttatttcaacacatttgccttcttcaacaatcttatccgttgttgaacctgcctctaaaaaatcaataacttccaaagtctttggagactcttcactagctccaaaactgtcctgtgaaagaattgcaaaaccatcttttaaagctttatcaaatggaggaaaatccatcctactgtacacatcaccagaaagtactctgccgtatgcatcttcaacagcaatctcttcactttgaagagtgtaatatttatcaaataagttttgaataatttctaaagcatcttcggattctttaatttttaaaaattcagttcccatattatcccctttaatgaatacattaatatattaataaaagtaatatataaatagtttaatttatcatcaaccaaatggaaaatataaactatattgatggaggagagtacttgtcaaaaccaaataataacaatgaccagcaagaatttagaagagtaagaacacctaaaaaaggggaaattccaggagccgtggaacaaatcatgggtcatggtaaattaaaagttagatgtgctgatggaaatattagaatgaccagaatccctggaaaaatgaaaaaacgtatttggattcgtgaaggagacatcattcttgtaaaaccatgggatttccaatcagatgaaaaagcggatgtaatctggagatataccaaaactgaatctaactggcttgaaagaaaaggctatttaaaaatgtaaataccctttttaccctcttattattttaactgattttaatggattcaaaaatcaataaagccgatgcaaaagtccaaaaaatacgagaacgtaaaaggcgaaaaggtagtgaagatagaaaagtcggaagcgaagtcttcgacaaaataactttagaaaccctatataaattagctaaacaggattatattgatattttaaatggtgctataagtaccggaaaagaagctaatgttttaaagggaataactaaagatgaaacttatgtagctgttaaaatttacagaatagctacttctgattttaaaaaaatggattattatgtccatggcgacccaagatttaatgttaaaactaaaaataaaagacaactgatttatgcctgggtaagtaaagaatttaaaaaccttaaaagattgtataatgcaggagttaatgttcctgagccttacatcagtgcaaataatgttttgataattgaatttattggagatgaaaaaggaaatcctgcacagcccgttagaaatcagcctccaaaaaatcctgaagaatttttcaataagcttttagtgcaactgaaaaagttcgtgcatgaaggaaaattggttcatggagatttatccaattataacattcttaatcaaaatgaagaaccagttattattgatgtttcacagtctgtcgttttagacaatcctatatctcacgaattgctccaaagggatattaaaacattagtgaatgaatataaaaaattaggtgtaaaaacaagttatgatgaagtatacgaatatgtagacttcaaactttaacttcttcttttttagacggtttgcataaaatcaccaatgcaacaataacaatcaccaaaccgcaaagcattaaaactgttggaatttcaaagtaacaaataataccaaatattaatgctgcaataggttcacatccagacaataatattgatgccacccctgattccacataatttaaagctgttgttaaacaaatatatggcaaagcaaatgaaataaatgaatgcaatattaaaaacaacacatttgaaagctgattaacattaacataatgatttatctgtccaaaatttgtaaaagggagcaataaaattacaatcaatattaaagaataaaataaaatacagtaagtatgacatcccttattgattacttttgttgaatctaatgtataaaccgcacaaaatattgcagctccaacaccgcctaaaacaccgattaatgaaattgaacctatactgctttctaaaaatccactagccaaaatacatcctacaattgccaaaaacatcgaccctatttttttaacagttattttttcacctaatgtaaaataagcgccgattataacaaatatcggagaggtacccagcaatactgctgcaagagacaaatgaattgaattcatagcctcattataacaaagatttaatcctacaatactaatggctgcaatgataaaataaggcaaatactcttttttgattttaaataatgatttgtcagtcagcaacacgcaaacaaacattaccacagcagctattgaaaatcttaaaaacagcaatgttgttggatcaatcccattttcagttaaagttctgacaaaaatcccacttgatccaaacattattcctgctaaagcaggcaataaaaaataaatatttttcataatacttttccttaatttttcgtacaccgataatttttatcaaaacttctattaaaaagtatgttccataaaaaattttagaaattattaaataaaacaatacaaataatttatattacttataaaaggtgataagtatgccagaaacagattatttaaaaatacctcaaaatagaattggggcactaattggaaacaaaggagatgtaaaaaaatcaattgaaaaggctactgaaacaatcttagatattgatagtgaagacggaactgtttacatcaccccacaagaaaacatgagcgacccacttggcgtatggaatgcaaatcacattgtaaaagcagtagctcgtggatttaatcctgaagttgctcttaaattagttgatgatgatatttatttagaagtcataaaattgccattatatattggaaaatctaaaaatgcactttctagatacaaagggagaataattgggcaaaatggaaaaacacgtgaaataattatggatatggctgaagtacaaatggccatatacggaaaaactgtttcattaatcggtgaaatggataatatcatgatagctaaagaagctattgaaatgattctaaaaggatcaagacacaaatcagtttattcttttttagaacgtaaaaaagatgaattaaaacttaaagaatttaaagatcttgttggaatcaaggacgatgaaatcgaatttaaagacggaatcgaatttgatgaagaaatgatgaaatagtaacatttgaaaaaaaatgttacttaaactttttttacaatattttttaaagcagcgcaatattttgctttgaagtcaaaaattccaaaataaatagcaaaatattatatactttacttagcatatatagatagtgtaatgaaaatatcatgttttctacaataaatttattacttttttatctataacttagtcaaaacagatagagtactctaaaaatattacttttaaaatgctctctgacttgatttaaataaaaaatagattcataaataaattataaaattttgaggaggaaaaatttgtctcaacaagcaaatgaactctttgacaatttccaacaattgacaccatcagagttctttagaaaaaacaagcaaatgttaggattcactggtaaaatccgctcattaacaattgtttttcacgaattgattacaaacagttttgatgcagctgaagaagcaggtatccttccagaaatcaatattgaattaaaaagaattgacaaagaacattacattctcagacattcagataacggtccgggaattcctgaagactttgtaatgcaggtatactgtagtatgtttgcagggtccaagttcagaaacatccaatcaagagggcaacaaggtttaggttgtagtggttgtgtgcttttatcacaaatgactactggtgaacctgcccgtgtaatctcctgttatcaagagggagatgacctcaaaggagttaaaatgaaatttaaaatggatgttaagaaaaataaaggtatgttaatggaaagagaagatttccctgcagaacatactggagtttgtatagaattacaattcaaagatgtttcttactctatggcagaacagggtgcttttgaatacatcagaagaaccatgattggaaaccctcatgcaaaaattacatttagagacccgacaggacacaaatacatattcaaaagagctgcaaatattgttccgatacttccaaaagaagttttaccacatccaaaaggagttagtgcagatgatatcctctttatggccaaacatactgataaaagaagatacaaaagtatgttaaccagttcactttccagaatgtccaataagagagtaaacgaaattgaggaactaaccggtattgatatgaataaacgtccaaaagatatgacctgggcggaagcagaagctatcgtaaactgcttcaaaaaaatgaaattcatggcgcctccaagtaacggactcatacctatcggatcagaacaaattgaaaaaggtatgaaacaaattctcaaacctgaattcatagccacacttacaagaaaacctgtaacttacggaggaggtgtttctttcattattgaagcaggaatcgcttatggtggagattcaggaagagttgtaaatgaacaaagaaaatcagagattatgaggtttgcaaatagagttccattaacctttgaccaaggaagctgtgcaattacagaagcactgaaaagtattgattggaaacgttatggaattaaagacttcgacaattccccagttactttatttgtaaatattatttcaacacaggtcccttacctttctacaggaaaacaaagtgtatctccagaacctgaaattgttcatgaaataaggcaagctactatgactttagcccgtaaacttcaaaaacacttaagagctaaaaaagctgcaaaagaaaaagcaatgcgttcaaaagtatttgaagactaccttccagttattattgaagaagctgcaaaattaggagaaactgcagtacctgaatataatcaggttttagctaaagtaactaaaagagctcttgctgaattacttggtgaaaaagttgaagaagaggaagaagaagtagaagaagaagcattgattatggaagaacttgatgaatttggatatgctgttgatgacgaccacagtaatcttaaaaacattgaagaagacattccagaatatgaaaaagaagaataaacaggtgatttaaatgtctgatgaaataaaacaaaacccagaaggtaaatcacataaagaactaagaaaagaatataccttcaacaagttaaaaggattaggtcaggaaattattgaagaaatcgaaaaacaaaaagttccttctgtaaaagttccttcacgtggtacttcaaatattgtttatgatgaagcaaaaagatattatgttttaggagacagatacggtagaagatctcttggtaatgtaaaacaaatcagaaaattaggacaaatggtttatgtagctaatttctgtaaagatttggttcaaagggaaaaaacagcaacaatcagggaaatgtattatgtttccgaaggttggggaatcagttttaaaacacaacaggaatcaaacattgttggagaagatttagaagtaaccttaggaacaacaagggaagatttaggattaatgccagaggaagatggtgcctcagtatatggtgatttaaccttaaaagatggtgatgttgaaattaatgctttaaaagctggaaaatcagggtatactatttcaccaacaattgaccaagtagatttcctagactgtaatgtagacagagttattgctgtagaaaccatggggatgttccacaggatggttcaggaaaaagcatatgacagatttaatactttaattgtaggacttaaaggacaggcagctcgtgctacaagaagatttattaaaagagtaaatgaagagttacatttaccagtttatatctgtaacgacggagacccttggggattccatattgcacaggtaattatttctggcagtgcaaaactagctcacgttaatcatgatttagctacccctgatgcaaaatttatgggagtaacagctagtgatattatcaattatgatttgccaacagataatcttaaagacgtcgacgtcatgagattaaaagagttagctaaagacccaaggtataaaagtgatttctggcaaaccgaaattaaaaaaatgcttaagattggtaaaaaagcagaacagcaatccttctcaaaatatggtcttgaatatgtagtagatacatatttcccggaaaaattagaggctatggaataaatttattccttaaaattcaagcaaattttttaatttgcttttttcttatttttttattttaataatttcataacataaccactatttttaaaaattattattcatttaatagatttcattaaatattactccatttcaatttttggaaagccaataacctcagtaactttataaaacatttatttaactatcattttaaagtttcatcgaaagtttatcatttcacatcctttttgttttatctaccgttattttttatttttttattgaaaaaacaataatatgttttagatgaaaccagagaatattaacccttaaaataaaatataaaaaagtgatgaatttcagaagcacattacatcaaaaataaactgaaatagtgttatttttcctaaaaagtttatataatgaagtacaaaatgattatcgtgttgtcatatgaaaaatttaatatttaaaaaacagttgataatcctaatatcagtttttatattggtagcaggaatttctgctgtaagtgcaaatgaaaatactactgatttacatcaaagtatggaagcatatgataataacgttattaacactgatttagaagttgatgataataatattatccaaccaaataacactgatgttaaatccaatgttagtattgatataaacaactttgaaatgtattataaaaatggtactaaattaaccggaaaattattagataacaatagcaacccaataattaaccaaactgttagtattaccattaatggcgtaagctataataaaattactgatggcaatggtacatttggaatgaatatcaatttagatccgaatgtttataatttcacagtagcatataacggttcagacatttataattccgcatttaaaaatgctaaagttacagttttatctgttattaaatcaaatgatttagtcaagtattataaaaatgaatctcagttttatgctactttattagacgaaaaaggaaatccaatagctaacaacacagcagtccaattcaatgtaaacggtgtattctacaccagatataccaatgaaaacggtactgccaagttaaacatcaaactttatccagaacattatatcattacaattatacaccctaaaggtgaaaaaaaaggatataatattactgttttacctacaattatttcaaaggatttggttaagtattataaaaatgaatctcaattttatgctactttcttaaatggacaaggaaaaccaatagctaacaatactgaagttcactttaatgtaaacggtgttttctacaccagctataccaatgaaaacggaactgctaagttaaatattaacctttatcctggaaattatattataacttccatgcaccctgacggattccaaatgggagttaatatttttgtaaataaaactttaatcacatatgatattagtcagccatgtaataaaacaggtactgcaacttttaatgcagaagttttagacggacaaggcagacctctcagtaatgcttctgtaacattccttattgcaggtaaagttttaaccaaaattactgatgaaaaaggtattgcttctattaatattaaagcatatccaggagtttataccattacaacaacttacaatggttactctgtaggaaaaactttagagatttataacaatgaaacaggatttaaaagatataatttaggttcaaatgaaaatggtactgtccatttatacaaatcaattggtaataccagttcaaatgtaagaatagcttatattattggtgttcatataaccgaaaatgctgttcacaaagcattatttgatgaattaaccaataaatccagcgaattaaattactgttatgatatttataaaataaatgtagttccaatcggcaaacctattgatgacattaacaggatgagagggcagcttttaggacgtgattatgtagttcctgaagctataaaaaacaattattctcttgtagttgatgtacactccaatcagggaggagcatatgtcattactaactttgtttttgctcctgcacaggataatgtatccaaagctatagctaccaaaataatcaatgataatccaggtttacaggaatacttcccggcttcacaaacaagcccggcatatgtaactcttcctatacaaaggtcaggtacacctaccatactttatgaaacatataaatacgaagattataataatgtaactgtaccgtatgttgatttattgattgaatcagtcgataccatatttgattatatatcataaatgggaatttgataataaactaaaaatggagagataatttgcagaaaaataatattataattgcaattattattgtctgtattattctcgtaggtttagtattttatgcaacaaacatgaatactgactcagataatgcaacaaaagatggaaataattcttcaattaatttgacaaataatagtactttatccaatccaagttcagattcaggttccagttccggaggaagctcatcagcttctgattcaggttccagttcatctggttccagttccggaggaagctcttcaagtggaagttccagccattcaggcggatcaagtcatactggaggatcaagccatagcggagggtcttcaagtggaggttccgaccatagtggcggatcatccggaggaagctcatccggcggagattccggatcaggcagtggatccggtgatggatcaggtattatagatgtaagctaaatgtttacatcattttttctttttttataattaatttacaaacttaaatttctttttgcagtttcatcaactcaaaatatttatatactacaaataatcatataccctactaggtataggttgtgttattttgaaaaaatgtatggattctgaaaacctccacagaagattaaaaaaaataataggtcagctaaatgcaattgaccgcatgatcgacgaagatgttccttgtgaaaatattttaatgcaaataaatgcatcaaaatcagcactgcacaaagtagggcatataattgtcgagggacatcttgaacattgtattaaagaaagtatggaaaaaggagacactgatgaagcattggctgatgtatctacaattttagaatattattctagaatttaattttttttaaaataattttatacctataggggtatacctatatcaaggtgatttaatgaatattaaaaattggttaagaaaagaggaattaatagaaataacactaatgtttatttcagctatcacactgataatcagatttataaaaccaaacttattattctttgatttatcagggatagcaatcatattgtgcggactgccaataattaaagaagcaatagaagcactgatacacgaaaaagacataaaagcagatttgcttgtttcaatagccattatatcctcaacaataattggagaattatttgctgcaggagttattgctttaataatgactattggcgggtttttagaagaatatacagtaagcaaaactcaaaatgaaattaaaaatctaatcaacattactccaacaactgcaacattaataaaagacaataatactgaaaaaaagataaatgccaaagacattaaaacaaatgacattataaaagttttgccgggagaaataattcccggagacggaataatcattgacggcaattcatctattaacccggcagctttaactggagaatctctgcctgttgataaaagtacaggtgatgaagtattcagtggtacaataaatttatacggttcaataatcattaaagcaactaaaaatggagaaaacagttctgtaaaccaattaataaaattaattgaatcatcaaaacctgaaaatgcaaaaatcgtaaaagcagccgacaaatgggcaacatggattgtagcagttgcatttgtttgttctatcggaacatggattgtaactcatgaaattttaagatcagttacagtacttgtagtattctgcccatgtgcattagtcctagctacacccactgcaattatggcagctatcggaaatctaagcaaaaaaggaattcttgttaaggatggggagtctcttgaagaactggctaaagtgaatgacttaattttagataaaaccggaactttaacatgtggagaacctgaagtaagtgaaataatttcatgtaatgataaatactccaaaaaagaaataatacacattcttgcatctcttgaaaataaatcagaacatcccttagctaaatcaattgtaaaatattataaaaatcatgaaaataaaacattgaaagaggtaaatgactttgaaattattcccggaaccggagttaaaggaaaaatcagaaatgatgagctaatcgcaggaaataggaaaattctaaataaaacatatgaaactgaattagatgatgaaacaactgcagtatatctttgtaaaaataaccaattaattggagcagtactgctgtctgattttttaagaaaaaatgcagttgatgttattcttaatttaaaagccatgaatgttactccaatacttatgagtggagacaataaaaataccaccagaaatattgctgcaaaagctggaattgacaattataaatatgattgtttacctgaagataaaagtaattacattaaagaattacaattaaatgacaagaaagtagctatgattggagatggattaaatgatgcaccttcacttaaaaaggccaatgtaggaatttcaatgggcagtattggcagcgatatttcaattgaagcatcaaatattactttaattcatgacaacatccgcgatttgccccatttatttaaattatcaagaaagactttaaagactatcaatgtcggcattgcatttgcattgattttaaatctaatcgcaacaattttagccatattcggcctgttaaatccaattgaaggagcatttgtccacaatataggttcagttattgtaattatttatgcatcctctttattaaaatacaaatagatattttggtataactaaagtttatataggatttctagccaaataaataatcataaacaataaaggagaataaaattatggcaactgaagaaaaaaccattaacgttgttggaatgcattgtccatcttgtgtggctgctgttgaactttctataaaagatttagacggggtagaagatgctaaagctgatttggaaagcaacactgcaaaagttacatttgattcagacaaagtatctgattctgatttagctgaagcagtcaaagaagctggatttaaggtagaataaattatctgcctttgaatcttttttattattcttttttactaattttaaaatatcaaattttatataatttaacttacaaattttaatccatataacaaatttttttaaaaatttaatattaaaattagggattaaaatgaaatctgtagctataaacggatatggaaccataggaaaaagagtagcagatgcagtagctgctcaagatgatatgaaagtaattggtgtaagtaaaactagacctaattacgaatcaagaactgcagttgaagaaaaaggttatgatttatacattggaattccagaaagagcagaccagtttaaagaagcaggaattgaaatagctggaactgtagaagacatgattcaggaagcggatgttgttgtagactgtactccaggaactatcggtccgcaaaacttggaaatgtataaaaaagccggagttaaagcaatttatcaaggtggagaagaccacgaattaactggcctttcatttaatgctatttcaaactatgatgactcatatggtaaagattacacaagagttgtttcatgtaacactaccggacttacacgtacattaagtactattgacccaattgcagatattaaaaaggttagagcagtaatggttagaagaggatcagatccttcagaagttaaaaaaggacctatcaactctattgtaccaaaccctccaaaagtaccttctcaccacggacctgatgtaaaaactgttatggaaggtattgacgtgacaacaatggcattgcttgttcctacaactcttatgcaccaacacaacataatggttgaaattaataacgaagtggaaacccaagaaattattgatgcattagaaaaacgttccagagttcttgttgtggatgctagtgaaggtttaggttcaactgcagagcttatggaatatgctaaagaacttggaagaaacagaaatgatttatacgaaattccagtttggagagaatcaataaatgttgtaggtaacgaattatactacatgcaggctgttcaccaggaatcagatgttgttccagaaaacattgatgcaattcgtgcattacttgaaatggaatcagacaatgaaaaatcaatagctaaaaccaacaaagcaatgggaatcttataatttcccaccaacacttttttgataaaatgaaacataaagtaatgtttggacctgcaggaagtcctgtcaattataaaggagcagcctacaaggcaccgaaatatattaaagaagaaggtcttgattcttatgaatatcagtcaccttacggagtaaggattggtgaaaaatcagctaaaattttaaaagaagaatctgaaaaacatgacattctaatttcaatgcacggtccatattacataaatttatgttctaaagaagaggaaaaaattaaaaaaagcctcaaccatttaattgcaacagcacgtgcaggagaatggatgggtgcatacagattagtgttccatccaggtttttattcaaatagaaaaccgggaaaagctatggaaatttccaaaaacactattaaccaattatttgaagagctggaagctgaaggtattgaagaatttacctttgcgccagaaactacaggtaaacgttcacagcagggaaatgtttcagaaattatcgaattatgtgcaagttttgatcattttgaaccaacagttgatttcgcccatgttcatgcacgaggcagagggtttttaaataaaaaagaagactataactgtattttttcacagctggaagataacctagatattgatatccttcattgccattttacaacaattgaatacggtaacggcggtgaagtaaaacaccatacacttgctgaaagtaatgaatatggacctgacattaaggatttgcttgcaaatctcatagacaatggctggagagcaaatattatttgtgaaactcccctaagagatgaagatgctctaaagatgaaagagctttatgaatctatgatttaaactatttttttcttaattttaatataactaattcagaatcagtcctccacctcattggagtatccattgaacctactccagtagtaactgacagataactgccatttttttcaaaaattcccatattatatttgaacatcaatttgcaaaaccacctcatcggataaaattgccctccgtgagtatggcccgatagctgaagattataacctaagcgagtaaacaaatcccagccataaggaacatgataatttataatatttactgcatcttcatcagtagcctgttttaactgttcattagagacatcttccttatctccaaaagtaaaagataatccgaagatattcaatccattgaattccattttttcatcatccaaaataatcattcccgcttttttagcggccctgcaaacgttttcaattccaggatagaaatcatgatttccaggtgtaaatacaatcggcatatttacctttttaaatgcctgaaaatcatcttctttaactacacaagacccgtcagccaaatctcctgaaacaatagctatatcacacctatcagacaattcatttaacttatcagctacatgattaattatttttttatgtcttacagcaccaaaatgtatatctgacaaatggacaatgttaacttcctcttttaaattatcaaatttcaaagtatgctctttaactactaatttatgagcatgaaaataactgtaaactcccaaaattggcacaacagcaagtaaaatacatactgcaaaaagtgaaatgccaataaactgttttattgcataaataacaattaaatctattaaaatcatcaacattgcccactgccaaatcccgaatatttcagtgcaaaatcttccagcagctgttgattttttctcttcaaatatcattggaatgcattgcaggccacctaacaataaagtagctatgaacaaataaacatccttaactcctccaaaaagtaaaaagaaatatttcaacaggaaaaattcaaaaagcatgtaaaatggggttgctataaaaactctttttgttctaaaactcattttttcatctctaaacagctaattagttgatttattttaaaattatttaaatctttagccagattataacgaaattaataaaaataatgactttcttaattatgaaacataggatattactatgtatcccagaggtgtaaaaatgaatatgaagaaaattgtagtagcaggtggtggagtattaggcagtcaaattgctcttcaatctgctttttgtggctttgatgtaactatatggttaagaagcgaaggatcaatcgaaagagcacaacctaaacttttaagattgaaagaaatttatttaaacactcttgaagcaatgaaaacaaatcctgcagcatactgcagaggattcagctgtgaaaacgaactgtcagcagacaaaatcaacgagcttaagcaaaaagttgaagatgcatatgacagcataactttaacaacaagctatgaagaagcaggaaatgatgctgatttaattattgaagctattgctgaagatcctaaacagaaaatagcattttatcaggaattagctaaacacattcctgaaaaaacaattattgcaacaaattcctctacaatgctcccaagtgcatttgcccaatacacaggacgtcctgaaaagtaccttgcactccattttgcaaatgaaatctggagaaacaatactgcagaaattatgggccatcctgatactggtcaagaatattacgatgcagtatgcgaatttgctgaaaacattaatatgattccgttaaaacttaaaaaagaacaaccaggatacattcttaattccatgcttgttccgtttttaagtgctgcagaagcattatatgcagatggagtagctgactttgaaactattgacaaaacatggatgttggctacaggtgcaccattaggtccatttagaatacttgatgttgtaggtctaactactgcatataacattggtatgatgaatccgaaagccagcgatccggacaccattgaaggaaaagttgcagctatgcttaaagaaaaaatagatgctggaaaaaccggtataaactccggtgaaggattctacaaatattaaactaagaatttaaccattattattttttatgaacagttaaaaatcaccttaccatcaccataacatttaacaacaaatgcaacagctatcttaacacacaaacaactacttttaaatcagctaccttattgagggcaaatttattatatttttatatagtaaaacaaataaaatacataggtaataaaaaacaactgttgcaagttggtgactaaatgaaaacaaacaacaaaacccaagagacaaaaccatctaacccaaaatcaaaaaccgcacaaaaagaaaacactccttttgctgaaagtgtagttttaaaacctgtaggttatccttttgattttgcaatgatggaaaataatcttgaaattatcgataaaacactctttgaagagtatgctcgtgaacaatggttagggttagttgtaaaagaaaattcatatcttttcgatcaaaaaataattcctgattacggttttcaaatagtatctgttagccccaacaactcaataatcgctgaaaacactgaaattaaacttttagatattgaagaaagaaatttggatactgtcaagcgtattaaaacaaatgtcaaaatttcagatattgttggtcaggaaaatgctaaaaataaaaccaaagttctaatcaaatatcttgaagagcctgacaaattcggtgaatgggctccgaaaaacattttattttatgggtttccaggtaccggtaaaaccatgcttgtaaaggcactagccaatgaacttgacgttccgctgtatttaataaaagcaacttcattaattggagaacatgttggagacagtgcatctaaaatacaggaattatttgaaaaagctcaaaaaacagcaccatccataatatttattgatgaaattgatgcaattgcacttcacagaagctttcaatcacttagaggagatgttgccgaaattgtaaattcccttttaactgaaatggatggaattaatgacaataaagcagtagtgacaataggagctacaaataacccaaattcaattgattatgctgtaagaagcagatttgaagaagaaattgaatttgtcttacctgatgataacgaaagaaaatctatctttgaaaacaatcttaaaacatttccactcaaatatgatttgaatattgaaaagctagttaaaatcagcaaaaatatgtccggaagagacattaaagaaaagattttgaaaacagctcttcaccatgcgatttcacatgacaaagaaactgtagataacaaagatgtggaatatgctctaaaagcaagtaaaattaaaaatagtgaagtaaaaggaatgtttgaataaaaaccttctttaattatttttcttcaaacataaattcaatagctctgatcaattcttcatcattttcatgagctgcctgtttaatttttttagaaatatcaaaaaatattttgttgacaatagaatttgttaaattatctattattttagcatttgcatctacatcagaaagtttggcaatcgccttttcagtttctctttctcgtatattttccatagatactcttaaattagcaataatatcttcaacaccaattaacttaaaggattctttaagtaaactgaactcttcatcgatgatattttcagcttctgcaaattctttttttctgagtttagtattttcatctgcaatctcacgcaaatcatcaatgttaaataatttaactcccaattcgcagacatcttcgcaaatatctcttggattagctatatcaatcattaacaagtctttaaaatctccatcagtcttttccaaacgttctttatttaaaatataatgaggagcacctgttgcacttattatcaggtctgctgtttggacatatttgcctaattcgttaaaaagaacagcatgaccgtttaaatcattagccagttcaactgcaacataataagttctgtttgcaacaaatattgcatttaaatttttctcagccaaagccttagccaccagcttacccatcttccctgcaccaataaccaaaacagacttgttttcaagattccccaaatgcttttcagccaaatcaacagctgcagaacctatggaaattgatcctttgttaatattggttttatttctcactacacgaccgacatgaatagctttagtaaaaatagaatccaaaatctttccgcaatgacgttctttaaatgccttttgcttagcatcactaacctggcctaaaatctggtcttcacctacaatcatagactccagacctgaagtcatacggaaaagatgcttaataacactgtctccataatcaataataatgcttttattttcatgagataaaagagaatcagaagcatctatattgtcattatgaatgtaatattccttacgattacatgtagatatttccacatattctacaattgaatacttttcctgcaattccaaaaataactgatccatttcctttgcaatattttccatagcatcaatatttgcaattttatggtcaactcttaaattaagtatcatcaaatccccttatcaaatcatcgatatactctttagcttcatctattttatggttatcaagtaatcctttaatattttcatcattgaaaatttcataaagatactgtcttctttttttctggtcggatatcctggatttaagcaatttacggctgtaatcctgaagttcaatttctaaaatatcctcttcagtaataatagattgaatcttttttcttaattggcgagccattaatggactttttccatttgtaaaaatagatatctcaacatcaccaatattaaaacttgtagggacaataatatttccattatccggaaaatccgccctatttaatagtttatcctcagctattttactgacataatcagacaattccctatcaccgctggctattacaactacatcagaccattgaactaagttaaccacatcatcaactgaagccaaaacagctcctttatcgattaattccttatctaaaacatcccctgctaatttaacattagctccatggtcaagaaatttatttgcccttcttgtagccacttcaccagtacctaatataaatacatttaaattggctgttttaagatatagggaagtccaatccattttaatcagcatttcctaaggatttaacacgtaataattttacagccattctcaaatcattattacaatcatttaaaacactcatagcttccatttcaccaatattgaaagtttcagctaatacttttacactttcatcaggagtaggcttatcaacaccaaccaatttatcagacaattcttttttcaagtccaaatattcatcatgagtcataccgatattttttaaagtaatatcacgtaacgggcatggtttagacggtttacaacaccatactaatgatccaaaacaagtccctgtcccttcacctaatttagtttcttttgcgaattcagttttaatatcaatatattcttgaggagttaagttaacttcgtccaaagcatttaatattggacaaggtttaactggagggcaacagaaagccaaaccccttttatctccacctctgcaaatatgagatggtgcatcttcccaagtcataataaacctccaaattaataatcatttccatgaaataatttatacatacataatttattttagtttatatataatcttttttatgaaaaaataggttaatcaatactcaatcgtatgactgatacacttaaattcattgccgaaatcatccaaataactttcacctttaagtaaattgaagtattttaatgttgaaggagacaatttatgaaaaacctgatatttagtaaaattattttcaaaatcttcaataatcacatcatatacttcggctttaggaacaaagcagatactgtatttaatattatttgaaacaagtaaagtttcttcaaataaaactgaatcagaatcataaagttgtttaatctttctttttgaatcctttgtcttttcaataaccggcaatctgttcacctaaaaatccctgtcatcaaaattaaaaaaataataatattaaactataaatcccaataagtttaaatttaatgttgcttaaaatgcttagttatatcattaatggaaacatattaaacaaatccggccagttttagctgtaaaaaaaatatttaattttaagtaaaatgaaaataaaaaaaaggaattaatttttaaacattccttctttttcatctgcagttaactgtttaactatttcatcaggagttcctacatcaaggatttttcctcccctcattaaagcagatctatcacaaacatccaatacaaagtccatatcgtgagaaataataataaatgtttgttctaattcttttctagcttttaaaatagaatcagttacaattacacgagtaattggatccattgtacctgtcggttcatctaaaataattattttaggctctttaataagaacctgtgcaagagctaccctgtgtttttccccaacacttaattcgtcaggatatttgttaagtaaaccttcagctatattttcatcaaaaccaactgttgtcaatacatgaatagccttgatttttgcaaattcagcaggcaattccaaactaatagcatcagttaagtttcctaaaatagtcctgtgaggatataaagaatattcctgatgtaatagtcccatatatggaattacacgacccctgttaagaggaccgcttttactcatgtcaacccattcttcaccaagttttacttcaattttaccactacttggttcagtcaacccaattaacattttagtaagagttgtttttccagcaccacttaaacctacaataccaaagatttcctctttgtttatggttaaatcaattccatcaacagctttgactactcccctttcaattgaatagtaatgttttttaacatcatccatttgaacttcaggagcaccaatttcaggattttccactttttcaggtaccggtacagtttcaaggaaatgatttacaacaccttcaggttctccttcttctttgatttccccattttctaaccatataacatgatcagccaaatcattcatgatttcaggccagtgagaggtgattaacatagtgattcctttatcttttacaccttcaattaaagtattatgaagtttttcagcagtctgagggtcaagagtacctgttggttcatcagctaaaaacatcataggttgttttgctaattgtcttgcaagaactactctttgtttttctccaccacttaaatcacgtgcaacatgagtaatcctgtggttcatctgaaccatttccagtaagtctagagcatcatagagattatcttcataatcattctcatcactcattgccctcataacattttcaattacagtttcttcatcatataatgcgaagttacgctgtaacataatagcgattcttcttttaatacttgcgaactcttttctttcagcattgaagaaatcaatttcttttgcttcataagttccgccacatgaacatttttcacctgcatgggacggggattcaacagccaaacaatctggacaaatagccaaattaaagataacctgacctgcatcaggtttgtaatccaatgtacccctgagcatgttaattaatacagattttccactgccactacgtcctaaaatacctaaagtttctccttctttgattttcaaattaatatttttaagaacatcgacaccattgaatgtctttgtaatattcttaagagtaataaaatccatgaaatcacctttatataatcagtatttatttatcttttaaaccatttataatattttctaataattattgttatataatggtgttatatatttaaaaatcagatatattaaagtttaatttaccggaaataaccgccctagctattgaaaagccaaaaactcctgttttaagcattttttcaattttttgttcgctatctatagaattatttccaataactttaatattggtgttagaacagattttcgccaacaaatcatagtcggcatcaaaaattccaactttcattgcatcaatatgcagatagtcagcccctgtgttttcaattaatttagctatttttaaagtgtcaataccatcaacattagctcgaattttaactgaaacttcacaagaagcattgtcaacaacatccccaatatactcagccaaatcatctcttttcaacatattttgaccacagccaatagccaaaatttcatcctgacgacaatgacaattaatttcaacaatatccaaattgtctatgttacttacttcaataataggcctaggagtagttgatctaacattagctgaaactttaacattcggatgttgttttttaatcagattaacttctttttcaatatggttaacaatttcatcttgaggaaaatgaaattcatttcttccccttttaattattttttcactagcttctattgttttagcatctaaactgtaaccacctaatgtagctgtgtcaaatccaaatggaataaccttatttaaaaattcagcatcagttattccagccattggagctatgactttaatttagaagcccccttaatattctttttcaataacccatgtccacattccattatcatgatcacggatttcttcaagtcccaaatcagccatatatgcagcatcttccatattgcggccaacaccaatacctgctttaagaccaattccaatttcatcattgatttcaactaaaatatcttcaatttccttttcagacaatccattacatggagccatgaagttatctccaccaatgaagaacagtaatgctccttttttaattaatttagtcattaaataatgctgtgctttattaaccatgaaattagtgtcaaatgcagattcaatatcagtcaatgtttctgtaacactattaatatcaatatgtgctgcctgaaccaaattattttcatctgctggagctaaactatcaatagctaaaatttcttttctttttgaagattgagctccaccttctttttgtaaagcaatagtagctaatttttgagcttcatgaggagtttcagccgccccaacacccatactaatagtaattggatatctatttctaatagatctttgaatcctcaagtggtcttcctcatcaataccgtttgtaacagcaagtaaattatcaaatctagtaaagaaaactaatcctttcttatttgcaaattgcctttctaaatctgcatataattctgcctgtaaaatttgtaaatctgattcattacgtggtcttggagttacagtccatggaccataattatcaatttgtattaaagtcatttgtatcatttaagccaccattttccctaagaaatatcatttaagattattttagctaattttttcttatcatctaaatttttcataattgtatttgtaacaattacttcactaacaattttttctaaatcatcctttaaattattatcttttttgtcaataacaatcgtatctaaaaaactttcatataaagaagcaacacctaatgatgaaacttcaattccaagtgcatccataaatttactggccggaccacttactgaatcagtaccaataattggagaaactgctattacatgagtattttccaaagcttctttaactccatctaaagacaatattggagatattgaagttatcggattagatggtccaataataactgcatcagaattattaatagcatcaataatcccttccgcaggagtcactttggaaaatttgacatccaaaacttcaggattgcactgatgttttattaaaaagtcatgaaattccaattcaccgatgtctgtaatgattttaatatctgaattttcattactcataggtaaaattttggaagggatatgcatattatttgcctgaatatcaacagcttcagcaagtgaatgattttccatcaatagagtcttttgtattttagtagctctatcaatatctcctatcctaagcaactccggagtgcctaattcttcaagcctttcatgagtgataaatgtatcatctttaacaccataccaaaattcttcattaatcatatcagccatagtgtacaataccgtgtcaatgtctgctgacacataaacacctgaaaaatattcattttctaaagtattgacaacaatagtaatatctttaggatcaataacttcttttaaaccttgtaataattttggagttccagttcccccagacagtacagtaatcatattaatttaatctccagactaatttctaaatacgtcaaattcttttggtctaagtaatggattaattccggttttcgtatctcttaatttatcaaaattatcaaatcctcggataataaccacaggaagaccttcatcagcctgacccataacaagagaagctgcggctgccaattcatcacctgtagctacttcactagtttgaagctcacgaccatacaaatctttttcgccggcccttttccataacggattgattccagaacatccaatagctacaccaacagcaccatttctaaaagctctgccctgagtatcagtaattaaaactgccacttcctcatcaaattcattttctaaaaattcccttatttgttttgcagacctgtcagcatcttcaggcataggagtagccaatccttcatcaacattggattcgtcaatacctgaatttgcacaaacaaaaccctgtttagtttcagtaatgataaaatcaggaccgacagcaactacttctctagattcatttataatagcttcaaccaatttagaatcttttttggactgtttagcaatgataatggattcttcagatggaattatgtcccccaatttgataacattaccttctgcttttgaaattaatgtttcagctattaaaataatatccccatgttttaataaacaaccttgtttttcaattgcatctttaattatttgacaaacatcgtcattaggttcaactaatggaatattgtctaaaccaattaattctattgacatattaatcatcttttaaaaaaaaataaaaaaaattaaggattgaaattacctatattccattccccatcaaaaacagccgcaccagcagttactgcttttttgtaattggcaaaaatacctccatcaaaaataaattttgcagcatcatcagctgtttttgcatcaaaatctacagggtcgtagaattgacttccatatgtggaaataaatacggcttcgccgtatgggattttgtcaaccaataatttttcatcattagctatccccacatagcaaacataatcatcctttttatttgtagatgtaacaactcctgcaatacgtggagtatgataatcatctttttcataatccaaagtaagcaatgaataagctattgcatctttaatattcatccccaaagctattttatcagctattacatctgtatgtgaaccattagacacaatagccatatcttttacaatacgtatacaattatatgtaatgtaagtattttcaaaaatatctttttcgaaaccttctttcggcacaatagatgccctattatcaaattttaagcattgcctattaggaaatgatctgctagacaccctatatgccacaaaaggtttaccttcacaattcataccaattgataaaattcttcccgtatacatttttcaacctctttaagtagtatttggacttctgacagcttcttcaggagacacacctgcaggagtagttataataatctctccaggttttatttgtatttgcccctcatcgataacattagctttaacagcaatagcattattcgatattaaattagacatgtctttaccatcaacaactactttatgcaaattagctacaggcataatataatactccgcatcaccagaaacatcagtcacattcggtttaccagttccagagtcagtagaagatgcatcatcagcagacatatctgttgctgagaaattactagtcacaaccaaaaaaatcataatcgtaaataaaatatctataagtgggactaagttaatagcaggtttcctattaagaaccttctctttatatgatttaacatcaattgtcataaaatcacttattgtcttaatttactttcaattatttcagcattaacattacacttttccaatataatatttgaaatacttttatctaacatactaggtttaaatgaaaccttgatattcgcataaggatcagaaattagtctagtgttaacaacaccttcagcttcttgaagagcttccagggcacattcaacattagcttcaactcttactttaactactgcataaccccagttggtcattttagtagccaattcaattttatccatttcattttcaactaaaccttgaatataggtatgaagaggtaataatacaatagctacaaataaacctgcaatagttgttgttaatgccacataaataccctcagccatagcagaaggattaggagtaacacctaatgctttaaaggtcatccagataccaattacagtaccaatcaaacctaaaaatggagctaattcaataatagttttaattgaatttaatcctttagtcattttacttacttcaacaatgaaaatttgttccatactttcttcaacttcggttttatttttataaccaatttttaaagtttcagaaatgattttagaaataggatttttaaaagaattaatttgttttaatgcttcaactgcccctcccctttccatagaagaagaaacaatacctaaaatttcagttgtatccaccttactaattttcttaagatacacaatttttcttaatgaaacaagaagaccataaataccaatgaaaagaattatatatgtaataattcctccctgtgtaaatatctccatgagattttcgaaaaattgagtcagatattcaactatcatttttatcctcaatataatattttataaaaataatttatttaaccatatacttaatagtttttaaaaaaaatagctattgagaatttttcattttctcaacagttgcccatgatttccttacaaaatcaggcatttcatcatatgtaaaattagttaaaaattttttagtgattgggtcggaaggataacctgaaccaattccacccattttaatataatctttgttaatttcagctatatgtgcatccctttcctgtttggctataatagatgctgcactaacttcaatataattatcatctgctttatgttcagctacaacatttactccagtgtcatttgcaagtttgttttgaaaacgttctgccttaatatcaactgcatcaacaatagccttttcaggatttaaattagaaagaattttctccattccaattctttcaatttcattaaggttgattccgtctgctctcatattatcaatatcctgagcagaaattactaccaaatcatattcaaacattttttttaatttacgggacagaattgttcttctattaggagtcaaacgcttagagtcttttacacccattctttctaaaacaatatccattttctcaggaacaataacccctgcaataaccaatggtcctaaaacagatccccgacctgcttcatcaattcccaatacatccataaaaatcagcgcaaaaaaagttaaaaaagaaataattgaaaaaattatttcatagctctaagacgaacttcaggttctaatgcaagaggttctgcagctacaatagcagtaccttttgctacaacagtcataggatcatcagaaacttcaataggaatagatatttcatcgaaaaccctttcttttaatccacggagtcttgaacttcctccaactgccactgcattattataaacacccatcatcaattcaggagataatctttctaaaataacatttaaaccatctacaatttcttgcataaatggttctacagcatcagcaactaacattgagtcgatgacaacttttttaggcctgttggtttctaatgatttaccaataacttcaacacttaagttttcaagttgttcgctacagtgaatcataccaacttctatttttgcagattctgcatcatgaataccaatagctacattatatttttctgcaaccaattcaactattctgttatcaatgtcatctccaccgcatctaactgtttcaatatcgttaataccaccaagggaaatgataacaatatctgttgatcctgcaccaatatcaataaccatagttccgtttggttcagcaataggtaaacctgcaccaatagctgctgccaatccttcactaattacaagaatgttttctgctccagctttcctaccaatctcttcagctgcatttttttctacttcagaggaatctccaggaataccaataacgattcttccaacactttccccctcttctataccaatttgcatagctttaataagtaaagcttgtgcttgagctacgttttcaatgactccttttttcaaaggtcttacagcaagaatatcttcaggagttctaccaagcatttttttagcttcttccccaactgctaaaacttcagacggatcatcttttttaacagcaacaactgatggaatttgatataaatcaaatttatctccagatggttttgcaattacagtgtttaaagttcctaaatctattcccaagctgttactaatgattctagtatcattaacttgtgattcctcttcttcatttccaaaaatattcatgactaatcctccgttacaatatctttaaaatcaatgacaaatatcctattagatgtagctatactctggactttttcaatatcctcatctttttcaactgaaatcagaattgttgataatacaacatcgcttatattatataatggctttaaagcagatttaataaaatttggtagtttaacattagaatttatatcaacatcaataaaacctgtagtttgagattcctgtaaaattgcaaatgaaactttagatttctcaagaacataaacaagatttttaatcatgtcctccggagcaactaaaaccattaaattaggttcttcagttaaataatggcgagttatttgtataaaagccccacctctctgattacaaagtcttttaaattgattaattttccttgaattaccatataacatgataaaatcaaattttttattcaatcgtttatcctttaatataacatgctccctaaatagaatttttacagaatgcttagaagcaattgctttataggctatgtcatctattaaattaacatttcctgcagctatacaccaaactttttcatcttggttttcattatccggtgttaaccgtgcagcttgtctaagtgcttgtatatcctctatcatttaactactcgcattatattaatattttacttcaacttaaaataaattacaacaaagtaattgaatttattaaagtttaacaattaataattacccattattattatatatattttatctttaaaaatataactttaaccataacaattagcataaagcataacaataattaaaatcaaaaattaattcaagaaataaataaattttcaaaactcatataaattagtttattttactaaaaataccattattcaatcattaaataaggacacaagaaaaaataatgagtaaaacaagaaaaaattaataacaaatgagttaaaaagtatttaatggagttttacatgaaattagaaagtacaaagattcaaagtttttttgcaatatctgatggaatatcactgatgaacatgctatgtggatttatctcaattcttcttgcgataaatcataattttgaattatcagcaattctgatgataatagctatcatgtttgactctgtagatggatgggtagctaggaaaattaatagaaatgataaattaaaatttgggcaaaatatagactccctttcagacgccatatccttcggtgcggcacctgcagtattcctctatactatcagtagtacaatacctcataatctttcaatacttccggcaatcattagtttattaattgtagcttgtggtgtcttaagattaaccagatacaatgcaatagcagattacatccaaacacatgactttataggatttccaattccaggaatagctattatattagctacattctatttaagcggattgttcaatatttatattgctttaatattaatgacaatagtgtctttattgatgattagcaatgttacatacccaaaatttgacaatttaattataatcggaatttctgtagtgctaatagtgttaattatacttccaataagtctaacactcttcggcataaacatacctgcattgatactattgatattttccttatattacctgttaattaatttaattaaaatcaattaaattacccatctacttttttaaactaaaagtaggggtataaatcaatgattgaccaaaaaccaagagatccattatatcctcaaggatttgaggatatagataaccttaaaaaccgtcaaataccacgaccaaaacctaaagaaaacgaagataatgatttaaaaatattaaaatcattcaatcagaaattaggaaaatatattggtccgaaaccaaaaaatataattgaaaatgaagaaaagaaaaaaataggtatgataattacaactttaattatcctaactttagtaatatccacatattatttcttaatttatgaaccgtcacaggaagagctaaatttagcaaaaacaaccaaacttaatgaactccacagtctttatacaggtgcactaacaagctccagcgaagctatgatattagaaaatgaaatcaacaatgccagaagcaaaaatgaagtggaatcaataaatatactgtcacccgcaactaaagcctggaaatcatttcataaaaagtccataaatgcaaatttagacccgtacaacagaaccatggcaacatatactgacaacaataccaaaaatgcaataatgcctgcaagtgaagctttaacaattgttgatgaaaacaatgcagaagttctctccaaaattaaatttgaaaaaccgaatacagtgtcagtgcctattttagtttcaagactgcaggcaggagccggacttgtaaatgtaggaagtgttgttgatatctacaccagctcaaattatacggaaaatggaacaccaaacaatcaaacaaatccagatataaagggatgtactgtagtttccataatgagatgtgaagaaaacggagaaattgacagtgaatactcaaaagcaaatacagttgttcatggaaacaacacaaatccaaatgaaaatacacaaaccttcaaatccaatgttttagaacttttaaaaggttcaataataaacggatacaatgaaaaacagacagccgaattattgcagaattacggtataaaattatccaattatgaaaggcaaattaatcttggagatttagatgcacagtatatgttacttgttgaaacccctcaggataaggttaatttcttattggacaatatggatcaaatcatattaacaattccaacaacaaatgcaccttcatggatggttaatgaaataaattcaacttacaacaaataggtaaaatattttaaactaaaaaataaaaagttgataacatggacaaaccaaaaattacaaccatagttgttataatttgtataatcatattaggattatatgcagcaggagaagttaattattactcatcaaaaatagctattgagaaaaatattgattctcctgttgtaaatataccaaccattggaattgaagagaagataaataatgtatctctttcacaaggtgttatgcatgatgcaaaatcatttacaccgacaaatggagatgttatactgtcaggacacagaactcttcagggatcaccatttttaagacttaatgagttgaataatggagatgtaattactttagaatggccgggaatcggggaagtaaactatactgtcataaacaagactatagtcgaaccaactgcccgcatcaatactcaaagtaatggaacacacatatatctaattacctgtgacccaatcggatctacagcacatagattaattattgaaggggagttaagtgatgttggtccaataaatgataaaataattcaaaataacccacatgaatcatatgcattaataataactactgcatttttagttatagggttaatattcagttatttctatcctaaggacaatagaatttacatattagctatagtgctgattatatcagcaatattattctatttctaccttttcccaatagattctaatataatttatgaaaagatattatggttaaacggaggaatgtaaagtatggatgtagatgaaaaatacttttcaaatataacctcaagagaaagagcaatatttgaaggtgcaataagtatgggagcactatttcaccaatttgttggaactcccgtaaataaaagttctaaaaaaagcttagaaacaagtatggaagaatcattaaaattacagccagctattgaagatgttgatgttaaaatcagatttgataaactagaagaatcaatgagcgactttgattacacttctttaactggagatatgcttgatgttaaaatatatacaaaagtaaaggatgttcaggctacaataagaatagaatttattgaagagttaaattatcctttaatgtatgtagaagacatcaattaaattattgcaggtgttgttatacaaacaacacccataaactattttttaatcaaccaactcaaaattaattaactgattggtttccaaatcctcatcatgtatattaacagatgtttgaggaccatcatatgttttataatacaatattcccttatctgtattgtaacagtctgaataaatagtatactcaaatttatcaggttcttccactaacgtacatcctttttgctgttcaacagatgccagaatatggaaaaactgagacacactttctttttcagaatctccggaaacggaattttctttaacaaaagctgcttttacaaaacgggactgtgaagaaacatcccccggaagaccaattgaacccattccccgactataagttgccaaatccaaattgcctccaaaggtattttcaggcgttctgtttgataatgccatataattatttaaattaaatagctgtttatcaaaaggagggttgtttgttaaaactcctacaggattatcataaatatccagtccttcctctacaacctctacaacaattgaagcattcctatctgaaataatccaatgaagtggagatggaggcaactgggcggaaaatttctcatctgaaatatttaagttttccaataacctttcggcatcactgatggtttttgcttgagataatatatatggaataatctcaaaagaagctatgttaactttagatttatctagtggtttgtagtcacagtaatccggaaagtttaatccccccatagctaatcctttctcattacatgcatcataatacaaaggatattcatcaatacctgcagctatgccaataatcccataatgattttcaatgtcctcagtatccctgaatattaaaggatagtttctaggagttatcgttactctttcattatatgaaatttcatagtcaaaattacggccaaaataatggcattttgttaaataatttgcagcagtacacataattaccaaacctccgttgataattaattatgtataatccatatttatacttaattatatattctaaaaaaaagagcagaaacaaaaaaattaataaatttctgttaaatcatccaataaatcagtcaaatgctgtttagtgatatgattcattaaaactacacgaatagctataggacatttagctactgaaactctccatcccaaatcttccagtttatcagccaaatcatgagcttccatatccggatgattaaatgctacaatgttcaattcaggttctacaacaacatcataacctattttttccagaccttctttaaaataatgagtattatccatcaagtttcctgcaagcttttcatagccttcgtttccaagatatttcatgattgcataagtagctgcagaagctgctcctgaacgagttccaacaattgtagattgtgttttaacagtcagatatggagaatcaacagccatcacttccagatactctttttttctaaacagaattcctccggcaggaattggtgccaaacccattttatgaggatcaacagtaattgaacatacccccggtaatgaaaaatcaaaaggcggaaattcataaccaatttttcttaaaaatggtattgaaaaacctccaaatgccgcgtcaacatggaagtaaatattattttcataagctatttcagacaattcttcaataggatcaaccaaacccaattcagtagttcctgcaatagctacaatagccacagtattatcggaaatattttctttaactgaatcaacatcgattttgtaattttcatccagtttagcttcaataatttttaaattcatcatatctgcagcttttttaaatgagaaatgagcagaatccggaattatgatttctccttctttaattcccttatattttcgggcatgatttcttgctgccctcatcgccatgatattagcttcagtaccaccagttacaatatttccataaggttcactaatcgataataattcaccaatagattttataacttcattttcaatatattttgttcctttaaaaagaccaggatctcccaaattagaatctaaaaatttacaataaacttctttagcaaatggatgtgcttctgtacacatagaacctaatattctaccatcactatatttatggtcttttgattggatttcatttaattctttaagtatgtcttttttagatattggtttatcttccatagtacaaccttataaggtgatatttaaaaaaaataaaaaagaaaataaaatttattcttgagatttgcgagcagcatcaagaataatttttttctcagctctagctacagtttttctaacttcagctacagcatcagcatttgaggatacactggtaattccaaatcctacaagtttttcaacaatgtgaggtacactacctgcttgaccacaaatactgcaagtaactccagcttcaacacattttttaattgttctttcaattaatttcattacagcagggtgttcttcagtataatgttttgcaacaaattcgttgtttctgtctactgcaagagtatattgtgttaaatcattagttcctaaacttacgaaatcaacaccaatttcaagataatcttcaatagttaaagcagctgcaggtatttctaccatcataccaaagtcaatgtctttatgagggattaaacctacactagcacaaagttcttttgcttgtttaagttcagcaggactttgtgataatggaatcatgattcctaagttggtgtaacctttatcataaagttttttaatagctttgaattcacatttaagaatttcaggttggtcaagttcccttctgattcctctccaacctaacattggattgtgttcttcaggttcgttttctccaccttccaaagtgatgaattcgtcagttggcgcatctaaagttctgtaccatacaggttttggataaaatgcgtctgccacaatcattacattttctgcaatggtgtcgattaattcatcttcccttccatcagcaatgaattttccagggtgaatacctgcagtcaacatcaaatgttcagttctgagcaatccaactccatctgcaccagtagctgctgctctttgggctgcttcaggcatacttacattagcttttacttcagtaacagttatgattggagctgcttcaacattagatgtagctgtttgaactgcttcctctttgttttcatgaattccttcataaaccaaaccttttttaccatctaaagtaactccaacattctcttttaatgtagttgtagctgaaccagttcctacaacacaaggaattccaagttcacgggaaatgatagatgcatgacaagttactcccccttcatcagtaatgattccgctagctcttctcatagctggaaccatatcaggagtagtcatagttgtaaccataatgtctccatctttaattttatccaattcatcaatgtctaaaatgattttgactttacctgaagcagtacctggacttgctccaagacctttaacaatgacatttttatcactgatagaagagtcttcaccagctacgccattgtcatcacctaatgtagtaattggccttgcctgtaataagaataaattgcctctttcaaaagcccattcagtatccattggttcgccataatgagcttgaatccttttacccatttcagttaactcaacaagctcttcatcagataaaactctttcgtttcttttatcttcaggaacatctactcttacactggttccgtcttcgtcttttacatacattaattttttatcacttatagtgacacttacaacttcatcattgcttttgtctacaacataattatcaggagtcacgtcacctgacacaacagcttcaccaagaccccatgatccttcaattaaagctatttcttcaccggtagatgggtttacagtaaacattacacctgccttatctgcaatagccattttttgaacaacaacagcaatgtatacttttgagtgatcaaaaccgttttcttccctgtaaaaaatagctcttgcttcaaataaagatgcccaacattttcttatgtaatcaattacatcttcactacctgaaacatgtaaaaaagtgtcttgctgacctgcaaatgaagcatcaggtaaatcttctgcagtagctgaagaacgaatagctacatcagtatcatcttcatcaactctttggcaaagttgattataagcttcaataattaaagtggacatgtcttctggaactggagttccaataatgatggatttaatttcttcagcagcagcttgaagttctttagtattgttgatatctgttttagcaagaatatccaataccttaccattaattccagcatcttccatgaattttccgtaagtttcggcagttactacaaaaccaggcggaacaggaatgcctgcttgagtcaattctcctaagttagctccttttccccctgcaattccaatatcagatttgcctaaatcctcaaattttacaacatacatgaattataacctctttggtttaaaatgaattaatattaatacttgacagcatgttctcaataaataaaaaacatcgccaatattatatttaatgtataaattttaacacttaaatatttaatcaaaagaagctgtaaaaaaagtgattgaaaaaaatttaaaaaaaaaatagtaagtaaaaattagttaaatttataaaactaattcttcgcctttgtcaacaacaattctacaggaaactggtaatttcatccctgctctttttaatgctaatttagcatcttcaaagtttttcttgttggtgtcaatggtaataatcctttgacctgctttaacaatagcttcaacactgattggtttaccaaatgcgtttctcataccactttgaaccctatctgctcctgcaccggtagccataggattttcccttacaatttggtgagggtaagttcttaattttaagtggtaacctaatcttccagcttttctttgcataagcctgttagatgcaatccttgctgcttctaaagagttatgtctaatttgagcaggtttttttacagctaaacttactgaaactggaaactcgtcagttaaattacccatatcatattgaacaattcttgaatttggggtttttctaatataatctcttcttgtataagcacgaaccattataattcctccgaaaataatccaaacatctaattatatatgtttgattaaaaaatagctatctataataaaattatagtgtatctctaaatagctatgtaaaaattatatataatcaatatatagaatacttaactatttaaacttagttattaataaatgttgtcctatttgaaaaattaaaaaaattatttatttaaaataaattttgttctttccaataatttttcaacaaaaggagttgccggatgatttaacacctcatttggagtatcaaactgatgaacaatcccattttgcataaccaatactttatcagcaagatacaatgcttccctaatatcatgagtaacaaacattacagtaatttttgttttttcatggatttctttcatttctttttgcagctgagttcttgttatctcatcaacggcactgaaaggctcatccatcaataaaatcgcaggtgacgcagcaagtgctcttgcaatacctactctttgctgttgacctccggaaagttcatgaggatacctgtttaaaatagaagaatccaacccaacaatatccagccacttatcaatagcctcatcagttttttcactgtcattttcatggatcaaattaggaacataagctatattttcccgaacattcaaatgaggaaacaacattgttccctgaattgcatatccgattcttcgccttaattcaacaatatcagattcagaaacatccttcccatttacaatgacactacctctatcaggagtgattaatccattaatcatttttaaaatagtggtttttccacatcctgaaccgccaatcatcgtgacaaaatcccctttttcaacacttaaattgaaattatctattgaaaaatcactatcagaataatgtttacttatatctttaaattcaatgattgaactcatataatcacctcatattaaatgtttacttactaaaaagtcatgtgctacatctgaagggtcttttccttcaatatcaacttcataattcatatgtttcatatcttcagttgaaatatttccagtcaaataatcaagtgcatcagctacttcaggatgatctattaaagtttgctgatttattactgttcctgcataataagaaggatagaaatccttatcgtcttccagaactacaatattggagttttccaagcgcccatctgttgtataaacatcaatcacgtcaacctgaccctgtttaactgcatcatatttaatgcttacatccaaatccattgtatctttaaagttcatcccataatcatcacagattgcatcataaccgtcttcacgtgcaaaaaaatcagattctgctccaaatgacaattggttagaaactttagccaaatcagagtaagtctttaaattatatttatctgcaacttcttttgtaactccgattccataagtatcttcaaaaccgtacttattataccaggtcatattgtagttatcttcataatatgaatttaaatcatcaaactgtgtttcatcataagtgctgtttttatgcaaaatacttaaccaggctactccagtatattcaggatacaaatcaaaatccccagattccatacccctgtgaattgtacctgatccaccagctactccagaagtaagttccacatttaaatctgtgtgtgcttcaataacctgttttaaaagttctcctgtaatgtattcttcagtatatgatttgcttgcaatatgaattgtatttgcagggttttgctcatatgcaacatatcccccaataagaatacaaacaataattatgcaagcccatactttcttatttttaaaatattttaagaattttggcctttttgcacctggagcagatattttttcaaagtatcccaatatcaaatcaatacatattgctaaaacagaaatcagtacacttcctgcaacaatcaaaggcatattatttgtagtaatacccctgtaaatagctacccccaaacctccggcaccaataaatgatgcaatacctgctaaagcaattgtcataactgccatattacgaattgcagacataatatgaggtaaagccaatggcaatttaatttttaataaaatttgcaaatcagtactgcccattccctttgcagcttcaataatcctgtcatcaatagttcgaattccagtgtaagtattcctaaccataggcagcaaaccataaatggttaaagctataactgcactggtattgcccactccggaaactggaattaaaaacccgaataatgctattgatggaattgtataaataagattaacaattgccaaaacccatttatttttcggatactcacttataaaaatacccaaacccaatccaataattattgcaaaaacaacagaaattaaagaaatttccaaatgctgaatcattaaatccgtaaaaaaatcactttgattaacaattaatgaccatgtttcagataacatttatttcacccataattttccacaatataatcacaattgaataaatagttatttatttcattatataatttcaaggattataaaagaaatattgaaaattaaataatattcaacaaaattatattataataatacaatgactataaaaattaacaaattaaatatgattattcatgttacaattatgacaaggaagtaaataaatgttacgattagctgaaacttacttaaaaatattaaatagtttaaaaaacataatttttaaagatgaaaataaaaggaaatctgcaacttaaatacaaaaattcaaagactgctaaaactgtttatgaatctttagaagttgacaatattggatttttagaatcaaagttgaaaaataacacaattgaatatgaattagacaatgattcacttgaaacttttttatcaacagctgacgatttaatagcatctgaaattgttgtagaaaaaattcttgaaacaacaaaaaaagaatgaaaaaaccattcacctatttaaaaactcaatttatattagcctattaaacattttaactatataataggaacttttatataaataaaaaatataaatatattttataaataatttcttgatttattaaataaatacaaattagagagtgtatatttatggaatgttactatcatccaaacaaagaaggtgttaatacctgtgccatctgcggaaaatctgtatgtgaagaatgcagtttggaaattgctggcaaaatgtattgtaaagaatgtttggaaaaaattgtaggaatcggattaaataataaaactgatgaaaaaaaagaaacacagaatacagctagcgaagaaattacagaaagacctgaacctgtaaggcttggtaaaaaagaagaaccaaacatataccaagaacctcaagatatttatgaggaatctatttaccaatctccaaaagaagaaaaagctatttttgccagtgatttaagtagcaatttagaccagaacaatgaaagtatttatgcaagtgatttgcaaaaagaatcacaagtttataacaattcaccacaacaggattattatcctgaagaagaggttagcaaagctattgcagaggattccccatacaatataaaaggaatggattattctaaagaaattaatgaaacaccaaaatcatactttaaaaaagaaagcgcaccttatttagaaccgtccaataatataaatcaagatcaaagtataggtcaaaatattgttgaaaatcaacagcaaacattgagacagcaaccacaaagtgctcaaaatgaatttgactactattcacaggaacagatagcaccgcagcaacaaggacctcaggattacatttatccagatcatacttacgaacctgaagaaacaagtgcaagaaaagctttagaagaaaaatacgaaagatatttggatgatttatactttgatgaaacagaagttcctttagaagaacaattagctaaagatgaagcagaatacggttcattaactaaaaaaccatatgttcctccaacatcccaaccaatagaagaatatacaccgcaaacaatggaagaacctgcttatgctcctcagcaaattggagaacaaacacacatcccacaggctaatgaagaaatgtatggacaacaacaaagttactaccaacaagaaccccaaataaggcaaccacgtagaagttatgaagaagaacaggaattagacagacaaatacgtgaacaattaaatatccgtagagaacagccaaaaaaatccaaaaaacctattcataacatcagatacgaagatgaaaaagagtcttttggaattgtggatattatattaactattatactgataatagctataataatcgtattattctacattgtatacctgttattcttaactagcagctaccctacatttttagatgctatatttggtcttcaagaccctggagaattaataggtaatttaatgaaataattcaatttcattatttactttttttctaaatttttctaaaacttcactgtttttataatccaacactctaatttttgcaggataattttcaatatattctgaaattacctttttagaaataggaacttctaaaatgcttagtattctttcactgaaatgtgttgaaaaacctcttccaatgactttttgaacttcatcaacattatcaaaaggagcattattgaaaatagtgttggccaatctttcattaaacatgtttaaactagctaaagtgtcaaaatcaaaagtatttgcagtatttaaaatagcttcctcatctctgacattataaattagattatcattagctatttcatgtttcaaaacttcaattgttttgtcaggcatcatatccttaactttatcaaagttattttcaacaatagactgcctaatcagagttccgcttacaccttcaatccgttttacaaaaatgaacttgttttcataatcaaagttgattttacttaaagaatttgaaaaagaagctataacataattatcctcttcaagtttgtctctcagaagaacttcattaactgttttatcaattattttataaggttttggagctacccaatggcctttagatattctatccattattaaatcaaaatttggaacttctttataacctctcggaatataatccgtgtttaaagctttaaacatcttggccaatgacagagaatactggccggagcccataattcccataggcggaccttcaacaacaatatctgcacctactgaaatggctatttttgccctaatttcacgtggaagtatatatggaatacctctcccacttcgctcaaagagcccaggcacaatagctacaaataatgcatcaggaacttgtgactttgcaactttcatgcaatgaaaatgaccattatgtaaaggattatactcagtaaagtcagcaaccaatttcgtttcagaattgttgtccaaagtttcggaagttatattcaaatcattgaaaaataattcctcatcacgcctaagaatatcttcagttaatgacatgatttataatatgaaagttaaattaaaaaaattttatgatttataattttaaaaaaaaagaaagaaaaatgagatttaattaaatcccctttaagctatttttatagtgtttcccacttggaaactgttccaatatgaagtaataatatattgtccagccattaaccttatattcaatgatgcaataccatctttatcagttactttgtgatagaatacaccatttacattaaatgatacattctgattagctaatggattgccttgaccgtctaatgcttgagcagtaaaactgctgccgtcaaggtatttcatagagagatcacttgttactaaagtcggcaatacatttacattattacccatagccaaatcatcaacaatagtagtaataatgtaatttccaggtcttaaagcaatacctaaactagctacaccattttcatcagtagttttgtgatagaatacaccgttaatattgaaagttacatttttattgatagctaaagttccatctttattgtagatagttgcttcaaatcttgatgcattcatataatatttagttaaatcattagctgcaattaaagatttgacagttacatcaaatcctttttcttcaccagttatatcattataagcagttaaaatataagctccaggcctcaacctaatacctaatttagcaataccctcagcatcagtagttttagtgtagaacaccccattgatgttgaatttaactgaagtattagctaatgcttttccggttttatccaagaattttgcaacaaactcagtgccgtccttatacattaaaacagtatcattagctaaaatagttggattgacagttacagtaatgtttttagagagcttatcataaatatctgaaccattataagaaacagttgcattatatatttttgatactaaattaatgcctaaagaagcagttccattagcatcagtagttttcttatatgtttgaccgttaattgtaaagtataatgttgcattagctataggattgcctttaatatcagttaaaatagctgccattcttgttccatcacgatagaacattacaacatcagaaatatttaaattaactttcattggattaacagctaaattaaatacattatttgaaacttcataagttttatctcctgaatatgtaacatttactttataatcaccagcaattaaagagttgatttttacactagctactccatcagttacatttgctttgtatgaatcttttccaacagtaacattgacaacaccagttgcatcttcaggtaaaattataacaagagttgaattttcaccggcgacaacatcagtagtgtttaaagttacattataatcagaaattttgccaattgaaaaagttttagtaatgttggttgcattatatttagcattgccattataaattacagtaacctcataatctccaacacctaaaactcccaaatcataaacaatagtttgtgaagcgttgaaattaatagtttcagattttccattaaacttaatagttacattaccattagcatcaaatggtaaaacatcaattttgattgtagcatttttatttatgatagcagatatatctgcattgattgaagcaccagcaggagtgttgttttctattattgtatcgttgctttttgaagtaaccgcaccatttccataatagtctttagaaataatataattgttagttatggatgtattggtacctgtagtacctgcaacagatactgcataatttttaccggaaataatcacattattgtctacagtaatattttttgcatttgcagcaagttgaattccatctccaacagcatcaattgtgttattttcaattataccatatccttttttaagtgaaataccaatattagatacatttatagagttgcctttaacaactatacccccaccaacaacattagtggacacatcaattcctgttttaatattaacaaaagtgttattaattataactacttccccaacatctgccacagcattaacacctacaaatgcattagatatgacattacctataaaagtattctgaccaacgagtttattctgcttggaattgccctgcaacttaattgcataacaccccgcagaacttataccagtagttccatttatgatgttgtttttaaatatgttgaattcactaataccagctacactataagtattgaaacccattcctataaaaataacatttgaagctttagaatatattttattatcagtcatattattataacttgatgaaacaatctgtattggagttttacctgaagattgagaaatggtattgttcctgatattacaataagaagcattcatcatataaatcgccccgttaattgctggaacagaagctgctgatgaatgaatataagaattaataacggttatatctttagcatgctgaattaaaataggtactaattgtatagcatcattattactccatttgccaacattattgtcaatagttaacccatttacaacagaaccttcacttccaggaacaaaattaaaccctacatttttcaaggtaatattatctcccgcaggcatgatagttaaatttttatttattacaaaatatttatcagacacattatcaatttttaaaatatctccattattaaaaggagcctcttctaatgcatcaccagtttcattatcaaaataatttccataattgtcatttgttattgtgtattcctttgcattatttgtataaataggattatcaataataactgaatcaacaggcacatcatttacatcaatatttgcattgaaagtgctgttaacatcatctgcagcacttactgcacccattgaaacaataaacatcaaacataaaaatattaaatacttaaaattcattaatatgtttcctccattttataatctaatcaaaaatatttgtaaataattaaaatatttttgatatataatatatggaaaattaaaatatttaaatgttatattttttaaaaaaaaaacaggataattaaacaaaaatacaatattcaaactagattatatttaaatagccccataaaaaaacaaaaaattaaaaataagaggtgaaaaacctcaaaaattatcttttattatatccgatagccaataatgcaaatataactacaataaccaaaacaatccaaatcagataattatcatcagcaatatctttagaaacattggatttttcaagttcatgaacttcaggtgaagaagaatcactactcaaaccggatgaactatcacccacatttgattcagattcactaaggctattcttagcagaataatgtgatttatctaaactatcaccaacatcggaatctccactggaatctgtagaattacttttaatatcatctcttgaatcatcagtattatcagcaacatcagaacctgaactggttgtgtttttattagtatctacattatttggatctttaacagaatttttacctttgacatactcatcccataaattcttaacaaaatcaaatattttatctaaaaatgaggtgctgtccccagtatattcttcattagctgaaccatcaaaatttttagaattatagaagtagctataatccattatatcgccagtaaaatctttaatctgatttttagtaaaattcatatattgggttttgtagtatgtttcattagctaaaattattaaaccatcattattttcaatgatattatgttcaatattaatttttgaagctcttgactcaaatattgcaccgtcattaagggaattgtttgcaaaataattatgattaacttcaacattacctaaaggaccatcaacatcagttataccatcaatataataaaatcctccaaacaatgaagaaataattccattaccatgagcaacagtattttcaatgaatgcattacctgcaattgtaatattatctcttaccttaatataaataacagggccaaaactgtcttcagtacctatttttctaaaaacatttccggaaatatctgtgaaatgagagtttatatcaatataccccttacgggagctgttatctgaacctccaccatagaaataattatttttaatattaatatgtcttccagtgtaagtactaatagcataatttgaatttataaatacatttgaagttatatccacattatttatatgttctacaaaaacagacttcttggaattgttaaacacattattgctaatagttaaattggcagttttatcctcaccaaatgaattgagataatgaattccattggaattttcaaaataattataagaaattgtattatttacacctccatcaattaaaatttcatatacttcccagtaatcaggattttcaaaataacctttatcagtagcattttcatccctataaaaagtattgcctgcaataaaagtattatttccatccatctttatggactgtgcaagagatcttgcattattattaataaaagtattgtttaatataatgcatctttcaccattgtcaatatttataggcgggcaggctgcagaattatttgaaaaggtgttgttaattataattactttattatatgctgcaatagcactggctatacctttattgcttaagtatacttttttagtaacatatgaagacaacatggaatatatttcattagaatcaaattcattatttaaaaaagctgaaatatctgcatttgagtaaacagccccaccatatttatcagataaatccacatgtttattcatgctgtcagtatatccataaatataatttccattaaatttagaatttttaactattaaattgtttccggaattataaatagctccaccatacatttttccgtttttataccagttagtattaaacagatgatttttaacaaaagaacagttgtcaacagttaaattattagcataattagctattgctcctccctgtaaaataccatttttaatttttgcataatttccaatgaaagttgaatcatgaatagttaaatcatcctgaagattatatatagctccaccactaactgaagcaatattaaattcaaaagtacaattatttaaaatcattgttccattattataaatagctcccccaaaagttgctttattattcacaaaagtacaattatttaataccaaaacaccgttattgtaaatagctccaccttttactccattggcattagtcagattcagattagataaagttaactttgcatttgaagaaacattgaaaataacattattattttccgctgaaatagtggaatgatccttagcagcaattgaaacatcatgatcaatcaaaatagtttcaccaacaacataatcagacccatccaataaaacatcatcatttaaagtcatattattcaaagaatcggcagcagaaactgaattgacacataaaaccagtaacaatcctaaaaacaaaatctttaatttaaaattcaattcttttcacctccatttaaattcaatatagtcaataaaaattaaagaaaaattgactattaattaaagtattacaatatacaatatttaaaactttttaataaaatataaacaactaaaaagatattaacttaaaaaaccaaaactaaagttaacagagggataaaaaatggacaccataatagaaaactgtaagctaatcaataaaacaggaaatttcaatgttggaattaaaaatggaaaaatagccaaaatatcaaaaataccatttgaaggcggtaaaaaaattgacattaaaggaaatttacttctcccaggttttattgacccccatgttcattttagagaccccggactaacacaaaaagaagatttcaaaaccggcagtgaaagtgcggctaatggaggatttacaacagttatagacatgccaaataccatccctaaaacaaacacctacgatgcactaaaagaaaaaatagctatagctgatgaaaaaagcattgtaaattacgagcttcaggcaggatggaacactttagaagaaatggaaaaaataatcagcttaaacccaatagcttttaaagtgtttatggatctggaagataatgaaactttagagcaaatatttaaagatttgggaactttaaaagaaagcaccccatataacggtcttgtagcagtacattgtgaaaataaagccatcataaatgaagaaaccaataaattaaaacaaaaagaagaaaatatccctcttgactacagctatgccagacctgcaaaagcagaagatgaatctgtaaaacaggctattgaattagcccgtaaaaataatttaaacttgcatatttgtcatttaagctctaaaaaatctctaaatttagccagaaaaaataatgtaagctatgaatttacaccacatcatttactgttagacaacagtgcatacaatacttacggcactatgataaaaacgaatcctccattaagagaagctaaatataaaataaacataagcgatattgatgaaaacacaattatcggaactgatcatgcaccacatacattagaagataaaaatcagggagtatggagttcttcaccgggaattcctgcattggaaactgtagttccactcttattgacacaggtaaaccgaggaaatcttgacttgaaactgattccaaaaatattatccaaaaatgctgctaaactttacaatttaaaaaataaaggatcaatagctatcggaaaagatgctgattttacagttattgatttgaaaaaagaaggtaaaatcaatattgaaaatttcaaaacaaaagcacagtattcaccatttgacggtcaggaatatgctggagaagcagtaatgactataataaatggtaaaatagtagcaaataaattataactaatttttaaaaaaaaagaaaaatgatgaaaaggtgtaatacacctatacatcatataaagcgtgtttaggacatgcatcaatacattgaccacataaggtacagaatcccataattgggaatttttcattacctgttgcatggagcatattatatggacatgcttcgatacagtcaccacattcgttacatttgtatgggttaaattctattctgtctctggttacagtttcgccatcaataactttttctattgaaccaacagataaagcatcatttgaacaaactgcagcacatgctccacatctaatacagcttgcaaaagatggttcagcatctgtttcttctaatgcaggacataacataccagttttggttactacacgaattgcttcagtaggacatttattagcacatgcaccaacaaagtcacatttttcagcatcatagcctaatccttcagtatctgcaggaactccttcagcccattcaacatccatacttaatgcatcagtaggacagagttttacacataattgacatgcagcacatgcatctggaattaaaactgacaagtttgcagaattagctttgataaagtctccaggacatgcttcaacacaagtattacatccgatacatttagataattctaaatcgaaagcattaatggttttagcacgttttgcaggttttttctcagcaatgaatactgcattccaaggacaagtttgtgaacataaaccacatttaatacaaacatcatcagctattgaaatggttcctccaatttcatcaagagtaattgcactaacaggacatggatctacacaggttccacaacctacacaatcattaatgtaaatagatcctttaccgtcaaggtcaataacttcacctttaggttctacaatacctggaataccaattacatcaacaggacagatgtctacacatttttgacacattacacagaaaccttcaacttccattaaatcgtttccagtgagtttaatagtgtcttgtggacaagcttcttcacatttaccacaggaattacataaagtagaattgaatactaaccttatttgctcttcagcaccttctgcaatagaatatgtttctacttttaatgcgccttcaggacaaacatcagcacattttggttctcctccacaagtatcacagtgaataatggaagtaggtgttacatcaatagctgaggttgggcaggtaccttcacaagcaccgcacctaatacagccatcttcattaaatactatcattattaaaacccctcaattagaattttttaatgatgtttccttcactgtctacaatatctacttcagctaatctcatttggctatccatagtgtgagttgcacaggataaacatgggtcatatgctctgataaccatttccattaagttgaatattttatcgtctacttctacaccaggtttgatgtaatctttagctacttgttgaatacccatttccatagctgggttgttttggatagtagctacaacaatgttagcttcagttactaaaccattgtcatcacatgcgtagttgtgtattaaagtaccacgagcagcttctacaatacctgcaccttcaccagcagttctttctaattcttctgggaattttggaccagataaatcttggtctaatgcatcagcagcacattcagcagatgctaataattcaataagtcttgcccagtggaataataatggtgcttgtgcatatccaaatttgtcatggaattcttcaaatgccgcttgtgcaagaggtgctgcatctggcattttatcagcaacgttaatcctggataatggtgctactctgtaaataccttctgggtatcctaattctttaatgtaagggaattttaaccaagagtaaggttttacatgttcagcaacaacatctttgtattctaagtttttgtattcagtgtagatactaccatcaacatcttttattcttacgtcaccgttgtaaacatcccatacaccgtcatttacaagaccacagtgtctggtgtcaccaaagtaacctaaagaattgactaagtctattttttcttcgaaaataggtttagctaagtcgagagtagcttgtgctaattctacgtttctttgagctctttgtaataaatctttttgagtttcatcatctaattcagttgaaatacctccaggagtagaggaaattgggtgaattggacgaccaccgatttttcttacaatttctaaaccatttcttctgagttcaattgcttgaagtgcaatttcaggttgatctttaataatttggaaaacatttctggtttttctggttccgtcagggatgattaaatcaggagcagctaagaagtagaaatgaagtgcgtgggagtgcatgaatgaaccccagttcataatttctctcattttatatgctgttggtaagattttttcatcttcgaaaccgaaaatttggtcaactgcttttgcagctgctaagtggtgttgaacatcacaaataccacaaattcttggtacaatcctagctaattcttcaactggacgaccttgtaagaatttttcgaaacctctgaattccataacatgtaatcttgtatcgactacatttccatcatcatcgagctgtacagtaattttagcgtgaccttcaatacgtgttacaggctccatagtaagttttaccatattattctcctcctttctgcattttcatagggactaaagcagcaggtaatgtgtaagtatagaaagtacctacaatatcatctaattgatctgctacagtttcaggatcaacagttttatcttcatctacaccataatcagatgcgatagcactaatcatttttgctccttgatctaatactttagaagtaggaccgtaacatcctctacatggaattgcaatagaaggacattctgctccacataaggaaacagttgcaggacccatacagattaaaccttgggaaattaaacataaatctttttcaggagctccaacttcaaattgtcttttaatgaagtccatagctaaaccagcaggtggtttttctctaggacatacttcacaaaggttagttgaaggtaattcgatagtttctccacgtaataatgttaaaacagcttcagctacaacatcagaacgaggtgggcaacctggaataattaaatcaatgtccattgctgaacttaatggtcttaccctgctttcaagagctggtacatcttcattaggaataattccttctgggttaacagtagagcatgaattaatgtaagcttcttgttctaattcatctacagtccataagttaccgagtccaggaattcctccgtaacatgaacaagttccgtaagcaataactaatttagctttttcatttaacatttcagctaattccctgttttcttcgttcctaattccaccttctacgatgagaacatctaattctggtacttcatcgtatttggtatccataagtacaggggagaattcaaaatcagctaattccaaaacatctaataaagattcgtggaaatcagcaattgataagtggcaaccggaacatccgcctaaccacatagttcctatttttactttatcagccataataactcctccaatctagttttcagcatctaattgttctttcaatggtgcaggacctaattctttgattctgttaaccatcattttaacagcttcagagaatttttcaccttcggatgcagaaatccaatcgtggtgaactctttcttttccaattcccatatcttcaacaagtttgtagattaatctcattctacgatctaacttataatttccagcatcatagtggcagtcacccatgtgacatccagctacaaatacaccatcagccccttctttaaatgcttttaacacaaattgtgggtcaattcttccagaacacattacacgaataactctaatattcggtgggtattgcatccttgcagtacctgctgtgtctgctcctccataggaacaccagttgcaacaaaacattacaatttttacatcatcagccatagagtttatcctcctctataatatttttactaatttgaaattattttcaaaccagtgaattcaaatttaaaaaattttttaaattcttctttaagacaaaaaatttagtcataccttaattttttaccttaattcacaattttatgtacttaatgagctagctcagcataacattaacgtactgattaatatattactataataattaatataaaggttacttagaacttaaagccaaaaagtttatatactataaaacaagatttttagaaattaataaaaaaagttaaaatttaaaaaaaagaaaagaaaaagggattacatcccatttacgctcatatcaatcattttttgagtttcagcagctaattcatcaggaagtccagtaatatccatacttaagaaacctcttacaatcatggatgctgcttcttcttcagttattcctcttgaagttaaataattgatttcgtcttcatcgatttttccaactgctgcttcgtgagacatttcaagatttgcagaacttgcctcaagttcaggaacagcataaatcatactatcatcagacaatactaatccatgacattccagatgacctttaacttcaggaacagttccggccaaatgtcctctagcaaatatttgagattcatcctgagatactgcacgggaaataatttctcctcttgaaccaggagcattaaggtaagctcttgatcctacatcaataatagaatcttttttacctccttgaatactttggaaaatagctcttgaatttgcaccgtcacaataagcagtaggataggactgtagagtattaacaggactggttaaaatataattatttaaataggtaccgttttcttcaactttaattcctgttcttggacgtacttcaacctgctctgcccagttatgaaccatagtgaaagttattttagcacctggttttacatacaattcagatactccgacatgcattgcagatgaaacatcttcaccagttgcacagcctgtaatcaaatgtaattcagagttttcttcagcaatgataacattatgtgcagtttgcataatatcctcatcactgataaacatacatgcttgtacagggaaaacttccttagttccaggtaaggaccttacaaaatatccacttttaattccatctttttcttcacgtaaagcggttttagcagtatatttatctgcatcaggttttacaacattccacatgtaatctttaacccagtgatatttatccagagcaacaccaatattcataacttcaactgaattggacattgaattatttgtaaatatattggactgatcaacttgtaaaaatgaacctgaccttcctttttcttcagtatccacaccaactttcaaaagagtgtttttagtttttttagatacatcatctaaatcatctaaaagatcaattccatctataatttcatctgaaaaattttcaattgtaacatctacaccaattggagcttttttatctttagctctttcggcatcatttaatacattgcgcacattcaacacatccgttaaatccttctttcctaatatcctcaataatctcagcaggattacctgaacaagctattttaccatccattaaaacatgagctttatccgcacttacaaagttcaaaatataacctaaatgagtaatcaaaagaccgcttctttttctggaatcatgctttatatccttatcaagtaaagtaccaatttcaccagctattaattccacattttcaatatccacaccagaatccggttcatcaaacatggtgaaatcaggcatttgagcgagtaattgtaaaatttcagaacgtttaatttctcctccggaaaatccgaaattaacatccctgtctaaaaattcatcattgaatttaagtttttgagccaattccaacattctggcatttaacggttcattaatttcttgatgggattctattttaagtaaatcacgaactgatactccacgaatagacggtggagattggaagcttactccaattcctaattggacacgttcagctgtagttaaattagtaatatcttcacctttaaatttaattgatccattaactacattatattgtggaaaaccaagaattgttaaaaacaatgtacttttaccggcaccattcggacctaaaagaacatgagtctccccctcatcaattgaaagattaatatctttcagaactcttttaccggccacttccacagccaaattttcaatttcaagtaacattttatcaccttatttaaaaagacataaattatataacattattacatttaaattaagatatataaatatgttataattataaatcccacatctaaatgtttaaaagaagttaatattcaatcaatgaataaatcaaataaaaaaaatagtcaagtaactgaaaatattattcagttacaataatgaattcaccgactttttctactttagcaaaaggaactaataatatatctccatttcttttagcacctttaacatgaatattacgaccgctttccaccctaatagcaatatcaacaatttttccagttttttcgttgataattaattcatccaagacaccaagaatacgagcattgttggtagctacctgataattcttaatttcgctccataacttttcttctcttttaggaatttgtttgttttccatcacatcacctgataaattttcattaattatataaaatattttaatttcatcatatttaaatttaaatagttttattaatgaaagcctgataaaatttttcagcaacgatactgtctttaagagtattaatatttaatgccaattcaattttgggcaaaataagctgatcttcatcctgaatttcattaatacttcttaaaacattcacaccagaaggtaccgcaccattaaattcataagaatacttcaaatctaattttttaaaaatttcaaccggaacctgtgcagacagtgaatctttactggattccaaatagttagtcagtataaaatcaatagtttcaccactgacaaacggcaaatcagcattaataaacaataatgtgtccttttttgatttggactcaaaaagagttaaaatataagataaatcatttaaatagtcaattccagaagtatttaaaatttgaaaattgccatttaatgattttaaatatttggttgtttcctgagtatgggggcttacggcaataacaacatcttcaactaatttagatgaagaaatattatcaagaacatatttaattaaaggtttgccatgtaatttaaatagaggtttttcaacatcaacttttagacgagttcccctacctccagccataacaatagcataaatcatgacaaaaacctttagaatcaattatgcatatttgctgccctgcaatttcatcctcttaccgagaatacatttctgaccttggcagcctccaataggtgatttttgagttcccatagaattcatacagcgagccataatagctgaacctaaagccaaaccgtcttcaacaaatacgaccttatcaaacttatcctgaaccgcttctaaaataagctgtggtttacgtccagtaatacctgctcttccagtaatacctaatgcagaacctggagtaacaacattttccttaaatgcaacatctaaaacacgtgtaacaattttagtacttacataatccatagtagacaataatgttggaagaccatctctgtcatagaatttagctccaagatccattaaatcttctaatttatcaccattaacacctacatcacaaccaattaaagttgtacctgcattttcagaagcgacaggatctaatgggacagtaccaaatctatctacatccataggaactttacgaatatcaattaatttatgagcttcctcagcattagcctgagcttttttagtattggcttttttaatcaacttatcagaatacaaatctaaagcagcaccattatttttatcgatttcaccagaacctctagctagagaatcgctaactacaccagccaaacctaaaaaattacctacagtatttgcataaggctgattatcattgacaatacggccagctaatgttgatccgaaatcaagagaaatacatgggtttctataatcaacatctgtccatttagcacctaacttaatacctgcagtaacaagttccccttccatttcatttgcaacagtttccttacctttaggaggaacaacactaactacagcaccgtcaaacattacattatttaaaagagaatgtttttgcaatctttcaggaagttgggaaacactcatagccggagacatttttcttggtgggatgcctgcatccaaacagccgtcagctaatgcaataactaattggcctgcttcttcagcagtagcaaaacctgctgttacaccagtagatctaactacaaaatccaaatcattatctttatcaacatgagctttttttaaagattccaaaacagtatctttaattaaatcagcaacagcttcttttgaaagttcaataccccaaacagttttaccaaaaacttcttcattaggtttaggcggacgaatatctctagtcattttcactgttttattgagcagataacattcactagtatttaaattagtagccataacaatacatttggttgtagtgttacctaactctacagaagcagttacataaaaaacatctggctttttaacagcaccaggactttgcggtccagccctattagcccttaaagaatctaaatttccttcatgagacttagctattataggtttaggacctttattaaaaattttacctaaaaaagacattattcaaacctcaataaactgtattaaaagttagttaataatatctttttataataatataaatcttattaaatgaatttgaaaaaaagtgagtaatatctttttaaacttattaaatgaatataaaaaaaagttggagaatagattagaataaactaatctatactaatttgttgattgggtgatcttcaacagcttcagtaccgaagtcagcagctgcttctgcaatgaacatatcggtttgtgctacagcagggaatgctattttagcgttatcgataggtccaaagagaacgaagtctccaccagtcataacttgaacaatgtttgcaccaatatcacaaacagtgtaagcagttttgtttccagcttttttgtagtctcttaaccaatcccaagcggaaggtacattgtgaataccggaacctactgggtatccccatttagctttttctgcaaaagtggtttttgcagcaatacctgcaccttgtcctaatggagtaactgcagtatccatcatgaacttgtcgataccacaatcagcagctacttcaagtaaacctttttcgtaagctccatcgtctccgttttcccacatagccattttaccgtcaacggtagcattcattgggttgaaacctaagatgatagaagcggaaatatcagtttctgcaagagcatctaattcagatttatctgcagccatgttaatggagttgtaaatagccctttcagttaagccaacttcatcagcatattgtgcaccagcaactctagcatcaccggaagtagaatctataaggaatggtttatcacagatgtcaccaatgtactcgatgtattttacaatagcttcttcagtttgaccgaaaacttgtacaatacatgggttaccagttacatcagacatttcaaccatgtcattaactaaagtttctgctctacttttatcaaaatcacctgtcaattcatcactaataatattgtgtccaccgtagaaaatagtacctgctaatacagtaggatattcccctggttgacctcccatttttacaccagcaaagtcaaatacgacttgctctttatcaaatctaaacattacgcaatcctcctaaaacatagtagttatcatagcaaatacattatatttcatagctactactaaaatcattaaacctattatcataccatataaaataccaacatccctacctgtttgttggcctaaacgttgataatattcccccacagtaaaatcaactttttcttcagcatcgtttaatttttcaacaatgtctttgaaatcatcgggtgaaaccattacttgaggtattgaattattttctttttcactcataaataaacacctctaacatccacataattttgcaatagctggaatgacaacaagtaaaagaactgctaaaacaataccaatagcaaatcctttgaatctagttgtgattaaacctgcaaaaagtttaccttcccttgcaagaagttttgagctgtattcagcatcttctgaaacatctttaataccactaatattaggtttattagaaatttgtaccatattcatgcctccttaaaatagtaagaataaagctccaattactaaagagaatgctaaaccaatcatgattccttgcactttaccagcataattacctgcaaggtttctttgaattgatcctaccatatctattttagtattgatatttctcattcttgcttcaattaaagcagtttctgcagaaacaactttcatttcttcgccgtcatcttcttctccgtcgtcaccttcaacggaaattaccatagcttcttcttcaaaagcaccagggtctttttcaacacattcgttaattttagcttgaattgcaccgacatcctcagtgtcaattaaatcaattatttctaattgttgttggaatctttcaaccccgtctaaaggaacattttcaacaaaaggaattgctccagttgctccaataattttctttttatcagggtcagcaccgttttcgtgtaatgctttgaaagattgacctgtaatatgtccttgtacttcagcaccagctaaaattaagaaacggatattaggattagatataatgtttgcaacaactttttctacacctaaattttctgttttacatggacctgcgattgctgctccagaaagttctgcttcaatatgtgaagctaatgttgttactgcaacaggactttcaggatcccctacaatgtagtctccactaataaccggccagccagctgctggttcttttttatcagccatctataaaacccccaatttaattaaaataggtaaagctgcgaatatgataattatagccaagacaaatccataaactatgtttgttaacataccagcagtaacatatgaaccttcccttccaggataagctcctgcaggactagtataaggatctaaagaactgactaattcatctgcagcaccttgaagtttagttacttcattgtttatttcatccatagagaggagaataacaccttcacctaaagatgcaccaataactccggaaacagggtcaagagccaaattcatattaggtacaatttgaatcataggtaacatttgagccatacataaaaccttccatttattcctctaatttaggccataatccagcccatttaactgaagctgcagcatcgcatgaagcttgaacaaataatctgaatgaaatgacccatccaattaatccaacgataagaacagcaaaccatccgaatccgccagtaatactggataaaagaccagtaataatcatagataagaatccagtagatgcagcacatttaagagtccttacttgatcttcatttggacctaaacatgcgttgaatggatgttgaattgccatagtacacattataaagaatactgcgataaatcctggagctacaacatattcacaaatggaatttgcatcaaaagcaccagttacagcagcagataaacataaaacagataaagcacctgctccagcaatttcaacagtacatcttaccataattgggattttcataccaataattttagtagcgattaatgcaacaacagcaccgataatcattgaaaatattaaaccaaatacaggtcctagcatgttaaattgtgggtatataagacctacagcaagacctgctaaagaaccgataataccaatagataatgtcatgtaaccaatagaaggtacaccagtacctaaaccgtaactagctacactacgtatagcattagctccccatacagtagcacatactgaaccgagacctgcaataactggaccaataacatcattgatactacataaataaattcctactaatccaccaataattcctaaaatcaataaatgattattgtttattgaactgacagcaccatcagcacttccaccagcagacattttaaatacctccagttaataatacacaaaatactccaactactatagatgcaatagcacaagataatgctcctctaccaatccttttaaatttaggatcgtgcataccttcaatagtaccaccaatgttataagaagcaataaccgaattaataaagaacacacctacacctaatatagcagctaaacctatactaatagcagggtcagtgaagtaagtagatttttgaacagcagcatcaatagcatagtatactaatccaccaccaaatcctccaaagagaccacctataagaccactaataaaacaagtagtaggtacaccgtgtccttcagtacccggagttttatacttttcttgattacgtttggtaattatatcaacaggcactttagatgctgcaggaacaatacctacaccatatacatatatgaaattagcaatgagcatagtaatacccatcataatcatagcacctattgcaccaccaatacctactacaaaccatggctcaccagtcatagttgcagcagtaataagacctgttaaacctgcaccagcagctaacatagcggtaccagtacctacaccagtagcggttgccatagctgcaggagctccccctacaggaataaagtgcacacctgcaccaatcataactccgcctatagcgacgaataaaattacaaaaattggatccataatcgaaacctccttaatcttcctcatatggtccgtaacggtttcttgcaaatacttctaatctgtcattcataataattaataaaatgacaatgatgaaaccaacgactaaaccaccataaattccgaatacaacagtattccaaaaactaaagaatactacaagaccaaaacagaaaccggttaaaggtccaccaaatttagcacagaagtttactacatccatagagttttttgcacccataggagcattagtaacaatatctccttgaatagctacaggagttcctccaccaaattcgaacttttgatattcactttcagcaccgtaatgaacatccccagttgaagaaccgatagctccaagagcaataccccaaagtactgctaagagtggtaatgggaatacatgtaatgtagtaccgtttaatgggataatcattaaatatgaaattccaacaatacaaaagctagttataaatccgtgaccaacaataggtcctaaagattgagttaacacatccataaataatggctgttcaaattgagattgaccaacaatcctacccatatgggatgtgacagtataaatagcgtgaacaaaagcagcgacacaagatcccattgcaattgaaataataggtacgaaacctaacataattaatacatatgcaatagatccagcaacaccacaccaaacaccataagcgaccggttcaccagaagccgctttgtttatcatacggtgtaaatgtcccatttgcggagcaagttgaacttgagagtttgggttactttgagaaccgatatcagattctaaatcctcagcagctccaccaatagttgcaactgcacccattaatgcgacaacacctaatgttacagggtccataattttttcctccatattttttattaaattgatcatttaataaacgtgagatatattcaatagaatatatgcgataaattgcgatttttattccatataaaaatcaattaaatgataccaatagaattttctattgatacttaactttttttcaatattaatataaatgttttactaaaaaattttaaggtatacttaaatttaaggaataaatagatgaaaaatcacctatttaacctatttgtttcaaatttattttgctggggtgatgacagttctttcaccggatggttcgaactctcttaatgcacctttagcaaattcttcacgaggtttactgaagtcgaatactaagtttttatcagcaaatgcgattttaactaatgggttgaaagaccaagcatctccacgagctgcgtgaggagcttgagcgataccagcgtattcaccttggtgacctacgttcattgcgtagttagggtagtttggtcctctcatttcgagtggtaaaccttcatcatttctgatggagaatacgttagctgcaccacattgatcttgtaaatcgtatccgtagaaacctaatctggaatgttgttctttgtgtaagtacatacctaagtaccatgcacttaaaccagtttgagcattaccagtagcgaatgcagtggaacaaccagctgccgctgaaataacagaagccctttgagatccaccgaagtgagtttcaagtaaagctgggtattcttcgtattgttctaatgcgtagaatgaaacttcagaacctacatcaagaacagtgtccatgttattaggtgcttcagttaatccaccatatttgtcttctacgtaatctttaccatagtaagtgaagtcatctaatacatcatcagtatatgctgcagtagcatattgagtgaatcctacaccaccagacatgtaagaacctaaccaaatttggtcgtataatgcagcacctaaagctactacatctaaggttgaacgtactgggtcgtcagcatttactctggaagattgacagatatctgccatgaaaccaaatggaactccacctaactcgttttctgctcttgctcttcttacaggtaagtaagtacccatgtgaataacttctgcgtgtttggatgcgtatgcgaagtcaccagtagctccttcaccagcacattggttgtatgcagaaatcattgacataccaatttgcattgcagaccatcttgaggtagtacctccgtcacaaactcttcctacgatagcaggaattcttacagcttgccatacacttccaccaacttcttcttttaaagctgctgcttgttcttcattgaactctttgttgatgtctaaaacgaatgctgaatcaatttcatcagctaattcatcgtcaccagtaaatactttaacataactgtcttgtactactaatgggtcagtttctaccatgtgttcttgaactactgctgcaccaggcattgcgtggtttacagtttctaagtattcagtgattgtttcaggagttacttcaatacctaaccttttttcaagaacgttgtgagcagtatttaaacctacaattacagttcttctaatatcgtcccaagcttgttggatagctgcgttgttaatgaagtgtaaatcgtcaccttctacataagtatcagtagtagataattggtaagacattaaagccctttgacctaaaggagtaccaatgtctgggttgtacattggaattcctcttttttcagcgatttctttaccttcttttacgaatgcgctttttctttcagattgtttccaaccgcccatgttatagaaagtggttcttttatcagttggaccttcactgaatttgtttttcattgcatctaagaattttttatctgccatacttaatcccatcctttaactggattgaatgcaccaaatgatctggatacgtgaatgttttttaacacttcaacagcttcagtatcatctttgtatgcttcaccatcaattctgtaaattgtggtttttgattttaaggtttcttcatctaatggttcacctaatactactggttcgtctaagtctacaccgatttggtctcttaccatttcaacgttaccagtttctttgttgaatacttgtcttctaagcatatcaaacattaaaccattttcgtctaaccttaaagagtgaccgtgtacacctgcacctctaataccagttcttgcagtatcaaagtattcggtttctaagaggtatttggaaatacgttcaatatctctttccctagcttcgataacttgtcttccggataaagtaccagtatcaattcctctgaatctgtttaaataagaccttgctcttaagtaaggttgagctggtgcgaagtacattgagtctacaaattggatgtatctaatcctgtcccctgcttttgcacctgcaataggggtaactaattctcttacaatgtcatcaggctcatccatttcatctaatggtgggtgaacacttttgtattcttcacctggagctctgtgacctaatatttttactacgtcttcatcagagatttctcttaacttttctaactcgtaatctggattacaaaagtttcttctgttttgagcaacctgagaagtacctggataaatttgtgccataattatgcatctcctaatgctaatttaacttttctaataatttcatctaatttttcctgtgagattgtttctccgcgaataactccactaacaatatcaacaatgtgtccttctgttttaacatcctcttcagatggcatgactttagaagtttttacaccaattttggcaaaatcttcacagtcaactggagattcacaaatgataatacaaggcttgtttacattccttaaaatcaatctagctttgtagattaaatgatttttaactcctcctaaatgaataacaagtaatttaaaattactcatttgttccacttccttatcagtgagaccaaataatgtaccaccagaagctggagcatcatgaggaacacctgcacctgcatttaataccattgtactagtcaaaacattggattcacgtaatccaaaagtgatttcacaaacaggtttagtaatatgtctacgtcctggagacatagcaacagctaaaacttcagccccacattcagcaaatgtgcctctttgtgcaagacctccacctttgcccataccacctgttgctctgcaatcaactacgtgagtacatcttccaatcattttaaaagtcatcctttctaacaatatttacatgatcttcaaaacttgaatattgatcagtcattccaattaattcatcaggtaaatctgcatcaccatatttaattctatcagaaactgttctttcctttctgatgtaatttgttttgtcttgattaatatcaaaaccaaaaggaatatgtttcttgcagatttcttcaatttttttaactgtagactccattgtcaattcaacaaaaattctaccagttttaactttaagaacaacatcttcgccattaatgttaatcactctacgttctctatattgtggcggtaaagtttcttcagtttttggaaatctcggaccatgaattacagtccttttaacatcttcaagtgattcgatgtcatttaacaacttttctgttgtgtcacttccaagcactcggtatgggaatatttcaatatccatttttttgccgtccatgaaaaattagatttaaatattaaattaattagatgtcacctttaatatcatcagctgctaaagcaacatatttgagaggttctctaaattcatcaacttgactgtatacttctttaattaaaccagaagttgcttctggtgaaaagagttgtgttcctgcatctaaggacatagcagcagctacacaagggatacagaatcctttactgtgtctggttacaacgtggttaccgttaaagagaccagggcctcctccaccgtagatagagtgactgaagaaagagaatcctacagctacaccttctgctctaccgtagtcaatacttggtaaaccagtagcaaattcaatgttatcattgaagtataataaagtggatggaataccttgagcagcacgagcagcaccaatgtttaccataacagcagcagcagcaccagcagcagcatatgcgttccataaagctgcgtcatcagtgttataaattgagaaatcggttaagtctttttgaggagcaataactccgtcagcttcagctctagcgatagttccatttacaacactaccaacagtaccttcttttgcattatcttttactaaatctaaaaccatattgtcagcattcataccttggtaagctaaacctaataagtgtaatctttcgtatgcaccaatagcatcacccatttcaaacatagcagtttgttcgaaaatagatgctaaagcagtagcttggaaagtgttttttaaggtagcagcagcaaaatcatttgctttaacacctcttaatgcataacctgcaccttcgagtttttgtggaatgtctaacatagtagcaatgttggatcctttgtaatctacagattgtgggcatctacctaatactgcagcttttacgaagtttgcatcatagatacttacgtcacatacatcaataatagcttgtactaatgaagttgcggtagataatggagcaacagagtattctgcagcaacatcaattcttttagatggaacttgtactaataatcttttacctccggaaataggttcaactttagtatcatcatcttcagaaatttgtatcatttctttcattttttctgcaattgcacccgcatttgctacaatatcaatatctaattcccttcctaatattttggatttgtctccaccgactgaaccagttttgacagatttttcaagaccttctaagtttactgcaacagttctttttacacctttaacgatgttttgaatagcagtgttcctgagtggacttaaagcttcgattggaacatcagatacaactaatgagcctctatcgtcgtataaatcgactttatcatcaaactttgccattttttccctcctaattaaatagagtatttaatataccacctatatttgagtgaaattttcacacaaaattggataaagctatacacaataattttgtagaatagctaaccatatggtatacagttcttattttaattaagatataatataaacattaccaatggaataatttagaaaactttataaactataagagttcctaaaaacttaagaacaataattacaaaagtaatactttaaacataagatatctgaatatttatttcaataataaagcaattaaaaaccatatttaaaaaaataaacttgatattattatcaaaaattattagacaactattattatacaataattactttaaattccgtgttaaatcaaaatttaaaaaaatatatcaaataaaagctccaataatataaaaattaataaatttaatacaagaaatgacaaattttttaaacaaacaaacatattttatcaaaaatactgtaaaataatcaacaattcagaaaaataaaattattataaaaaatggtaaaaataatactgaattagtttatataatactaaaaacataataaaaatattatgcaagttgtagcagatgttggaggaattcctggaaaagattgtaacggtttttgtaagtactgttacttcagaaaggtaaaagaagttaaagcatttggctgtgctcactgcttacctaataaaattggctgtgacagatgtagtaagggaataaccgactcacaaagtgaatttagatctccatttgaagtaattactgaagttcaaaatgctttgatgatgcaacctaattttagagaaaacgacattaaagtaaatattagcggaggaggagatgttagctgctatccctatcttgaaaatttaacagctaatttaaatcagttttcacttaaatcccatttaggttatacctgtggaaaaggcattactgaaagtgaaatagcttccagattaattaataatggtgtcgatgaagttacatttactgttttttcaacagaccctaaacttaggagagaatgggtaaaagacaaaaaacctgaagaagctctaaaagcttgtcaaatcttttgtgaaaatgctgatttaacaggagcaggagtaataattcctggagttaatgacggtgatgtacttagacaaacctgcaataccttggaagaatggggtgctaaaggatttatcttgatgagatttgcaaacaccttcaatgagggattaattttaggaaatgaacctattcttaaaggaattgaatcacagcctgttgaagaatttggtcagttagttgaagaaattaataaagaatataatttcagagtaacaggcactccattatgtgatcctgaaactggcggcccatttgcaatagctaaagatgaaaatgaaatatttttacaatttattaaaaaagtgaccggagaagctaccataattacatctaaaatagctgcaccatttataagtaaaatatttgataaaatagatgcagataatgtaaatgtaatcggagttccaaaagaaatagcttgtttaattacaaaagaagacctggaacaaattgatttaagtgaagtgaaacaggcagttattattccaggacgtgcctttgttcatcaattagatgctgagagaattctaagtgctgacggtgtagaacgtattgttggccgcggcccggatactttaacaatagatggtgaactcagctttgataaaacagacgaaaatgttattgaagaagaattaacacaatttaatgatttggttgatgccattaacttctttggaatgagaatataaaaaaagtagatgatttaagaatcatcaataagggaactttcagtgtggatttttactaagatataatcatacatgaaagactttttaatttcagccaagtcggataattttttaccttctataactacattttcaattagttcatgatatttatcataatttaattttaccctgactccatcaagctgcactgtaataggtgctggagatatgatatcttcaatagctggaacctgattttcaatagcatttttaactacaatagatggtacaagtggcggatccaatgccatttctctttttttattatttaaaattgtttcaattgtatccactaaattattaagagctcttatatctggacctcttttaagtcttcttggaatcctgccaagcccaccaacatatgcatcagcacctggaagttcttcaattggaatttctggagctccagttacaataacaggaacattaatgtcatcatataaaaaggatttttcttgaatacaatttttaaaactgcctaatgcaaaaacagccacatcatgttcttcaattaagcttttttcttcttcagtgattcctgaagttcctttcccatctcctctggccaatccaatcatattgtctttagcaccaaattcacgcaaatactcagaaatatcacatgctgcatgaggcaggtgatgtcttgcaagtgttggagatacaatagctatttcagaacctgccattggagctactgttaccttagcaagcaattctttagccttatttttaataacatcaacatcttctaaaggaataggtaaatttaaaaccaattccatttgtaaaatgttttcctgaaggatgaaacctcctaaatcttcaataagttccttgacttcttcacttttgtgaactccaccagtatatgttaatgtttcatacatctaaaaaatcccttatataatttattaagtaagttttttacattatttctatattaacttttccaaaatttcgtatcttttttcaagtcttacaaatggatttttagatacaaaattgtgtgacgaaatctcaattaatgtttgtgtttcattttgaacttcatcagccaaataatccggatatactacataatcatagttttcatcatcaatagtaaaccccatactttcagcagtgtcttttaaaaagttagaataaactttaatgtgaatactgtttttgacattattattaagatattttttagctaatggataatcatcaaaaaatgaaagtatttcttcatcagttaaattattgttaaaatctatttttttaatgctttcaaaaatctggactgatgaattaactttaagtggaatagagtctatttcaaccttactttcagataataaaatagccaaatccccatcattcttattggggtgtttattaaccttataattttttattccaactaactttacaagatcttcacacataggtgttgtgacaattttcatactaataattattataaaaagtaaaatttaaaattaattaatttttataaatatgaatcatgaaaattacattaagctttgaaaaaacacaaaccaaagatacatccataatggtcgatgcacttagggcaagtaccacaattacacttgctttgaataattttaatgaaatcatcccatgctttacaccagaagaagcatttgagttaaaaaaagaaatcaatggaataatagccggagaaagaagcggaaaacgtgttgaaggctttgatgttggaaactcgccaaaagatgttgaaaattatgacactgatattgaaacacttatactgaccacaagtaatggaacaagaattcttaaagatatggattcaactgttcttgtaggatccatggtaaatgcaaaagcagttgggtataaaagtgtagagatagctgaaaatgaaattgatgttgtaatggcaggatacaaaggaaattttgccctagaagattttttggcagccggtgaaattctttactggatttgcgacaggttaaataatgagtgcgaaataagcgattatgcaaaagcagccatcatggccagcagagattatgatgctctaaaagaaggattttataattgcaactccggaagaaaactgtcccgacttaaatccaaaaaagacatcgactgttgcgtgttaaaaaatataagtgaaaatgtggctatctatgaaaataatatattgaaattaattaaagattagatttatatacaaattgtaaaatatatattataacattaaattaaccgatgtgttttttttgaaaagagaatgtttaaccataataggaactgctcatgtatctgcaaacagtgtggaagaagttaaaaatacaatttatgagcaacatccagaaatagtagctattgaattagataggggaaggtatactcgattgaaaaatgaaatgatgggtattgaagaagatgacactatttctgtttcaaaaatcatcaaagaagaaaaagtaggactatttctagctacaacaatcctttcatatttccaatcaaaaattggagaggatgttgatgtaaaacccggatcagaaatgattggagctattgaagctgctgaagatttggaaattccaatagcattgattgacagagaaataaacacaaccctgcaaagggctcttaataaaatgggatttgtagaaaaacttaaatttgcatttagtttacttacttcaattttttcaagtgatgaagaagatgaaattgatattgaggagttgaaaaatccggataaccttgatgaattaatggaattttttaaagatgaatctccaaaagtatatgaagttttagtacaggaaagagatgcttatcttgcaggaaatattttaagaattcctcaagaccatgtaatagctgttgtaggtgcaggacacaaacctggaatcaacagatacttagacaatcctgaaactattcctcctttaagccaattggaaattactaaagaaaaaaaaggaataccatggtttaaaattattttagctttaattccaatattgtttgttgtgatattttttctggcctacattagcgggattaatataacctggaacctctatgactttataattataagcatgataatgggatttatcggttctgtactttccggatcaaaaatccaatctgctgttgttggaggattagtagctcctttgactattattcacccattacttgcagcaggatggttttcaggactggttgaagctaaatacagaaaagttagaaaaagagatatggtcaatcttactaaaattgaaagcttaaaggatttgtggcacaacaacatagtaagaattttacttgttgtagttgggactaatttaggagttagcttagctacacttgttatattgccttcacaagtctttataccattatttatgaaaatatttggcggatgaaaaataataatttttataaagtatacttacataattattaaatgaaaaattttaatggaattaattactatgtatttcatatttcgatgtgactgtggaagagtattatatgcaaaagaaggagtggctacccgcaagtgtgtttgtggaaaaacaatcaaagtaaaacaacgcagaatatttaaaaaagtagaaactcgtgaagaagcttccctggcagttcaagagatgcaggatgaaatatatggaaatactgactttaagagagccagtgaattataaactataagtttaacaaaaggtctgtttaaaaatggctaacgtaatatttgaaatagtattaataataattttaattgtccttaccgggattttatcgatggctgaattggccgttgtttcgacaaagaaagcaaaattagaaaaactgttaaatgaaggacacaaaagtgctcagataatcattgactttgcagaagatccaaatcaatttttatctactgtgcaaataggaattacacttatcggtatcttaactggtgcttacggtggagctactttagctgaaccattatcagaagtaattggtccatatgtaccatatagcggaacaataagtattttagtagttgttatcattacaacttacttaactttagtaattggagaaattgtaccaaaagttattgctctaaataaccctgaaaaagtttctttaaaattagctaaaagcatgtctgtactttcaaaagtttgcaaaccaattagtgcagttcttgccaaatcaactgatttcgtcttatggaccataggtatgaaaagcaaatccgaatcaatagtaacagaagaagaaattgagttattaattgaagaaggaagagaagacggaactattgaaaaagaagaagaagatattattaaaagagtctttaaacttgatgataaaaaagtcgaatctataatgactcctagaaatgaaattatctgggttgatttagaagatgataaaagagctaatgaaatcaagattatggaaagtaaaagatccattttcccgatagccaaaggagaattagatgattttatcggagttgttcaagcaaaagatattttagcacttttatttagtgaagaaaaatttgacattaattcaattattaaaaaacctttagttgtttctgaaaatcttgaaacattggaattattaaaagaatttaaagaaaacaaagaatatgtccatatggctcttgctgttgatgaatttggtagtgttgaaggattaataaccttaaacgatttacttgaaggaatagttggagatattccgggcattgatgaaactgatgacccaatggctactcagagattagacggtacatggttaattgatggaagattccaaattgataaatttaaagaacttttcgattacgaaaaagagttcccttatgaaaaagaagaccaatacactacaatagctggatttatcctaagtttaagtggtaaaattcctgatgaaaaagaaatatatgactgggacagattccacttcgaaattttagatattgacgggcatcaaatcgacaaaattcttgtaactgatttaggtccgcaagaagaagaaaaagaaacagaagaggtagaagaatgattgaattattaatacaaattgtattgcttattgtaggatttgcaattttaataaaaggatcagatatttttgtaagcggatcaagcaatatagctactattttaaaaatcccaacacttattgtgggattaactattgtagcatttggtacaagtgctcctgaagctgcagtatccatatcctcatctattcaaggaagcaatgccctggctgtaagtaatgttattggaagtaatatcttcaatattttaggaattattggtatttgtgctctacttaaagaattaaaacttggagaaaatgtacttaacaaagatatgccgtttcttttaattgttagtctgcttgttgttggatttatattactcagctgggatttaacaagaattgaaggaattgtattattgattcttataatcggatatactgcccatttagtttatacttctaaaaaatcaaaaggggcagattttgttgaaaagcctaaattcggtattggaagaagtattgtttatgttgttgtagggcttgctgcaattattcttggtgctcagcttgttgtaaactcatcatcatatattgcaatggcatgtggaatgagtgaaacattagttggtttaacaattgtagctatcggtacatcactgcctgaacttgtaacttcactaactgctctaaaaagagatgaaaatcagttagttattggaaatgtaatcggatcaaacatattcaatatcttatttgtacttggtttaagcagtaccataactccaattcctgtaaactcaaatatgattgtagatttaggtttaatgataattgttacaattttatgccttatatttggtaaaacacaaagtaaatttgatagaaaagaaggaataatcctattaggactattcatattatatatggctttcgtgattttcagaaattaatttttttagctcacaggctttgcagatatctgaagatgtaggttctccacataacctgcactcattcaaattagatggaatatcactttcaaaggttaaaatcttttggaaggattccataatattattttttattccaggatatatatcctcattattatttaaaaattccttaattttagccctcagagataaatgagaataaggacattcatctaaatgaatattaatatcatttaaaattgcccaggttccaacttccttttccggagtgttccacaatggtttaatacgtggaatcaacttaggatgaataacatcaagttcaggcccgaattttgagaatttaattaaatcaccacgggcaaaactcattaaaaaagactgaatttcatcatcaagattatgtccggtagctattttatctgctccaagatcatatgctgttttatttaaaatatttcttctaaaaactccgcaaggaatgcatgcacttttaaatccgctataaatgtcatctagtgcaaatccctcttctattttaaatgatttttgaactaatttgacatctaatttttctgcattgtcaatagctgcatcaataccatgctgacggtaaccctcaataccttcatcaacactaacagcaaccaaatcaaaatccaaataattttgataattttttaaagcatgcaatgtcaaaacactgtctttacctccagacaatgcaacagctatcaattcatgttcatttattaaattataatcatgaattaaattattaatccttgtaaatatcttatcattaaattcttttttgtttaactgaaccattactaaataaatttataataagataaataaataattttactaggtgaattaaaaatgataactgcagatttcgcaatattacctgttggaactgaagatactgaatgtaaagaatatgtaactgctgctgttcaagcaattaaagattctggacttaactatcaattaacaggtatgggaactcaaatagaagctgaaaatcttaaagaattatacgaagctatagctaatgcacaagaagctgtatttaaaactggaatcgatagagtttacactgttattaaagtcgatgacagacgtgatttagaaaacagaactttagatgctaaaattgacacagtaaataaaatgttaaaataaaaaaagaaaaagattagttaaagctgtcactagcttgttttacagcatcaataactaaatccaaatcttcttgtgttaatgaaggatgtaccggtaaagaaattacatgatttgcagcaagctctgcatctggtgcactgccttcgatacctaattttttataaattggctgattatataatggaataggataatgaacccctgttccaatacctttttgagttaagaaatcaacccaatcatctctttttcctttttcaacaagaatagtatattgatggtaaacatgtttaaaatcatcagcagaataaggagttactaccccatcaacatcttttaaaccttcatttaaatattctgcattagctattcttttgtcattgaatccgtcaattacatttaattgtgcaagaccgatagctgcagaaatatccgtcattctaaaattataacctatttcatcatgagtgtattttatactggaaccatgagctctaaaaatacgtgctcttttagctaattcctcatcatcagtagttataattccgccttcactggtagtcatgtttttagtaggataaaaactgaaacaacccgcatctccaagtgcacccacatttttacctttgtacattgcaccatgagcctgtgccgcatcttcaataacttttaaaccatgtttatcagcgatttcattaattctatccatgtctgcagattgcccatataattgaactggtaaaatagcttttgtcttatcagtaatcaatgcctcaatactgtctggatctatagtgtatgtttttaagtcaatgtctgcaaaaacaggagttgctcccgtataaataattgaatttccagtagctataaatgtaaatggagtagttatcacttcatcccctttacctattcctgctgcaagtaaagctacatgtagagcagatgttccagaattagttgcaattgcatattttgttccaatccaagcagcaaatttttcttcaaattcagttactttaggaccttgagcaatcatacctgattttaaaacttctacaacatttttaatttcttcttctccaattattggttttgcaattggaactttaatatccgccattttatcaccaaatcctaaaaatagattaatttaaacttacaataatatttaaatctaataatatttaaaatattacttgattatttaaaaaagtgataaactatggacgaatataaaattaaaacagttgaagagggattaacaaaaattcaatttcctgaatttgataaaatttcatctgatgctcctgttttttacaatccacatatggaactaaatagagacatttccattttagctcttcaaacttttcaaaaacaagaagacagaaatataaacatatgtgatttgttcggaggcagtggaatacgcggtgttcgttataaaaatgaaattgatggagtgggacatgtttttataaatgacattagtgaaactgcaaatgaatatgaaagacacaatgttgagttaaacaatttgaaagacattgaaatatttcagcatgatgcaagtatgttcttaagaatgcacagaggagaatttgatgttatagacattgatccctttggaacaccttccccatttttagactctgcaggatactgttcccgcagaaactcattattatgcgttacagctactgacacatctgcactgtgcggaacctacaaagaaccgtgtatccgcaaatacaatgcaaaaccttacaaaagtgaatactgtcatgaaacaggtattcgtatattggcaggatttgtagctcttacactggccaaatacagcaaatccatagaagttaaattatcccacagtactgaacattatatgagattatatatagaagtcaaaaaaggttccaaaaaaagtgatgaatgtttaaaaaatatcggatacctcagtcactgcaaacattgtctgtatagggaagaaaataaaggattagctacatctacaccagatatttgtccagaatgtggtgaaaaattaattcaggcagggccattatggcttggagaaattcaaaacgaagaatttatctcaaagatgattgtagaatctgaaaataaaaaattaaatactaaagaagatgttttgaaactattggaaagctgccgtatagaagcaaaaagtcccgccacattttatgatgtgcataaaatctgcaaaatcttaaaaatcagtgcaccaaaattagatttggtatttggcaaccttgaaaaagaaggatttgaagctgtcaaaacacatttcaaccctcttggaataaaaacaaacgctcccctaaaaaaaattaaggaaatcataaaaactttgtcatcttcaaattaaacaaatatccaaaatacacaaatagtgaaaaaactagatatagcctatgaattatttaggaacactaaataaatccctgctttatcttcactactttttttaataaaattgaaaaaaattacatatcaaaataaatatctctttttttaccatacaatcattcaaaaaatatttgaaaaaataaataaactacagtataatgctaatggtatattaatttaataaaaacaaaaaaatagggattatattttaattatattcaaaaatacataccaaatgatttacaatataactattaatttttcgaatcatatttaaaatagtactaaaaaaattaaaaaatgtacgaatagtttatataatataaacataaaaaatgtatatgcctatattaatttgtttacttataatcaattaatataatcatttttagagaggttataaatatggctaatgaaaataaagactttatcaaattagatgatattgatgttagcattttaaaaatcattaatgaagatgtcagaacatcttatagacaaatatcccgtagtttagatgtatctgttggaactgttcacaaccgtatcgacaaaatggttaaaagcggagtaatcaaaaagttttcaccagtaattgaccatgaaatattaggatatgtccttacaactataattggagtgagggttaaaggtggaaaactcaaaaactgggaagaaaaaacttactctaataaaaatgtagttggaatatatgatgtaaccggagaatatgatgctttcttaatagctaaattcaaagatacaaatgaattaaatacatttattaaagatttagttaaagaccctaatatagaaagaacatatactcaaactgtattggatgttataaaagaagatatgggttcttcaaatatattataatccaaatttttaatttattaaaccaaaccatcacaacattcatttaacattaatcaagccatattcaatcaaataacttatttttacttgtaaaaaattgccaaaaataagcttaaaatatataagtttcaaaaaacataatataaaaaataattatatgatagaggttattaaatggcagtttgtttacctgacacccaagatgatactcccagcatacctatcaaattaacaagagtaggtgtaaccggagttaaaaaattattgcaactcgaaagaaataacaaaagacctataattttagtacctacatttgatgcatttgtagatttaccaaacgatcaaaagggagtgcatatgtctagaaaccctgaagcaatcagtgaagtattagacgaagtagctaatgacagttcagtggaagtagaaacattatgtgctaaaatcgtaagtaaaatgatgtccaaacacgaatatgcaaaacgtgttgaaatatcaatgactactgattatatgtttatgaaagaatcacctgtaaccaaaaataaaacacaggaaatggctaaacttaaagctaaagctgtaggttacagagaagacggtgaaattaaaattagaaaaagtattggtgctgaagttatcggaatgactgtttgcccatgtgcacaggaatctgtgaaagaatctgacaaaaacaaattgttggaatttttagacgaagaaactacacaaaaagtattagatactgtaacttttgcttcccataatcagagaggagttggaactttattaatcgaagttccggaagacagggaagttaaaggtgaagacatcatagaaataattgaagaatccatgagctctcctgtatgtgaattattaaaaagacctgatgaaaatgctacagttttaaatgctcataaaaaacctgtttttgttgaagactgtgtaagaaacatgatggaaaaaatagctaaaaaatatgctgattttcctgaagacaccataatcacttcacgtcaagagaatcatgaaagtatccacagacacaatgcttttgcagaaaaagtaacaacaatgggcgaattaaaagaagagttaaggatatgattaaatgcaaaagttttatgaagtagcaggagaagtgatggggttttttgatgcattcaaaggatcaagacctgcaattaacaatgaaaaaatcttaatcgtcagaggaagatcaagaaaaacattagatattaatgactttaactcaaagcttgatgaaattggaagcataataaacggtaaagaaatcgaatccaattctgcaaaaatcgccaaacttttagaaattggtgataaaagtatacaggaaagcgaaggccaaacaggaaatatagacaaacatggcttagaaagaatgcaagaagagcttgaagccattggtcttgtagttgaatacaaagctttcgaattaccttgctgttatgctgtaattgcaatatggcaggacaaacatggatatcctccattatatgttgaagtaacagtttcagaaaaagaagaataggtcatgcaaagaaaagaaaaaattctccagatattagaatcaactgacaaccaaatcattgatttcatgaataaagcatcaaaatacagggagaataatcttattacatattccaaaaatattttcattccattaactgaaatctgtaaaaacgattgcggttactgtaattttaaaaaaactccagatgatccaagtgcaattattctaaaaacaaaagaagaagtattggctagtttgaaagaagctgaaagatatgggtgcagtgaagctttatttacatttggagaagatgctgatgaagaagaatcagtacagcaaaaattagctgaattcggatatgaaaatattgtagattatgtttttgatatctgtaaaatgactttggaagaaactagcttattgcctcacacaaatggaggtaattttagctatgaaagtctaaaaaagctaaaggaagttaacgcttctatgggtatgatgcttgaaagcacatctgtcagattaatgaacacagtagcacacaataaaagcccaggtaaaaatcctgaaatcagattaaaaacaatatcaaatgccggaaaacttaaaataccatatacaacaggaattttaattggaattggtgagaccaaagaagaaatagccgactcattattagctatcagggatttatatgataaatacggccatattcaggaagtaattattcaaaacttcaccaccagccccggaattgaaatggaaaactgggaagaacctacttttttagatatggtaagaacagtaatagcagggaagctgttatttagggatactgatgttagcattcaagttccgcctaatttaaaccatgacactgcccagatatttttactttgcggtgcagatgattggggaggagtttctccagtaagtcctgattatgtaaatccaacatccccatggccaactctagatgaattaaacagactaacacaggatgcaggatttgaattaatcgaaagaatgtgtgtttatgaaaaatatgttaatgataaatggctaaatgaaacactgcttgaaaaaatagctaatttatcctagcatcacacaccacatgaaatactcccggagagtatttcttaaccttatttaattttaaaaattccaccgacctatctccagccacttctttaatcctgtttatcggacgggtatccattaatttttcgggaactgtttcatgataatgaataactccacctttgttcaggctgtcaatagctgtctttaaataatgatgcgttgtttttacataacccattataattctatctgcactatactctggagttatgtccatgcaatccccaagtaaaggtataatattgtttattttatttaatttaatattttctttcaaataatgaaatgaattgggattaatttcaattgaataaacttgttttgcattgctgtgaactcctatcggaattgaaaaataacctattcctgcaaacatatcaataacagtttcattatcttcaacaagtttagctattcttattcgctcgttgttatttccttttgaccacattactttttttaaatccaatttaaaaagacatccattttccttattgattgtttcagtatcctcaccatacaataattttataacaggttcccttttagtcccatgaatatggtcaactttcatgacagtttttactttatgtttatctgaaagttcttttaactgtttatctgattgtacaatgaatttattatccaatattaaaatattgcctatttttttccatttcattaacaaagctccattaaagtatcttaaaaagaaaactttatatatgtaaatacataatgtattattagttagtttatactaattaattgattctgattttataaatattaataattaaaataattacgtgtttatataagatttatgtataacctacaatatagttgaaaaatacaaatattttaaatacttacatgaggtgtttaacatggatgataaaatattagaaggtacaacaactgtaggaataacctgtaaagatggtgttgtatttgctagcgaaagaagagctagtatgggaaaccttgtagctcataaagtcgcagaaaaaatatttaaaataaatgatcatatcgtaacaaccattgctggtagtgtcggagatgctcaaaatttaatgaaaataattgaagcagaagtttctctttatcaaatgagaaacaatgacaaaataagtgtaaaagctgccgcatcagtaacagcaaacattttacgttccggaccaatgtatgtgcaaacattacttggaggaatggacggagataaaccttcactatactcccttgaccctgccggaggtatgattgaagatacatacatatccacaggatcaggttctattgtagcatatggtgttctcgaagacagataccatgaagaaattacaactgatgaaggattagaaatagctgtaagagctatcaaagctgctagcgaacgtgacacattttcaggaaatggatatttagtagctaaagtaactaaagacggctttgaaatgttagataaggaaaaggttaatgatattgtagcgaaaatataaagactatttttcataactaactactttttatataaatagtgtgaatagtttatgaagttttaactaattatagcaaacaagctttttcatgaactatatttacacaatacttttttttgaagggattatatgacttcagagattttagaagatatcaaaaaagaaataatggacaagttaccaaaaaatgctcaggtttcaaaagttgaatttgaaggtcctgaagtggtactttacaccaaaaacccagaaattataactgacaacggcgatcttatacgatcattagctaaagaacttagaaaaagaatcattatcagatctgataaaagtgcattattaggtcctgaagaaaccattaaaaaagttcatgaaatagttccggaaggagcagaaattacagacatttactttgatacagttacctgcgaagtagttataactgcaaaaaaaccagggcttgttattggaaaatatggtgtgacctccagaacaatcgttaaaaataccggatgggcacctaaaattttgagaacacccccaataagctctgatgttattggaaaaatcagaactacactaaaaaacagcagcaaagacaggaaaaaaatgttgcagcgtctcggtagacagatacatcagggcactaaacatcctaatgattgggccagagtaacctcaatgggcggttttaaagaagtcggacgttcttccatgcttttacaaactccaaacagtagagtattattggattgtggtgttaatgtagctgcatctgacaacaaaaatgcatttccatacttgaatgttcctgaattttcaattgaggaattggatgcagtcattatttcacacgctcacctggatcactgtggatttgtgccatacctttatcattatggatatgaaggtcctatttactgtacaactccaacaagagatttgacaacacttttacaacttgatcacttggatattgctcacagagaaggaaatcctttaccatttaatgtaaaacatgtgcaaaaagctattaaacatacaataaccttagattacggtgaagtaactgatatctcaccagatattagattaacactccataatgcaggccacatcttaggttcagctatttcacatatgcatattggtgacggagctcacaatttagtttatactggagatttcaagtatgaaagaagcagattacttgaacctgcaacattcagattcccacgtgctgaaactgtaattatggaaagtacctatggtggccgtgaagacatacagccttcaagaaactctgcagaaaaagaaatgatgaaaaccatctataaaactttaaaacgtggcggaaaagttttagttccagtatttgctgtaggaagggcgcaggaacttatggtagtacttgaggaatacatgagacatggaatgattgatgaagttcctatttacattgacggtatgatctgggaagctacagctatccatactgcaagaccagaatatttaagtaaagacttgagagatcaaatattccacatgggcagaaatccgtttatctcagatatgtttaacaaagttcaaaatcttgaccaaagaaaagatattgttgaaagcaacagtccggcaattattttatccacatcaggtatgttaactagaggtaattctgttgaatacttcaaatggttatgtgaagatgacagaaacacattaatatttgtaggataccaatctgaaggttcattaggtagaagaatccaaaaaggatggaaagaagtgcctcttgaagaagacaataaaacaaaagtattcaatgttaaaatggaaattaaaactatcaacggatttagtggacactccaacagacgccaattaatggattatgtaaaaagacttaatccaagaccggataaagttattacttgtcatggagacccttataaaacaacagacttagcttcatcaatacacagaagttataaaattgaaactaaaagtcctgtgaatttagatagtgtaagaatacactaataaataaatactaattgaaataaatatagtaatataatttaaatttttattgattttaaaaaaaataaaaataccactaggtgttaaaaaaatggttacttattcagaatccggtgttgatattgatcttgaagcagttactgtttcaaaacttgcatcaaaacttaaatcaacactggaatatagagatataataactgatagcggacattatgctgctttagttagattaggtgataaagctattgcaatgagtactgatggagtaggtagtaaaattttaattgctgaaatgatgaataaatatgatactgttggtatagattgtatagctatggttgtaaatgatattctttgtgttggtgctgaaccaatagctttagtagattatcttgcagtggaacagcctgatcctgaaagagctgaagaaatagctgaaggtcttgtaacaggagcaaaagaatccagaatttcaataattggtggggaaactgcctcacttccaggaataataaaagactttgatttagccggaacaggaataggttttgtagatgttgataaaattattactggagaagatattgaagctggagatgttttaataggtattgaaagtaatggtattcattcaaacggatacagtttagctagaaaagcattgtttgatgatgcaggattttcaattgatgacaaaatgcctaactgtgacactactattggagaggaattaataaggccaactgaattatatgttaaaccaatagttgctttatttaaagaagaatatgatattcatggattagcacatataactggtggaggatttactaaccttagacgcttgaaaaaaggtgtcggatatgatatttatgacctcccagaggctcctgaaatattcaaacttatatatcaacaaaatgttcctcttgaagaaatgtataaagttttcaatatgggaataggttttgttgtaattaccaatgaaaatgaagctgaaaaaataatggaaactttgaaagactactgtaattgccaaattatcggtaaagtaactgatgatgaaaaaattaccgttaaaacttttgaaggcagtgaagttacatactgattcaataactataaggagagtgaaaaaatgaaaataatgaaagataatgaaatagctcttgtaaaagaaatattaaaaaaattaggagctagtgaagaagacagcgaattggtagcagaagctacaattgatgcagatttaaaaggatttacttcacatggacttggtagattcccacaatacttaattagtattgaatcaggaaccataaacttaaaagacaacataactattgaaaaagaaactcctgctattgctttaataaacggtaacagcggattcggacaggctgttgcatacaaagctatgaaattagctgtaaaaaaagctaaagaagtaggtatcggatgtgtgggagtacacaattcaaaccactttggagtaaccggattttactcagatattgcagttaaagaaggtgttatcggaactgtaatcgcaaatactgaccctgcaattgctccatttggtgcaagtgaagcacttattggaacaaacccaattgctattggtattccaagtgattcctacattgcagtagatatggctacatcagttactgcacgtggaaaaatattagaatcaaaaagaaaaggattggaattacctgaaggttgggcacttgacaaagacggaaacccaacaactgatcctgaagctgctcttgaaggttcaattttagcattcggtggatttaaaggatatgcattagcatttatgattgaaattttaaccggacctttagtaaatgcagaatacggaaaaggagtaacaggtacagcttcaccaactaaaaactgtacaaaaggagatttatacatagctattgatccaagcaaattcggttcactagaagatttcaaagcaaaaactacagatttctgtaatcaagccagagctgcaggagaaaatgtttcaattccaggagacttagaagttaaaaaaatagctaatgctgaagctaatggaatggaaatagatgaaaaattatacgaacaattgaaagaaatctgcgacgatttagatattgactttgattcatatttagaagaataatatttattcttccttattttttatatttagcataaaaaccatcagtgtctgcatatattgcataaaaaccataatcttccgcttttttcattgctcttttaatatattgcctaccccatgaagtaatagcttttgcacattcataagagtaccatctgaagcgaggaaaaccataaataccatacatagtattagctaaacgttttatagcctgctgttgcacatctaaagtctttttttcagttggatcaacagatgctttcatggcttttttaattttaaatctttcattaagaattttagctataactgacggaataaaaccttttggctcttttttaaattttaaatcatgttccggagaaatattgtaatcctgtctattttcaacatctccaataaccagcacgtcaggagaaatgttttttgaaataattatgctgggatacagacttctgaaatcgaactggactaaattttcatgcaatccaatttcgggttccttaacatatcctccttcattgtcttcctcagcagctctaagtgcaaagtttgaacctccaggtttatttggtacaatctcattgtcaaaatatgcttccttaactaaaaaccattcagcctgttgacccgtagccatacggcttaagtcaaaaagaggctgaccaacaatacgagtaagttccaggttaagcggaagtgtttgctgagcgatttttaatgtagatacaacatcatctaaagaataatcaaacaaatcatctaattcagttgaatcactgtcccagtactcccagatgtgttctccaggaacatcgattttttcctcaccaaataattcatagtatactctctctaaagtatatctctccaaagtcatgtatcttctcataacaagatataaatcaacatgaatcagtcctttaaaagaagctgcatttgcaaaaccccttcgaataaatttaatattagaatcatccattcccaaatccaactccaaaccataaagtttagctctgtctttaagatatggaaggtcaaaattatcagaattatatcctacaataatatcaacattgctttttttaactatatcaataaatgtttcaatcatttccttttcagattctacctgattaacaaaatcatccctatcttcagaatttgttttggttgaaataacctgatttattccaaaattactggctactccaatcatgattatctcatcaacttcagaatttggcatcccatgaggatttctaacttccaaatcaaaacttaaaattctaaagtcctgcaaatcatcattcactctttcaagaggtttggtaagtttaataatttccaaatcgtgttttttagaatccaaatttaaaaatgaatcaattttttccccgcaggctttaacctcagtcattggaataacatcacgatcaattaaatatcttctgtaaaatggaatatcatgttcccttatatgatccacagagtccaaatcacgtaaagcatccctgtttttagctaattcctgaggatttaaaaaagtcacttttaaaaatgttttttccacctgaaaatcctttttaataacttcttcaatatgcacatcatctaaagtatcaagaatctgtttttgacactctttatcatcatctttaggagcaacatacaaataaggctcaaaggtgtcatctaacaaaacaatgtttttatccttatcttttgaaaataaacggattacaggcttgttttcataagtaacatagtcaatatctaaaataacaacgtttttttccattgtttattcccctttgcttttattaagttctattctaaagttatctaaaacagcataagttatacccagtattaatggacctaaaataaaccctacaattccgtaaactaatggacctgccaaaaaccctataagtaaaattaaaggatggatatctgcataatgactggataatgctggcctaatatacatatcacttaaactaaggaaaaatccaaataaaattacaattacaacccttacataatttcctgaaatcaaatcaacaatagccaaggtccaataaattggccaaggtccaaatattggaattaactgaaaaataccggtaagcactcctaaaaatactccctgagaatatccaagtaaagaatatccaacagtcgcaataataccaataattaaagaagttaaaaaatgtccataaaatatactttttaaaacctctttaacggaatttacagttctttcaaagaaatctttactttcctgaggtatgaatgattcaacgaaatcataacagttatctccatcacgaataaagtaatatattgatgcgaataaaataaataaatctacagaaattgaaagaagtttgctggccaagcttacaatataatccagcaccacatttccaatatcctttataaaaccggataaagatgatttaattgatgcagtatcaataccagagcttatatctgccggcaggctattaaccatctgattaattacagtatccaaatttaagttaaaaccacttggattaactaccaacacatcagataaaacaccagatattactgaaataatatatgcaattaaaataaccaatggaatcataaccaaaattacagccagaaaaatagaaactgatctgatttttattttagaagttatttttctagctaatgggcggatagcataagctaatattgcccccaatataaccatattcaaaaccggagatacaatcattagtgatattccaagcaagaacagtaccagcaatactggaggagttatatattcttttaagtctttttccattagaatcacatttaattactgctttattcctgcagcattccttctgtatttaccgaactctgaaatttcttctattttctcatttttaaaaacaggcccttctacacagattctccatccagtattatcaacacaacactgaccacatatacctagagcacatttcatgtatctctctagagaatattctgcacttattccagcatcttcaagtatttcatagattcctttcatcattatctcaggaccacaaacaaatgcaaaatcataagagttatcttcaagtaaacttacagtacaatctgttgcaaatccttcaaatccaaaacttccatcatcagtacacggatgaatctttgcacctgatttttccaatgactccataaacagcaattcttcttttgtaacggctgccggaactacatcaacagcattgccttttttaagcaaatcactaactattgcattaataggagccattccaactccaccaccaatagctaaaacttttttatcagttaaatcatttgaaaatccatttccatagcttcctcgaatacctattttatctccaacttttaaatcatgaagctgtgatgaaaattcaccaacatttttaacactaatggccattctggaattttctttgtcaattaaagaaatggacattggtttttcattatggaaattccaaaccatcacaaattcccccggagaaggaacaccgaacttatccatatcccaatcaaagacaaaagttttaattgttggagtctcttcaattatttcattaatttcaacaatttgtggaacatcattcataaattacaactcctcatgtgcaaggccaatcatttcatcaatagattcataaccttttttattcataaattcttctaaatctttgttgattttgccaaatacttctacaccctcatccataatagaagtaccaatttgaactgccctagctccagcaaataaaaattcaacaacatcttcaaagtttgaaatacctccaacaccaataattggaatatctacattatcataaacagtataaacattacgaagagctattggttttatagccttaccgctcattccgccaaacttatttgataaaacaggtcttgcaacatcaatattgattttcattccaggacctaatgaattaattaaagtcaatgcatctgctcctgcatcctgagctgccacagctatttcaacaatatcagtaacatttggagttagtttagctattactggtttatttgcactatctttagcagcactaacaattttatgagttaaattagcatcctgacctatggatgcaccataaccttccatagcatgaggacatgaaatattcaactcaatcatatcaacataatcttcaatttccaaaactaacttgctaaattcttcaggagttgccccgtaaattgaagctattgaaacatttcctttcctgtcaattcttttaagttcctctttaaagttttctgcaccgggatttgaaagaccgatagcattgataatgccgcattcaacacctacagttgtaggatttgcatatcccggattcggttctaaagaaaaagatttagaaacaacacctgctgcaccggattttaaaatccaattcatggaagaagcattacttcccataactcctgcagccaacattaaaggatttctaaattcaactccacaaacatttgtcctcaacatgattacaccaaaaatttttatatgatattaattatgtattataaaacatttatacatttttaatcaagtttttcttcatatttcttaatcaattcacgatatttatcattctgtaattttaaacttattacattggttttattggatttaataatttcttctttatcttttaataaagatttaatgttttcatcctgtttttcaattattaaatctttttgagctaaaagcccctcataagtttttgaaatttttcttaattgaacttccaaattctcagtattattatgaacctgcaacttataatcatcgattaaagttcttaaatattttatctggtcctgtttatcatcaattatctcctgcttttcattaagtttttgttgaagatcatctaactccttaaacttggctttttcattattaatctcgctgtccactttaagttccagtgttttgatttcatacttttgtttagtgatgtaatttttaaatttgttaatttccttatccttagtggccaactgcatattaagctcatcaatttctgcattttttagctcaattgtttctttaaggtcctgaaatttctttttattatagtttggtttagtcatgattcccaattccataaaatattcaattaaactatattttttaaatcaattaaatgtttgtaattctctatattaatatatcagttacaataaatttagtattaaattaacaaatgcattttgagtgaataaatatggaatgttatataacctattgcattaaaggatttttagcttttagtgaggattttgaattaataactcaaaaattatttccaaaagagagtattgtaactgcactaatggaaattaagaataaaaaaatagtttcacaggaaaaggaaattattgaagaagtctcaaaagattatgataaaatcattattgaatcaaataaacgaatctccgattattctggcttaaaatcctttgacaaactagaaattaaaacaccaaatgccggtggagagtatttaagaagtaatttggaaaaatttgttggtgatgactatcttgaagtttatcagcagttagctattgctaaaatgaaagaagcatcaaaatcagaagacaaacatcttatccaagctataaattctattgatgaaatcgatgaatcaatcagcaaattaattgaacgcattagggaatggtacgctttgtatttcccggaaatggatgtaattaaaaataatgaaacatatgttcgtttaatagctgaaaataaaaccaaagaaaaaatcattgaagcaaagccagacgtatttttaatagattccgattatgatgaagaaatcaaccaaagtgatttggacatcatgaacaattatgcaaattccatttatgaattgcagaaaagcagaaaatctattgaaaactacattgaagataaaatggaatcattagcaccgaatttgaaattattggttggagcttcacttggtgctaaactaatatcacatgcaggagggcttaaaagactagcaacatatccttcaagtactgttcagataatgggtgctgaaaaagcattgtttagacatttgaaaagtggagacagacctccaaaatatggtttaatctatcaacacccacaaattagaggagccaagtggtggaatcgtggaaaaatcgccagaatgcttgcatccaaaatatcattagcatgcagaaaagatattttcaccaaagattttgatccgaatatttatgatgaatttatcgaaaaggcagaacagatagaaaaagaaaatccgttcccaacaaaaactaccaaaaaacgaaaagaagaacactcaaaatctaaaaataaacacccaaaatctaaaaaaagaagaaaaaataaaaggaggaaataagctatgaaagtttatttgaaagatggacaaatagctaccaaaaatttaacccccggaatttcagtttatggtgaagagctaattcaggaaaaagaagaatacagaatatggaatcctagacggtcaaaattagcagcagccttattaaatggattagaaaatctggacatttctgaagatgcgaaagtcctatacttaggtgcatcaactggaacaacagtttcacacatttcagacatagtaactgatggaagaatatatgctgttgaattttcaccaacaacagctaaaaaattagtcagactagccagacaaaggactaatattgctccgattttgggagatgcaaccaaacctaaaaattatttgaatataaccgaaaaaacagacattgtatactgtgatgtagctcaaccaacacaaagccaactgtttatgaaaaacatgaacttaatagggaaagatgatgttataggagcattaatgattaaagccagaagtattgatgttgtacaaaagcctaaaaagatttttaaagaagaagaaagaaaattgagagaaaagggttttaaaattattgaaaaagtaaaactggaaccttacgaaaaagaccatattgcatttgtagtagagaaaaatttttaataaaaaatatccccactacacttgtaaaaccttaaaaaaaggacagacataaaattaaaaaaataagccaaaacacccaaaaaagtattacttcgatagctatttataacataaaatgaaatatacaatatgctaatgcaaataaaaaaaagttcattttaaatgcctttagggaaaaaatcactctattaatcactcaaattggtaattcctaaaggaatgaacttatttttaaaaaatacttatttttaccaaattttcaataaatgtttaaaaaaagttattttaactaaaaaatattactttttaaggcctaaaaattgcacatatccctaaatcttttccaaaataacatcaaaaatgatattggctatttctttttttgaagacagcggaacacttacaatatcatcgtctacaatccaaaccttattattatctgaaccaaaatgacaattctcatcactaacatcattagctattaccaaatctgttcctgcatctttaatctgttgttttgcactggctattatgtcttctttagaaatattaacttccgccttaaatccaactaaaaaaatatccggattcaattctttaatctggcggatgattttaatggttggttttaaatttatagacagtgcctttgaagaatcaattttatgagtgtccttatcttcaaatttaaaatcagaaactgcagctgttgaaataaaaatatcctgactcggaattaatttcttaattgctttattcatttctccagctgtttcaactttaataacattaaatactgaagggattcttacactaacattagctacaattagtgtaacatcaaatccacgaatataagcctgtttagctaattccaaacccatttttccagaggatttgttggttattccccttatcggatcaataggttcataagttccacccatacttattaaaactttttcgtggataaaaccacctcatttatttaaattaattgttcttaatgcttctaaaactatatcttctttatctgggaattttgctttgccttcatccattttaggtttgataaatgaagcagaaccctcttctttaattttatcaatattgtctttaatagccttaaacattgaatcatgcattgacggaacgaacaaaattggagtgtcatgtccatatgctgtaatcaaaagtgtagagattgggtcatcagctagcttatatgcaaatttgcttatggtattcgcagtagctggagcaactaatatcaaatcctcttgtgaatatttaacatgctcaatcttaccagtcaacctggttaccacttcattacctgttgcaaattccatagcatttggagtgataatatcgcaagcagcttcgctcataaaacatttaacttccatatcatttcttttaagttccctagctaatttaatagattcagtagcggcaatactgccagtaacacataatataatcatgaaaatacctctaaaaaaaaataaaaagaattatgcaccaatttgcatattttctaaaatataattaaatgaatttagattttcattaaatttatcaattggagcactatacaatacaacataagcctgatctcctttatcaaaccaaatagccttatgttctttaactactccatctacatcagatgtataaacatattcagtagcatttttatcgttgattaaaacctgacctgatgaagtcaaattaaaagatgaatcatgctgcattgcagtataagtcttatttataaatgaatcaaaacttccctcaataggctgtttttcaacattgatggtaacttgccctactttagatgaatcaatagagtcagattttgcaagagcaattactgaagaatttgaagttgattcagaaagcacccattcagaaggatattgaaccatgactccccctttagaagaacttaacattttagtagcattatcaccactacttcctgtaaggtcagctgtagatacattattcataatcaagtatccgaacacacaaacaattgctacaattattataactccacatataatattttttttcataaattcaccattaattaacttctatcctgtcacagttccttcaacagttccagaatctccggatccagaactacttccagaaccagactcttcaccaccagttccagaatcataacttcctgaaccttgaccagaagatgaatccccactatcgtatgagttatctgaagtataagtatctccaacttgaacagaatcattatccgtatcatttactttgacttcttcaacctctggaaatgccgtatcctcaacaatagcctgcgcatcagttactgaaatgtttccaaagtcaaaagttaaaactccataaccaatacctgcagtaaatccgattactaaaactaaaaccgcaattaatttaaaagtaccattatccataggaggttttttctctttgttaaaatctttatctcctttttttggattgataatatatttttgaactaaatcttgctcctcttttttcttcttattaagtttaggaggtttagggttagtttttcttttaccagatggtttaccctgcatagacctaattctattagtagcatcacgagcatctaatgtattgagcttatcttcatatttagagcgaaaatatctgtatttttcttcagaaattttgccatgagcatagtctgcatctaaacaacgcataactcttagaagtttctccttatcatttggcatgtataccatccctgaatcttatcataatattagtttattaaaccaataatttaaagtttttctaaaactccgggtaagaacctaaaacctttaaaaagtaagtaagcccatccagttcatttagaatattctgaacagttttatcttttctatgaccataaaaatcaacaaaaaacaaatatttgcccaaaccttttttagaaggtcttgattcaatttttgttaagttaatactttctttttcaaaaacacctaatattttataaagcataccaggtttatcttcataaatagagaatattattgaagtcttatccctgccagtaggctcatgatcatttttcgataaaactacaaaacgtgtttcgttattatccaaatcctgaatattaggtttgaggatttccaagccataaatctcagcagctttagaatttccaatagctgcctttgttttatcgcctaaaatacttttagctgcactggcagtacttacagcataatggggctgtatttcattatccctaataaactcctgacattgagctattgcctgagaatgagaatatacatcagttatgtcattcataactgttttaggattgacaattaaattctgattaattggaattaccatttccttaaatatttttaaatcaaatttatgagctaaagaatctagagtaagtcctaccggaccttcaatagagttttcaattggcactactccaaattgacactccccatttgaaacactttccatcactgcaggaatcgtgcaatatggaattaaatttccctcaagtatataagctgcttcatgagtaaaagttcctttcggacctaaaaatgaaatattattacacataatactttgtgttatattgcttgacagttaaaaagtttattgtaaaaaataaaaaagaagaaatagctaaaatattagctattaaaatttaattaagactctaatttagctataagtcttaaaatatctgtttgggttataataccaattacattattgtcttcaacaacaggcaaaccattataaccagtatccatcattgtgttggccacttcggaaatagatgcattctttgaaatagataacggattatcagacatgacttcctcaactaaaatttctttaatttgagttttttgatatttttcaggaacattttttctgaaattgataaatgctttcataacatcttttgaagtcatcatacctacaagttcatctccatcaataacaggcaaccttcctacatgagaatcaatcatgattcttcttgcatgaaccagtctttcctgtgaagatactgctttgatatcatcagacattacttctttaacagttattttatcaaatgctctaccaactgcaagagttacaaagtcagcttttgaaactattccaaccatcatatcatcgtcagatacaataggtactgaaccgataccgttttccaacattaaatttgcaacatctgccaaatccattgtttcaacaacagagattacatctttaaccataacagatgaaatatgaagtcttgatgcgggcatattttcatattttgaagaacctaatttatcagctacatctctttctgaaataattcccactaattccctttgatgatctttattagtattgattaccggcaaacgtgaaacatcatttttagccaataattttaaaccatcagaaagtttttgatccttatcaacagtgattaaatcttcagacatcaagttttttatttgcatattatcatctccatttagttacgaataaactatgtcatctaaaaaaataggaataaaaagaaatactcctattttttaaagtttataatgttttaattgcgttcaatatatctttttcagtaatgataccaataatctcgctgtctttagttacaggcacaccaccaatatttttctcggcaaataatgcacaaatatctccaattctttctgtttgagatacagtaattggatcttctgccataatattagaaactatgttcttcaatacttctgaagcagcattagaatttaagttatcaaataattcttttgcattgaaatacctaataatatcagtagaagttactatacctaacagttttttacttgctttagatatgtcagcttcacccccaacaataggtatccttcttaaaccgtttctaaccattattttacaagcactttcaattggagttccaggagtggttgtaaatactttagtagacatgtaatcctgtgcaacttcttcagtcaatacgccagctaatgataatacaatatccctttcagttacaatacctgcaagcttatcattagcatctacaagaggaatagcaccaatttgattagataacattgtttcaatagtatccttaatagaagatttatcagaaaggcaaattacatcacgagtcataatttctctaataggttcattaatagctgctaaaaagttatcttcgtattttttctcaataatgttaaatttctttcctccaccaaagaaatccaaaatatccattactgtaacaatacctaaaaccttaccagaacccggatcagctattggtaacctcctgaactcatgttccatcattactttagcagtatctttgatacttttagttggaggtatagaaatcacgtctttgcttgcaatagccatgatttctccttctttattagaaacttttgtttcatgctcgactgagcccatctttatagattttcttaaaatggatgatttatctttcattttatcacacctctagtagttctaagtgtacgcctaacaaaaaataattcaataaaattcaaaacaaaaaagatttccacattcactcaatattcaatatcttgtgtacctgtggaatggtggatacttcaaaatattgcccaacaatttctgaaaattcaaataatttagaattagaattaccccaatcctctaaaggactagatggctggataattatttgaagtttgtttttgcttgaaatattattagataatttttccattacctcttgaattaaatttgtttttgttgaaggcaatacaactactttacaatataacattatagacttcgccattaataaatttactgatttgatttcattgataaaaatatcttcattaaaatcattgttaaaatgttcaggtaatttaatatccaatgatacaatgtctaatttttcaatgaaatcaattttttcaggcaaagtgccgtttgtttctaaaagaattttcaaatcagtctgacgagcaacttcattaataaattcaggatataaactaggttccccaccagtaaaagagattacatgacaatcaggagttctaacattttcaatagctgccaaaacatcatcaactgtcattaatttacctgatttttcagatttgctatcattagtatcgcaatagctgcagtttaagttacatcctgcaaatctaacaaagatttgtctttgaccaatgaaaaggccttccccctgaaaacttgaaaaaatttcgattattggagctttcataactaatcatcaagcacttttttataaattgctccctgtccgattccctcattaactccaactgcaacatattccagattatcatatttttcagctaattttttagttaatgtttcagcaaaaaatttggacaactcttcagcagaagaataagggagaggtaagaaaacacaatcttcaccaggaatagaatatccttttccagctattttaaaatgaactgttttttcttcttttaaatcgaaaatagagtctgattttttattaaaatctttaatatctattaaatcattgtaaacaggaattaataacctgtggtccaattcattacaaattgctttagtgtatgctttgacatctttaaagtccactacaaattcaaaatcccctgcacgttctccttcgatttccacatctacaaaataggaatgtccatgaatataaccgcatgattcatgtcccggaataacatgagctgaagagaatcttaaatttgattgtataccgttaatcataattttcataaaatcaccattctataataagttagttttgctaatatctttttcaattgtttctaattcatcaatatatctgccagcaacatcattaaccaattcagttaagttatccttgttgaatatttgattgccatttttatctttaatatcaaaaagaccgatagtttcaacatcatctggagttcccttatcctcaagatttagagcaaaatgtattttcatagaacttaaggatgcactagctattgaaatacttaattttctattttccacaaatatatcatcaccttctcttttagaaacaattcccttttcaaaaagaacttctctaaaaatcatgacaatcaatctttgacgaaggtaagctattctcatatttgcaggctggcagtcaaaaaattcacaaataaaattaatcatataattagatttgatttcaagtccaacatctgcaaaatcctttaaattaccaggagtaatatttacaggacctacccaagtaataatagatgatccataaattccaaattcattaaaagcccaggaaggattaatttgacttccatcatactcgaaaatatcatcaatatgtttatgaataatagtcatgatttaatgttagatgctatttttatataaaaatattgtgaagtgctgaaaaataatttcactttaaaaagaaatttaacacaactaaaaattaaatagaaaatcaagtttaatattaatttcataataataaagtaaggaagttatttttatgaaacaagttagaacaagagattttatttatacaacagatggattattctttgcttctaccaattatgttcatcctgatgatagatttatctcatttttaagatatattccagattcaaatggagacagggaaaaagacggtaaaaaatacaggaaagttacatctgatgaagcttacagttatttaagagaaaatcatccggattatctatatttctgtgacgtgacaaatgttgaaatgatgggtgttcccaaagataaagtagctgaaattattaaacctgaagaaagactggctgaacttagagatgctttcaataaaggtgaaaagctaaaaaatccggaaataatggctaaactaatggatgtcagtgactttttccattatgttgccggtgtgccttatgaaaacttgggaatttccggatctatcctccccggacttcacaaagaggatgtgtctgatattgactttgtaatcttcggactggaaaatcatagaaaagccatgaaagcatttagagaaaataaaggtaaaaatgtccatattgatgaagttgacaaagatattacagtaaatggaattgtagatgaattttgggaaaaagtctacaacaaacgtatgaaagattccagtttaaccatggacgaattcaaatggtacgaaaacagaaaaggaaacagaggaacaataaacggaactttatttgatattttatgcactaaaaattatgatgaaattagcggcgaatggggagatactgtttatgaaccattaggaatcgctcaaatagaatgtgatattgtaagtgcacttggcgcatttgataatccttcattatacaccattgaaaacttaaaaatacttgatggagttgaagcaccaatatctgaagttgtttcatttacccacacatatgcaggagaagttattgacggcgaacatgtcgtagctaaaggaaaagtcgaaaaagtcattagtgaaggtaaaaaagattcctacagacttgttattggaactaccagagaatccatggacgaatatgttaaactcaaagaaagtcctgcatgataaaattgttttaatagctaaatattattagctattctctttttttacttatttttaaataatttaagacatttataacctcttattatttatattatctaattctaatcaataatatcgattttaaagaggttaaaaaatgataaatatatcatctataaaaatgtatatgtactgcccaatgaaattatatctaaaaacacatgttgatatttctcaaaatgacgaatatcaattatataatgaaattaaaaatctcaaaatagatattcaggatttattgcagaaaaatatgcgcaaactaaataaaactatgaatttaaatgaaatagaaactgctttaggtcaaaatatagctgcatacaccgaaaataatatcgacaccataaagaatttgaaattaggaattacacaagagcagacagacgaaatagtagatgaaacttattttaacataaaaatattggctctcaaagccaaaaaggccatgaatattctggacaaggacggaatggaaattgtcgaaatgttttttccaaattgtatgtattcatacctaatgaaagacaaacaccttgatttagtaggaatatgtgacaaaatagaaattattgatggaaaatattatccgataagttttaaaagttcaaaaccaccacttaaaggaacatgggacggtgatgcaatagaactagctgcaaatgccatcttaattgaagaagaatttgacaccgaagtttttgtaggatttgtaaaatattcaaaaatagacgataaacgaccggtaattatggatatgaatcttagaaaaggactgtttagtgtattgaatgaagttaaagaaatcataattaataaaaaaattccaaaagtaaaaataaatgaaaaaaagtgtagaaactgcgaatattatgcaatttgtacaaaagattaatatttaatattcccatgaagctttttaatgtcaaagactgcagtatcagctattgccattacagcaagcactcccgcctgtacaggatcagttataattaaatctgcatgctccgtaacacttccaggcatatttaaggaaattacaattactcctttttccttttttatttttttaacagcttcagatatttctccacccattaaagaacctgccaataccaaaacatgcgctcttggaagtcttgatactgcatcagtagcttcagctatattctcttcaccaacaataggaagcgtatccacactaatacgttctccacgaatattatgcctgtcagcttcagtgattgcacctaaagctacttgagatacctgtgctccaccaccaacaataataatacgttttccataaatatttgattgtgaagaatgaatttctacagatttaacttctttaagagattccaaatcagctattaatgaatcaatatcttccacatgttcaagttccaaatctattgtacccacattatttttttcaataaaaaggtgagtatagctaatattaacttcatgtgcaactataattgaagtaatatcatccaatactccttttttttcgtcagatttaatggttaaactataattttccattttaattccttattttatctaattcagcatgtgctcttttccacatttttaaataattatcctcttttgatacaggaattacttccaggcctaactccctatgctcttcaatccagctttcatcaaaaaccggaatttcaattttaataggttcagaggttttatttataactataagattcctataaggaaactgtgtttctacaatatatcccccaagacttaccatatgttttggctgcattacaaatttcaaataatcacctcataatactccaattacaatagctaatactccaagcaaagatgttccaacaatagttggcaataattgtctgtttgtaaataccggagtgaatgctgaaaaaatacccatcataaatacaaatattaaagctacaacaatattaaccaaaattccccatgaaaatatatttggaggtattccaataaataatactgaaaacagagcaccaagtacaaacatcagaaatcctctagtaacaaatacaacagacctatatttggcagcatattccatatacggaccttcaattacatcagattttgctttaataattgaaaatggatattcatttaacagaatcatgtatcccatgaaaaacacaattgctgcaatagcacctgatacagtaaataaaaacggcccgttagcctgctgatattgaattatatcctgaaggaaaatacttccacagtatgttataggtgcaaatactgccaaatacaatgggaatgaaccataagtaatcatccttaaagatcttcttgcacttatatcttccataaaagaccttgtagtatttgtatgtgctgctcctttagccaaatcaggaaacggcatcctgacagacattacggacttggataatgcccccatcagtacataacatatttcttcaacttttaataaacctacaacagctattaaactagctaatgcaggaacataaaatgcctgaggagttaaagcaaccaatatacacaatactgccataaaacatataatcggcaatgccttatacaattttggaagaggtgaaaccacatcaacatttttcttaaatgcaaatttaattggagccatgattccaggagaagttactggcggtccgatcctttgttgaattctagcatgaacatattttcgctcaatacctggcaaaaatgtacttacaataaaacaaacaattactgtagcaattactgccaaaatagaaaacataatagtattttgcatcataattttatctcctaattatctcgattgctctgtcagtacaggtaaaacacggatcacactgtacaatacacaactgcgcatcagttatttgatcaccgatacatgcatattgcattgcacctatatttgccatagaaggtgtcctgataatagaatgtctgactcttccgctttctaaagcatatgaatgatataatgttccccttggaacttcaatacggctttcaataatatctgtgtctttcatttcccaatcatgagttacaaccggaccttcaggcaagtttttaacagcctgacgaatgatttttattgattcaaatgattctaatgccctcatcatcaaattagatttaacatctccatcttcctgagttataatattaaaatcaaacggatcatattcactcattgttgttcttaaatcatataccacaccagtagctcttaaagacgggccggaaacatctaatttaatagcctgtttttgaggaagtacacctattccggtaatccttgacatcaatattgaatcagaagtaaatctgtttacaaagtcagttaagccttcttccagtgcatccatatcattagctaatctttcaagtcttttagaatccagctcacatcttggcctaacaccaccaataacagaacaaccatactgaaccctgttacctccaatcatgtttagaagttccattactatttccctaagatagaaaactctcattgaaaaggtttcatgagctaaaacttcacaaccatgagccaaatataggaaatgactatgtaatctttctaattccccaacaattatcctaatataacttgccctttccggaatttcaatatccaaacccaattccgcagtccttacagaattccaaacatgagcattagaacagattccacatattttttcagttaacgcattggctttttcaacagggagtccttccatgattctttctacacccctatggttaacaccaatagttatttcagcttcttgtacaatttcatcttctacaaaaagccttactctgtatggctccaatgcagcagggtgaactgtacccataggaatttctgtttctataattttactattcggtattttttcatccatttttttaaactcccctttttaatctgcatccagtaattttggtaaaattgatacaacaccagataaaacatcctgaggccttacagcacagccaggaacttttgcatctactggtataatgttttcaacaggcccttcaatttcttcagaaggaatatctccatgaatattcttataaactccacccattaaagcacagcttccagcagctactaccaatttaggttcagggatagccttataaatttcttccaacggttttctgtttaatttggttacaggacctgtaactactaaaacatcagcttcacgaggattccatgttaagaaaaccttatactgttcagcatcgaatctaggtgataatacagagttaacaatctcaatatcgcacccattacatccaccagtataaaccaacatcagatgtattgctcttgctcttgaaaatgatttaattcccatataatcccccttaatcctctctattttttaatattgttttatctgaaagatactgtgaaataacttttaatttatcatcagatattttaactggctgattaataagttctgaaacatccacttcctgatttccaacagtatttggatggatagttcctttttcaccatataataaaaatacagggcagaaatcatgacaataataacataccacacattttagcgaatttaattcaggaacttctgtttttgtccagctgtcagtcaattttaccggagatgctaatttcttcatttcaatagcattggttggacaaacattggcacagcctccacaaccaatacaggcatcttcatctactttttttgccggtttaacagaaagtgtacttatctgttttcgcatttccatgtcagtaactctatctgctgcgaaaaatattcttttaaagttagtgaatgctccttccagtgctattttaagcatgtttctcatttagatctcctctatagaatctttaaaatttctctcaaacataaatgcatttgcaggacaggcgtttttacatgctccacaatatttacatttgtcttcatctacttcaaatttgccattatttttattaattgcatcatatggacaaatatcataacacaaaccacagtgcatacataattgctgttcaatgaaacagaatccatcaacaatctcttttttatgcatagtagttcttggaattgcattaactggacagtacacaccacagttttcacataaaatacatttatctaaatcaacagagattgttcctctatgtagagtaatagcttccttaggacatacttcacaacatattccacatgaaatacattcatcagttattgatccatcccaagtagctactttaaacaaccttgcatcattttcacagactttaacacagtttccacaggatacgcaaaatccggcaagtgtgttttgttcttcgccagttatttcattaacaagaagcatttcatcatcttcttttaatgtagctaccggacaagaatcaatagctattttatgtgcttttggtatattttctccaatatcttctgttggatcatatcttaattttgaatcttcatatctcaaagaatcattttcagacaaactagcgcataatccgcaattaatacaagagataattgaaccttccggtttttgattaatatgatttacatttattttaaacttcccaatagatattgcattatgaggacatgctttcaaacaatttaaacaaagtgtacatgtgcttttattaacaatgtggtttttattcattgcaccattaggacagacatcactacaaagtccacaatcactgcaaataccttcatccctatctaaagttacctggattgtacctgtcggacagtacttttcacatcttccacaataaatacacctgtcataatctgttgtgaaatagcttctggttacctctgttgtttcactaggcttatgaggtactcctttatatgttggtaatgcattgcttaaagattttataaactccaactgtttttcttcagttaatctaaagctgtcaatcctggaatttgatgggcaagcttcttcacaaactccgcaacgtgaacaaataccataaacaatcccatcttcaattttaatattatctatagggcagttatacatacacatcccacagccgctgcatttggctctgtctacaacataacccccatagctattaatgaatattgcattacttggacaatttttataacataaaccacaagtaaggcaacttaaagcttttccattaattaaacgaatagcttttgtaggacactgtttaatacattccccttttccatcacatgtattagttgatacaaacattataaacccctcaatctcctcttccgaataataatttacctacaaaaataccaattaatgcaaagaaaaatcctgaagctattggcatatctgtgtaaaatggaaacggacctaattgccatgcagaaactaaacctacaatgaaaattattacaaatgatgctaaagtgaactgtgtatccatagatttagttttaatttgagaacctataagaactccaaataaaaatccaaatattatcgctcctaaatttaacatatgttcacctcagttttcctcttcaaattttttaaatcccatgaaagctataacaattgcacttaaaccaacaaacacttttaatccaacaactatatttaaatacgggactattcctgcatttgttacatcaggataatggaaaattgttcttacaaatcctggaactactcctgaaagatctgttcctacattatacaagaaagcacctgcaaagaataaacctacaagaccaagaccaatataaaccaaaattccgaaactttctacaatatctacaaaattatgagaaaaatttattggggatttatctaatccatacaccaaaatacatagaataacacctgcagtaatcatagctccaccttggaaaccacctccaggagttatatgtcctcccaaaatagtcattattcccatacatgatacaaaaattgcaataggtaaagctatcaactttaaaatcacactattctgactcattcttctttaccccctaatcttcctctaccaaatacaagtaaaacaactaaacctgcagtcagtaatataatagactcacctaaggtatcataacctctaaaatcaaaaattacaacagtaattaagtttggagatatgctggtacctaaagcattgtaaatattacttacaccaggaacaatgactttatttaagttaaataatgcatcaaataaagatatagaaaataatacagccactactgatgcaactaaagttttaatactgttagacaaggttaccaccccagtaaacaaataccacaactattcccagcaccattactgcataaaatatcattttatccaatgaatcatcctgctctattttaaatttaggaattaatggcatattctttattaaaacaacaagaacaatcaaagtaacaagccctgaaagcaatatatgaacatgtctcaataataaacatgtcaacactaatgaaacaatcaataatatttcagatgtaatacttccagaaacatctgcattagttacaggacctggagaaaagaattttctaaaatcctttacaacattgaaaatttgatcataaagtttcataaaatacctcctacaaactcataaattccatttgtaacaagacctgggcaaagacccaatataataattaaagccaataaaacaaccattgcaaatactgctgatttaggaacctccttgtcagggacttccaaaccttttggttttggtcttaaaaacattccatagaatgttttaacaaatacaacaaatgtagctatacttactataaccgcaagaatggataattccggatatccgcaacttaatgaagcttgaacaagcattaatttactttggaatccgctgaatggaggaacaccagccattgccaaaccaccaaataaaagcattaaaccaactttcggatgataagcaagcaatcctcccaatttacgggtgtcttcctctttagttacataagcaataagtccgaatcctataaataataatgcagtagtaattatttcattaagtgcctggaaaagacctgcagtaattgcaaattgagttccaagaccaatacctaaaccgataaaaccaagctcaccaactgccaaataaccaatcattcttctgaagtctgtttgagttaaagccagtgaaacacctagaatcatagccaatactgaaaacaaaaccaataacagttcaaatattggcaattcatggaatattctaaacattatcaatacaattgaaatcattgaaataaccgtaaatgtttgaagcaaagctgcaccatgaggttctgctttactgtacattccggattttataatatggaacggaggcaaacctgaagcatataaccatccgaagaatattaaagcaaatgacattaaaaatactggggaggtataacttaaagttccattgtgaagagccacaattatatcagaaatgttaatattaccagtacttgcaagtaagaatccgattcctaaaagcattatcggacttccaatagatcctaaaatcatatatttaagagccatttcataactgtaatccataggagacgcaattacaatacctacttgaaccaatgcaagtatctcaaagaatacaaacatgttaaatatatcatcagtaagcattaatgcagttacagatgctgtacccatgaacaataagaacaaatactgtccggatgcttttttatattttgacaagtaaataaaagctactaaaaatgttattaaacctactgcagctatgaatatctgttgcagcatgtcaaaagcataagtaatagccggatgataaattacaccagttgcattatccaacatcggagtatatcctccaaagaagtgcaatccataattggaaagcaatggaataatcggtaaacagatagcaactacaaatgttaatactttaatagatttattaaatttagcaaaagcatttacaagtattgcacaaagcataggaactactaccataagaggaatcaaatagttactcatcgtattcctcctgtttagatgtatcagccaacagtacttttgtacttaaagttccgtatttcttgtaaataaccattacaatagccaacattacagccaatgtacttgcaccgattacaatactggtaagtaccaatccaaaaggcaatggataagcagagtttacagcaaaccatgacggagacattccaggcatcaaaattggaactactcctccaggtttgtatccaatagctataataaataaatttgcaccttcttcaatgaaactaataccaattattttctttacaatattatcaatgaaaatagctgcaaaaagaccaacaactaccaatgctcctgcagtaaataatgctgctaattgcatatatgccatcaggaaccatccctttgtgttttcttaacagccaatactaaaaatacaggaacaatagctgcaccaacaatagcttgtgttaaagcaacatccggagcaagtaaaagttggaaaagcactgcaagagcaccaccagaaaatcctgttaaaattgctgcttttaacaaatctttttgaataagagcaagaatcgcacttaaaactgtaataatcattaatataatacttaacatcttattcatcctcactaatctctaatgtagaaatagaaaatttaatactatcctcattactctcatctgatttattttccatttctttaactttatttatattatgaacaaacggattttcatcgtctgaactttcaacttccacttctttattttttaaattatttactttatcttctgagttataaaaagcattagctattgcatgtgctgtaaatggtgctataactaaataaatacctgctaaaagatattgttgcaacccaatcattgctataataaatgcaacatcaaaaacaccaacaatatgaattcttgcataaatcaaattattcatatttttatccagggttaaaaatccaattgcagatattatcattaaaatagctgaaataataagaagaatagactgaatcaactcaactgcaaacattagtcatctcccccttgtgtaacagcaaaagcaacagtccctataaatccaaaaagcactaaagctaatgaaatatctttaaagaatgatatgtcatacatatccccaacaacaagtaaagataatgcaaaagctacaactacaacagaactgcttaaaagccccattgttgtagatttataagcacttgcccttaacgcagcaagcatcattatcattgatgcaataaccacaaaatattttgaaataaataatatgtccattactatcccactcaacaattatttaaacatataaagaaaactactctaacatcttctttatatatggttcaaaaggaataatatcttccttacttcttggagaaatagcagctactttaataatgttattttcagaatccaaatcaactgacaaagttcccggagttaaagaaatactgttagccaaaattgtttgagaaacaggtctctctaaaactgtctcgatttctacaactacaggatcaatattttgtctcataattccattaaacgcaacatcaaaggttgctttaagtatttcataaataaggtctaagaaataaataatcccataacctagtctagttaaaaacattaaataagctccatttcgtagattaaaaagtcaaaataataaaatataaaattgactacataaacaattattaattatcatgattatttattataaatgtatgcatttaaatttgaagcaataaaaaattattcaaatttaagaaagtaattgataaacaaaaattaactataaatttttcccaaattatttaaaaataattacaattaatctaaaaaatttacatcacatgcataatcacttaaacaaatcataaagctcatttttaaaatagaaagatttaataacaacaaatacaaaaatttagatacacctaaaaaagtgatgtaaatggaaattttagaaaaagctgaaccggcaataatctttttagccattctgttagggcttggattaagtaacctccctcttttaacatccaatagtggatctttaataactttatttttttatgtttaatgttatatgggctgtttctggaagttccgcttaaagatttaaaaaatagctttaaaaatgttaaattcacatccgcaagcctaataattaactttatctggacaccgcttctaggatattttctgggagttctatttttaaaaggaaatatagatatcttaatcgggttttttatgcttatactaaccccatgtactgattggtacttagtatttacaaaaatggcaaaaggaaatttaaatttgagtttttcaatacttccaataaatttaatacttcagattgtattactgccaatatatctaataatcttcttttcaaccagcaattccatgaattattatgaattagcttactcaattttaattgttattgtaatcccctttattttagcgcagctgacaaaatacatcttaaaaaacaaaacaaaaataaatgaaaaaataacccaacttttttcaaagtatcagacaatatttctagctattgcagtatttggaatattcaatagcgaaggaagaattgtttttaataatttaaactcaattttactaatattcattccattaatcttgttttttatcataaattttatcttagattttatagtagctaaaaatatgaaatttaattatgaaaactatacaagtctgacaatgaccactttagctcgaaattccccattagccctagctattgcagtaaattcatttcctgaaagtcaattaatattaattggactggtaattggacctttaatagaattaccagttttatatggaatatcaaagctattattagcaattaaaaaaagatattaaaagaaactaatttaatcaaataaatcccacattatgaaaaataaatatttggaaaaaagtattgcatcaacatgattatttcaaaccttcttaaataaatagctaatatgagcaaaagtactatagataaagttccaaattgtttatgggactttttagaagataatggggcgaataactttattccggaaggactgaatgaatccagaacaatatgacttaataatcctaaaaacaatcctacagctatttcaacataatttacagatagtgttccaaataaaaataaactaataaaaaataatggcaagaatattaagagcagtttcttattcagaaataaaaagcttaaaagagctatcagaatagccataaacaaataagatgtaggaattattgttatatccataagaatttcataggcccaaataagtattaaagaaactgtcgcagttaatgtaagtacaccaaaaatagagtgagtgaaacttctgtgctgggaaaaataaaagacagttcctaaaaatactattattaaacctaaataataaggcaattttaagatataaagagatataaacactatcaatcccaaaataatcatcttatagacattatcttttttaaatttatgatcaaaatcaggaatattagcaccaattacacttaaggcaataattagaggattattaaaaaacattaaagccaaaatcaatgcaaatattgtgtgtcctttatatgaagacaaaaaatcaccttaactttaaattataagttaatattacaaattaatagcgatagcatttgaaaagtatttaaaaaaatagtttatttgaaaatgaaaataacaatctaaattaaaggcactgaatcattattttttaaaaaaaattccaaaataagataaaaaacttttcatttgcattaaagatttttcatcactgccttttccaactaaagcaaatggagataaaacctcaccagtaactgcaggaactccttttaaattgcaaacatcttcaactgctcctttgtaaatttttcctgcaaattcaaagctgattactttactccccatttgtgctgaaatataattggctattaaacagctttctggagaaggatttctgcttgaaaatactgattcaaatccaggattactatttttagctgttgaatgaaaatcaccaacaaaattaacatccaactcatcaatagcctgcatgattaaattacttaatgaatttttaatatgtgctgacctgtttaaatctcttgaatttaaagttctttcattattcatagtagcttttggagctgcaaatggaataatataaacagtattctctaatttagtattgattaattcatttaataaccttaaactggccaattgtgaaggaagctcattgccatgaattccagaaatcattaaaatatttactccaccacttcccaatttaaatataggtgttccaaaaacagcttgttctaaaataaattgatttaaatgagtcaattctattttttcaaaaagatatttatttttagagatgtagcccccagaattgtttgaaataaaactcattttcaaaccgttaaaatcatcaagtacttcaaaattcattacttaatatttactttaaaacttttatttatattatgacacaaagtataatttaagggataaaattgaaaaaatatatcaaacagttaattaagcttataaattatgaaagagatgccgaaattgaattaatgactaatgaaataaaaaatttgtctccaaagaaaagagaatcattaggaagagccatcaataaagtaaaaggaaaatatttaggaaaacagttgggttctcaaattgtacagttcggaaggtctgaaaaaatcgaaacagaaatcagtgttggagacatggttctaattagtacaggttatcctttaagaagcgatttaacaggaacagttgttgaaaaaggtgccagatttattaaagtagcttttgaaaaatcaattccaaaatgggctcttaaaaagaaagtcagaattgatttatatgcaaatgatgttactttcagacgaatggaagataacctactgcatttaaacacaaaagggaaaaatgctcttgaatactccttgaaaaaaagagaccctaaagaaaacaagaaagaaaaatatattgattttatagacaaatcccttaatgagtctcaaaaaaatgctgttagaaatgcagtaaatactgaaaatttctttttaatacacggtccttttggaacaggaaaaacaagaacattagttgagttaatccaacaggaagtaaggcagaacaataaagtcttagttacagctgaaagcaatagtgcagttgataacatattagacagactatcccaaaataaaaaattaaaaattacaagattaggccatccccaaagagtttcaaaagaaaatatcacatattctctggcttataaagctgaaaatcatcaattgaccggtaaaattaataaaaattacaaaaggatagaacaaataagcgaaacaagagaccgattcaccaaaccaactcctcaatatcgcagaggatttagtgattcagatattctttataatgcatcaaaaggcaaaggtggacgtggaataaattcttccaaaatggaatccatggctaactggcttttagaaaatgaaaaaattagtgaaattcatgacaaaattaaaaaacttgaaaataaaatagttaaagatattattaacagcagtgacattattttatcaaccaactccacagcagctattgaagaaatagccagaacaaagtttaatgtggtaattgtagatgaagcttcccaggcaacaattccaagcattttaattccattatccaaggccagaagatttattcttgcaggtgatcataaacaattgcccccaacgataataagtaaaaaagcacattttcttgaaaaaaccttatttgaagagttaattaaaaaatatcccaataaagcaagtttactgaatgttcagtatagaatgaatagctttttaatgaagtttccaaattcagaattttacaatggcaatttgaaaagcgattccagtgttgatgatataaatcttgacgaaattattgattcggaagagttgtcccgtctaaaagaaagtgatgttgaaaaacagctgcacaacaatttgaaacctctattattcattgacacgtctaatttaaaaaacaatgaagaaaaacatttaaaagattccaaatccattatcaaccagagcgaagcggccattgctacttcaatagctaaattttacctgggaactggaattaatccaaaggatattggaattataagtccctatgcagatcaagtcaatttaatccaggacaaaatccccattgaagtaaaaagtgtagacggttttcagggccgtgaaaaggaaattataatcatttcaactgtaagaagtaataaaaatggaaatattggatttttaaaagatttaagaagacttaatgtggcaattaccagagctaaaagaaaattaatagtaattggcaataaaaatactttaaaaggaaattccacatactcgaaattaattaaattttgtgcaaaaaatgatttgttgataaattttaggcatacctaaacttttatataccagaacataccaagtaaatagtagagagaaaaagtaccaacatacttttgaatctctaactcttaattggggggattttttcttaaatgtaaaacccatataacttttcaacctcaattataagaccccaattaagagttctcttctgtcaaactattttttattaaacttaacaaagaaattataatatttttatgaaatgctttcaaaaccttttgtagtcagtaattttacaaaagaaccacttggagacattacaatatttcctttagaatattcttctagagctaccttggtcattgtacttttcttaactggatctttagaagcttcagaaagtgctttaactaacaccattacagcatcacccctggacatatttccagttattccatcatcccttccatgatatccagagtaattatcattttgtcttacaatatctgttgcaccaagatccgtttcaaccccgtcaactttaagtggcctaattgaatctataatggcatccaatccgtcatcatatataattactactgcatcagcatgcattccagtattagcttctacaatttcctttgcatattccataccctgttccgggccatcccacagacagtcatgaagacgcattggcccttcaagaccacctaaagcttgttttgtaggatgagtcattccaccaggatatacaggagtataattagctatagttccattttccagtttaaccatgtatgccatatctacaccaccaccaggctgttcatctttgtcactagccaggaccaatatgtttttatcacctgaagccagactaggacctcctaaaaagaaacttcctacaaatgcaaatatcccaataatacatacaataaggataagtataatcagtttttttcttctgttcatattcccacatatcaaatatttttttacatttattttaacttaatataataaataatttttcttttcttaaacatactttttaattaatgaaacaatataataagacacttcccacattatttaattaaaaaaatcaaaataattttctaaaatggaaaaaaattagattttaaaaatataaaacaaatttgcaacaaacaaagaaaaaataaattacaaaattaactgataaattaaaaacactgattttaaattaatattaaatactattaaaaatagaaattaatttataatatttattatggtgatcaaatggacaaagtagttcttgcattcagtggtggattagacacttctgtttgtgttaaattattagaagaaaaatatgatgttgaagttattactgcatgtgtagatgtaggacaaggcgatgaagaaatagctaaagctgaaaaaatggcaaaagaaataggcggctataaacactacactattgatgctaaagaagaatttgcaaatgaatacatagctagaggaataaaagcaaatgcagaatatgaaggatacccattaagtactgcacttgcaagacctttaattgctcaaaaaattatcgatattgccaaaaaagaaggagcaacagctattgcacacggatgtactggaaaaggaaacgatcaattcagatttgaagctgttattttagctatgtctgatttagatattattgcaccaatcagagaattaaacttaacaagaactgaagaacaagcttatgctgctgaaaaaggcatcaaattaaactctgataaaatttacagtattgatgaaaacatttggggaagatccattgagggggatattttagaagatcctgcaaatgaacctcctgaagaaatttatgcatggactgcttctgctgaagatgcacttgacacccctcaaaaagtatctattgaatttgaagaaggtatcccagtagctataaatggagaaatgatgccccttattgacattattaaagaagctaataaaattgctggtgaaaatggtattggtagagtagatactattgaaaacagaatgatcggacttaaaagtagggaaacctatgaagttccaggtgctaaattactgattgcggctcaccaggcattagaggaattagtacttactactgatgaattaagatttgcagagtacatgagtacactttatgctgatttagtatacagagcattatggcaagaacctttaagagaagatatcgatcaagctattgaccatatgcaaagaagagtaagtggtgaagttacaatgaaactctttaaaggttccattgcaccattaaccagagaatctcctttcagcttacacagtattgaacaaattacttttgaagataaagaaactgatcaaagagaagttgaaggtatgatcaaataccacggtttgcaggctgcaaactatcaaaaacttaacagatagcttaaacagctatcttaaattactttttttaaaaaaaaataaaaattagttactatcaactaatagcaactaattaaatggtccaggtatttcacaaacatcattgtctttagccagataagtatataccaatgctgcagcaatagctcctgcaattggacctattaaataaattgggaaatatatccaaagatttattccgccaaccaaataatccatcaaataaggagcaaatgtacgtgcaggatttatagaacctccagtaaatggtcctaaaaagataataactgcagttactgtaaaaccaatagataaacctgcaaaattaggagtagcttttttatcaacagcaacacccattattacaagcactaaaaagaaagttccaataaattccgcaaatattgtttgtaaataacttacacccatgccaggagcagttgcacctaaacctccaacaactactgaaggcattcctaaacataaaaatactgctaaacttccgaaacaagctccgattatctgagctacaatataatacacagaatctgctaaagaaatatttttactaagcagcaatccaattgtaactgcaggatttaaatgagctcctgaaattcttccaaaaagatagatacaaaccattacagttaaaccaaatgccagtgcaatagctatccaatctcccaaaccgcctaaaattccaatgcccacattatttggattaactgattctgatatcatcaatgtgataactgcagaacctgttccaaaaaatactaagaaaaatgttccaagcaattcagcaatgaatttttttccaataccgcatggcgccatataacacacctactttatactgcatctttccactgacagaaatcatgtctgaaatcaattaatgaagcagacgcacaattcttacaacctttaactggagatccagcatcttctttattaagagccatgatatttgtcatcatagttgcagttattggttcactggtaagcaaacaaggataatctgccaatctcattaaagaagagaaccttacagaaattgcacatgccggatatgcatacctttgagggttcataatcacttcattttcttcaacagaatttaaattaacttcaaaaccagaaactaatggttttaatatacctgattcagaagctcttccttttctagctttgtctaaaaatccccaacctctgtaaatcatgtccataaagtcacagttgtgcagctctgcagcagcacctcttgttggaaactgctgaacaaaattatggaaacgtttagtcaataaatcaacaatcataactgcattgaaaccgtctaattcaagaatatactcagttgcacatgctgatgaaccagtagcaagtgacaatacatcaaatacgcttttaaaattgtctaaattatctcttaatgatgtttcaataacatctgttgtagcctcaataattcccatcgtcatgtcatccttacacatattgaatgttgactgagaaatatgatgagcaatatcacctacacagtatgcaggaacagttaaaatattaccatagtggacatcatcttccattgctgcaataactgtacttctcatttttttcttataggaattcatatattttcttacatcaaaagaagagtgacctgcattatccataagctggccttgggcttcaattgggtttttatatatgttttgtaacgtagctatttcttcactaactgcttcggcagctgttgaaccgccttccaaagcattagcaaaagcttccccaacaccataagaagtattcataccccatgatttagcagctaaaatagcttgcttatgattttcaggaatatctgtttctaacagtatttgattaacaacattacttgtacttccaggaattaaagcaaaatcaacaacacatgtaggaccataaaaacctccataacgtcttataacttcttttccaattaatgcttcacatgaagctatcttatctataaatttatctaagctatctgaaaaaccagcatcttcttcagttaatatctcaagaaccggaggagtttgataatgctcaacaaaaggatcatcttcaggtataacagtatctgtaagactgcacaatgtatcaaaatgtgttttaacagaatttacatgtaaatcaaacacactttgagcctgattatcaatagcctccatttttgatgctactctaacataaggttctgcatcttttattttaaaatcagtccctcgttttttcttaattgtgtcaatgtcggctctttgagcagccattgattcatcaatcattttctcaaataactctctcattttaacccactccacagaaaagttgaatttaaaataattcaacttatttaatatatgtaatctttataaattataaaattaactgaaaactatatattacatagcaaataatgctatactatgaacaaaatagaaaaactgcaagagattatagatgcttcagacaatattgtattttttggaggtgcaggagtatcaactgaaagtggaattcctgatttcagaagtgaatccggaatttttaaaagcctggaaaaatatggcgatacacctgagagattagtttcacatagctattacttagaacatacggataagttttttagctattataaagactgtttaatttttccagaagcagagcctaatcctgcacattatactctggccagattagaaaaggaagggaaattaaaggcaataattacacaaaatattgatggcctacaccagaaggcaggaagcaaaaacgtattggagcttcacggaattgtttatcgaaattactgtgaaatatgtaaaaaaaaatatgatctgaactttattttagaaagtgaaggtatccctcactgtacctgcggaggaattataaaacctgatgttgttttatacgaagaagcactggatatgaatattttaaataaatcagcccaatacattatgtctgcagatactttaattgttggtggaacatcacttgtcgtatatcctgcagcaggacttataaattatttcaaaggcaaaaatttagttttaattaacaaaagccagacagactacgataatctagctactttagtaattaatgaggctatcagagaaacattagctaaaataaagtagaaagtgcagattttaactacactcacataatatactgcttaacaggttcttgagtaatattagctaataagtcatccagatttataactggctgagttccattttgagaggttgtaactgtaaacatcatatccccatcaaaaaacatgaataatactacactttcattagaattagttgagtttaccatagatatttcataacctgtaacattagaatgggttttttgaatcgcagaagatacatctaaaccaggaatatcttcactgaattcttcagacattaaagaaggaatattagcccattcttcatcaaattcttctttagttacatcaataggaactgcactaatcattatctcccctgttccagtagatgtaaaattatcaaaaaagacatctgttgtatatccctcatcatcataatattcttcatcaacataattttcatcaatacttaccatttccctaatctcatcatcagttaagtttccatacataaaaagttgagttcaacacaaaatcggaaggaatattaaaacaagccccttcaacaatagcagaattatactcttttgattcataatcagaagaattaactaacataattgcagccaatgcaacaattaatattactacaacaattccaagaactataattatatttttcttttccatatatattcaccaaatttttttaaaaaaaataatataaaataatatatctattactgtaaaatatattattttctacttaaatcataatctaaagacttaggaactaattcaataccttcaagagtattattgcatttatagacaagtatttcaacacctgcattttcagcttcaactaaagtttgggaaaacttaggatcattttcccagttaggtctgaaatcattgcctgcaggatgctggattaagaaaaatactacagcacgatttccatcatttttaagcttaattaattcttttaagtgttttgctccccgttcagttggtgcatccggaaatcttgcctcaccgtcaactattaaagttactcccttaacctcaatataacagctgtcaactaaaaactccattccgcagcagtcatcttcctgattagctaagtatatatcaattcttgaatcatcaacctgtttttccctttggtgatatgaataaccctgaagctcttttattttgccatctaatattgcatcatacacaatactattggcttcctgcgagtaaagtgacaccagctcccctttgtttacaacaaaatgaagagtgaatctggtttttcttttcggattatcagaaggtttaagataaactgcagcaccatcaaccaaaagctctttacatcttccggtattaggcacatgagctatttcaatttttccgtcaacttcaacttcagctatgaatctgttaggcctgtttttaaaaatacctttaacataatccatattatcccttaattacctttccgatatgtgcaactacatctgtagctccaaatccataacctttttccagatatgcttcatctcctgcaagaccattaatgaaaatagctaaagtagctgcatcaaatgcattcaaacctttagatagtaatgaagtagctattcccgccaatgcatcacctgttcctccaacagtcattcctggatttccggatttattaagtttaaatttatttttctgaatcaccaaatctattgcacctttaaccacaacagcaccgttaatctgtcttacgacttgctgaaactctgaaatattttcatcaacttcagcaaaatcatagctgtccaaatctaatttaatatctttgccaaaaaatgacttgaactcaaaaatatgaggagttaaaattacatcatccctatttttaataatttgaggtttgacctgttttagagcatctgcatctaaaactaatggttttttaattttactggccaaaatatttaacagttttccggtttcattattgatacctgctccaggacctaataaaacagcatcaaccttttcagctatttccaaaatttctcctgcatgttctgtagttaagtaatctccttttagcgaatttacaatcaaatcaggatgtgttgaaatggccaaagctgcagattccggagctgctacatataccaaatctgctcctgcaccaatagctgcaagtcctgcaatactcggagctcctgaatactctttactgccaccaacaattaaaactttaccgttatttcctttgtgtgattttaaagatcttttattaagtttaatcatgtccccataatttataaagtattctgcttcaatcggaattcctatatcgcaggttacaattcccccaactttttcttcaccagccttgtgaattcctgtttttactttatgaaaacttacagtatactggggtttaactgctacatcatgtatctggccagttaacgggtcaagaccagacggaacatcaacactaattgtcaggccattggaagtgtttataacttcaatagctcttttaatgttttctctcaatttaccattaatgccagttcccaaaattccgtctataatgataaactctgaaaagctgtcactatttgctacttcacagttatcaatatcttcaattgtatttagattatgaactgtcaaatgagaaaagcgaggtttcatgttttcaagtatttcatagttagttttagcttcagctgaatgaattccgtttttatcttttaacatataaatatcaacatcatatcctctgtttaaaagatatcttgctgctacaaaaccgtctcccccatttcctcccgatcctgtgaaaataattattttaacaggttttgaaaatgtataaacagctatttttccaacttcttctgcgagagattttcctgcagattccattaaacaaagtcttgataaacctaaatattcacaatttaaatctgtaacagtcatatctataggatccataaaaatcaccaatcagatatacatttaaaaattgtatttaataattctttttaattttaaaatttaaaaatagaagtagtgcccatataaaaatggacacataaccagttttaaagtgttaaaaggtcagattatggattttaaccaaatacaaaaagtatgtccagctagttaatacctaactgaactctttttgtatcacaaaaaactaacccgagaatttgcatcaatattcataccacatatctgcaaacacagagcatgcaataacaccattacatgctccaaaatatcttatatctcatgttaaatatataatttcacttggatttgaaaacaatatttcaaagtgagagcaatttttaaaaaacgagtaaatattcaagaataagaaaattaaaataaaaaaaatagaaaaaagggataatgcccttagaataaatcttgtaagttgattttgtaagctcctaagtttccaccgaagttaccagcatcgatttctaatactccaggaacattacatgctgcttcaatacctgctttcattgcagcacgtactgattcttcatcaataccatcaataacgatttcaaatacaccattagcatcttctctgatgtcagaatcaactttgtcttttaaagttacacacattttttcgttggtagatgcgtttaagaatttgtaattgttacaacctactttagaacctgaagcaaccatacctccagggaaaggagtgattacaccttcaacagctgaaatagcatcaacagcagcttcagcagccattacaccagccatttgattttcagctaagataaagaagtttccaccagctacaccagctttgaaaccaaaagtagattctactaagaaatcaccagacataattgggatagaatgcatttttctaccgtcgatttctaattcatcttcaaatccgtcaccgaagaattttaatttgaaaccagttttgagttcttcatcagcgtcatcaagaacattgaatgctgcagtagttggtgcagttaaaatacacatacctattctttcaaggagttcgtggtctaattgttttttagatccttgacagagcataattacataacctggccttccgtcaggagtttcagttggtggtacgtaacagtcaatacctgcttctgcaggacatccaataacagaagttccgtatccagtagcttcagtagctgcaattttagctaatcttttagtagctgctgtaactaaaattctagttactttaattccaaaaccttctgcataattatctttaatttctacgccattaatttccatattttcaccaaatattttacaaaaaattaatttttgctatactaaaaaatatagaaagtaaataaaataaagttttctatttaattattccaggctctttcaaaaacttgtgtgatttttttctttttcattgtttaaattccaataatttagttttagcatgaatctggctagaagtccttgttctattttcattgttctttttatgtgttttgggaatactttttggaagatattttcgattttattgtttgttgatgggatgttcgtgttttccaggtgtgtcgttaattttttgaagtaaggaatgatgaatttccaaagaattttgtttgtgaacttgttttttgtatattttttgtttattaattcgtttctaagttctttagcagtatttaagtcttttgcatccaatattttataaatgtcctgttttaaacaatttaatatgtctttttcgtcttcagataatggatttttgtcaaagtaatctttaaatcttttgtttactgcttgtttcacgtgaaatttgcagaaatggtgttttacttttaatttatcgatggcttcacgatattcgtgttttaagtctgtgcctattgatatttttttctgatttcttagagattcgtttaaaaattgataaatggtcttagaatcttctgattcgaccaatttgacggaaacgatagtattcaatttaacgtcgaataaggctaaaatatagttccattcaccattaattttaacccaaagactatcaaataagtaatatccagaataagtccaattatcatagttaaattgataattagagttcaataagatgttttcaatgctttgatgtgagatttcaatgttatgttgttgttttaaatcaaatcgtattttatggagccctgctccataaatttgatataaattctcaatacattcaataacaggcaatgtaatatttgaattagaataaacaagagataataaatcagtataaaagactttaccgcattttatgcacttatatttttgaatagtgcaaatttgttctccaattcttaaaaaaataagtttacgttcataagtaccatttttaacagcattatgtgatttacaagatggacaaattgcaactctattctcaaaatgtattttacctcttttttccaatctgataagattattctcaatattttcgcaaccaaatcgagaaagatcatcaaattgacggaattcagaaaactcaggaacaaaatcgaaaagtttaaattgttttgactccataaattcatatggagcttttattttgatactagacatattaatatattagctccacttaatatattaattttactgcttttaaattaaaaataaagaaaaaatagaacgaaaaaaattcgtgactcaaaaactagtgaaaattcaaatcacacaagtttttgaaagtgacttattccagcagttcatcatcagattcatcatcggattttgaacttaatgaaattttatcaagaactgaagagccataatgaggtaaaatcagcataccaattacagtagctaaccagaatgaaattaacctttcaataacagtggcagctgcacttaatgaagcagatattcctgctgttgagtaaaataaaatcattactccatctacagctccaagtccaccaggtaacagtggaatcatacctattaatgatgccataataaatacttcaccaataataatcggacttacatgagctccaaatgctaaaaacacaacataaacccttaaaatctcaaatatccatatgataaatgacaaaggcagagcataatgcaaaatccttttatcagaaattacaagtttcattgtatcctggaacccgccaattacagtgtgtaccttttgttccaattcatctgaatttttcttataaaatcttctaattaatccaataatccaattatcaacctttttaccgaattttggatttacagacatatatataagtaaaattaaacaagccacaatagctattactgcaacaatcatcaatattaaaatccataaatccagcttaaagtagaaagtgattccaataattgtcaaaatagccaagaaaacaaatggaaaagtgtctaaagctttatcagctacaacagttgcaaaggtctcttccatcggatatcctttatctctggacaggatatatgcccttacaggttctccaccacctcttccagcaggagtaatattatttgtagctaaaccaaccataacaataggaaataattccttaatagatatttcaataccatccatcttgttaatgatttgccaacgcaaagtgtataaataataagtaaaaacctgaattaaaacagctaatgcaatgaaccacaaattagctatttttaaagctcctaatatatcacctatccctacaaaccagagcatgactcccaaaataagaaaactgataaatagaaatattaatgatttatgtttcatgatttcacacaactaatatagaatatacttattttagatttgctagttaatatttatatagctatttattcaaaaacataaaatgatgaaatatataactaaaacagatctttgcatagttacaagatattccggagtagtgatgatttgtgtgggattaatgtgcttatccccattacttatcgatttaatctatttcgaatttaactatagctgttttattattcctggagttttttcagttattttaggatacatatgtatgaaaactcttgacaaatactcccgcagcaagatgaaactgaaacacggaatgatgatttcatcaattgcctggatgtgggcatgtattgttggaggagtcgtaatctcacttgcaacaggaactgattttttaaacggtatttttgaaagtacctcagcattaacaggtaccggaataacaatgtttgataatgttgaaatattgccccacagcatattattttttagagcatttgaacaatgggttggaggattaggagtggtagttatggtaatcggtgttttaacaagaccaggtacagcaactgccaaattataccaatctgaagcccgtgaagaacgcctgaaaccaagtgttaaaaccacacttaaaaaaaccattgaaatttacctgatttataccatagttggaattatactatatcatttagccggaatgccgacttttgattctatttgtaataccttttgtatgattgcaaccggcggaatgagtgttaaaaatgcaaatatcggatattatcacaatgacctgatttatcttatttcaattgtattgatgattttaggagctacaagctttttagcacattataaaattatcaaaacaaaaggaaaatcattaattcaggatttacaatttaaaacattaatctgtataatcacttttgttacaataattctttatctagcatctcatattgtgccgattgaccttttatttacagttacctcatcaattaccacaacaggagctaatgtccaactggcttccaccatggcaggatggccatcatttatattagttatcctgatgattttgatgttaatgggtggttctagcggatctaccgtaggtgcaattaaactttacagagtaataacttatgttaaagctatttacagacacataaaagaaatcctttcaccagacggcagagtaatccctattaaaatatctggaagaagagtgtccgaaaaagaaataggaaaaaccgggaactttataacattataccttgtcatcattgcaataacctggattatattttgtttttatggatatccaccattcgacagtttatttagtataatatccctccaaggaaacaacggattggatattggagtattgaacaatactcttaatcctgttttaaaaatagtatctgttttaaacatgtgggtaggaagactggaaatttatcctgtgctggtcctattcagagctatttttgaaatatttaaaaaatgaaaatatttataatattcaaaaataaatttaatgtattacaaagagggagaattgaaatgtatattataataatgggtggaggtcgtgtaggccttaaccttgcaaatttattaatagaagatggacacgacatcactttaattgaaagtgacgaatcattatgctcagaagtagctgcagaacttgatgcacttgtaatatgtggaaatggaactagttcaaaattattagaagaaaccaatattgaagatgcagactttttcatagctacaactggaaatgatgaagcaaacctattatcctgtattttagttaaaaaatataatgttccaacaattattgccagagtaagtaatcctgaccacgaagaagcgtttatggaagtcggaatagacaatgtaatcagtccggaagttacagctgcaggacttttagaaaaacttgtaacaagacctaatgttgcagacctaattacacttggcgaaggagatgctgaaatcttcgatatgaccataaccaatgacaaggttgttggaaagaaaatgggggaaatatcaccaacaaaagattacattataattgccacatatcaaaaaggcaaactggtaataccacaaacagatagcgttataaggcgaggcgaaaaagttactgttcttgtaaaaagaggagcatttaaaaaagtagctaaaaaattagaaaaataatttaaaaaagagaataagacatttcaatactctttttcccattattgtcaatcatcccatgaccaggatagattgttttaacatctaattttttcagtttttctacagattttttcaaatcagaaaaactgcctccaatgtcagttctgccaacaccaccatgaccaaatactgtatctccactaattagattttcaccatcccacaaacagatagctcctttagaatgacctggagtatgaataacttcaaaatcctttattttatccccttcttccaattcaatatccactttatggcatttaatttcatggccaaaatgactggctacagtatcaggattatcatcttccattaaagcgattgcatcaattttatgaatagctattttagcattagggaaaaaacaattaccattaacatgatcaaaatgacagtgtgtgttaacaattaatttaatatcttcaggattgacatcatgttctttaagtttagaaaaaaggtattctttattatctccggctccagtatcaactaacatatcatcaatcagataacagttagaatctaaattataacctggaatccatataatatctttagaattcataaaaatagtattgaaattataatatttaaaaatagttttttataaaaatggggtcacagggatttgaaccccgatcctgggatgtctcttgcctcagtactccaattgatcatcacaacggatactgctcagttacgcgtatattttcttcaaagacaactggagtcccagatgatgccaggttacactataaccccaacagatatgtcataataacatactattattaatatgatttaattactatataaatgttattatcaaaatttcatttgcctatcaatgccggtaatttcatcaatttccaaagctttttctagggcaaaatctttttcaattttataattatcgcttttggtacgtggagttttttcaggttctaaaaataaccattttgtgtacttaaatttaactccaatatatggtttagcaccgaatttttcagaaaactcacataatgcatcaatttgaggaaaatctatgtaaattttatctttagttgtagttttaacttcaatagctaaatataatttaccgtttcctgctacaacatcaggtaaaggttttttagttgcacctccagaagctggagctctcatagctgcaaaatctctttcccaaagtttatgcactaaatctctttcttcagcagacccttttttagccatagaaataatctcataaaaaatagtttttaataatggggccggggccgagatttgaacccgagtcacaggatccacagtcccgtaggatgaccgcctaccctaccccggcataagaaataaataaaaaattgttagaatgcgggagcagggatttgaaccctggtagacctgcgtcaacaggtcctaagcctgtcccctttggcctctcgggcacccccgcttatacaaaaagaaaggatacatagaaaccattaaaaatcttaacaagtttttaaatgctccggccgggattcgaacccgagtcttcggctcgaaaggccgaaatgattggccggactacaccaccggagcaacaaatgacataatttaattgaaatgggcccaatggggttcgaacccatggccttccggttatgagccggacgctctacctggctaagctatgggcccaaaagcgccatcgacagggctcgaacctgtgaccaatcggttaacagccgaacgctctacctactgagctacgatggcatgtgagtacccaccagtcttaaccaaataaacccattcaaatcaaaagacttcaaacagtattaattagtttgattttcatactatataaatgttttgattaaattacatctaaataaaattagaagcaaactataatatagtttggataaactaatatataactttaactattaatattaaaacaaacaataaagaataatgattaaaatggattctgacatatttgatttaataaaaaaggcaaatgaaaccacactaaaaaaacatggtaatgaaattagtcttgaaagagcaatattcctttcctggtggtgcgataaaggagactgtgctttttgttacatgtctactcaaaaagataaaattaaagaccccactaaagctagacgtaatgtacacaatatatatgctgaagcagaaatgtgtaaacgcctaaattggaatattgaattcctttcaggcggttacaagtcatttacaactgcagaaattaaagaaatagcaaccaccatcaaaaacatcactggagacagtgtttggttaaatacaggaattacagacgagttagaagaatatggttcagaaataaaaggaattaccggagctgttgaagtagctaatcctgaattacatcaaaaagtatgtccaagtaaatcattagataaaataagcaatatgttagatgtagctggagatttgggattccaaaaagctattacggtgattttaggccttggagaaacattagatgatgttgattatttaattgattatattaaagatcacaaaattgacagagtaatattctactcattaaactcacataaagaaaccgcatatgcaaacagctcacagccagcttcactttattatgcccaggtagtgtctaaaatcagattaacatttccggacattacaataatatgcggaacatggattgataatctggccaacataggtattcttattttaagcggagccaatggaataaccaaattcccattatttaaaatgtttggaacaaaatatggaaaaagagtggaagaagaagttaaatggtccggacgtcaacttaaaggaacattcactgacaaaaaacaacttggaaatccggaaagcaatgttgatccagaactaaataaatttattaaaagatatataaaggaatctttaaaaaacaaatattaaatttccaatgtattagattttgttttaaatgaaactccattagccctataagttaaagaagcaccaccaaatgtaattttatccggaattactgcatcatcaccaaaatccatttttaaactttcatcagacggaagttctacatcaaaaataattgatttgacctcaccatcttcaaagtttccaaaatcatgagtataacactgggatagtgccaatgcattttctattaatcccctagtattgttttcaaccatccactcaatagttactttattgtcattatcttttgacactaatttttgtgtaaataaaacttcatcagacataaaaatcacaaatatttattaatctattattataaatacttatataatataaatctattttgattttccaaaaaattggaggaattattattagtgtcaatatgatgtgtggacttgaaatccacgtacaattagaaactgaatcaaaattattttgtgattgtccaacaaattataaggaagcaccagcaaactcaaacatctgtccagtttgtttaaatcaaccaggtgctaaaccatatccaacaaatgaaaaagcaattgaaaatgcattaatgatttctttaatgcttaactgtaaaatcgataaaggtttcacctacttcatgagaaaacattacgattatcctgatttgccttcaggataccaaagaacttcagtacctatcggttacgaaggagaactaaatggagtcagaatcagagaaatccatatggaagaagaccctggccaatacaaacctgacagaggtactgttgattttaaccgttccggaattcctttaattgagattgttacagaaccggatataaaatctcctgaagaagcaagaaccttcttaaaagagctcatccgtgtattgcaatatagtggaggagctcgtggagaaggtactatgagagctgatgtaaacatctctattgaaggtggaaacagagtagaaatgaaaaacatcaactccattaaaggagcttacaaagcattgaaatttgaacttgttagacagaaaaaccttatgaaaagaggagttgaaatcaaacaagaaacacgtgcataccttgaatctcagatgattactgtaggtatgaggttaaaagaagatgctgatgattacagattcattccagatcctgatttgccaccaatggaaatctccgatgctcaaattgaaaatgttttagaaataatgcctgaagcaccgcacaataaagtaagaagatttactgaagaatatggaattgatgcagaatctgctaaagtgttaacttcagaacttgacctggctatagcttatgaagcagtagctaaacaagtggatcctaaatttgcttcaatgtggatgagagatgaacttaaaagagtattatcctataacaaacttgattttgcagatagcggaatattagttgaagatattgtagaacttttagaaatgcttcaaaataaagaaataaccaccaaagcaggtcaaagaatcattgaacatatgccaaacaataaacaaactccaaaagcaatagctgaagaattaggtttgcttggtgttgtaaaagatgatgaagtgatagctgcagtaaaacaggctatcgaagaaaatccaaaagctgtaaatgattacttggaaggacaaaaatcttcacttaatttccttgtcggccaagttatgagattaacaagaggaaaagcagaccctggagaaactgttaaaatcttaaaagaaaacatagaataaaatcggagggaaactatggctaaaagtaaatcgttggtcaaagattatatgactaaaaatgttgttacagtatcaccacaaacaacaacagaagaagttattaaattaatgaaagaaagcgatcacaatagctatccagtagtagaaaataacaaactagtgggaatggtaacctcttttgatattgtagtaaaagactgggcagaccatgtctcagaaataatgagtacaaaattagtagtagctaatgaaaacttaagtataaatgatgcttccagagttatgttcagaagaggcatctcacgaatgccagtcataaacgaaaacggcgaaattgtaggaattattacaaacacagatatggttcgttcacatattgaacgttccaccccaaataaagtagattactttaaaagtactatggaccaattatatggcattaaaagtactttaaaacatatgcaagttgacactgataaaataaggcctactcaagacagagtttatgctgacgaacttgaaggaagaacatatgagcttaaaatgggattagctgaacctgcaattgttgttaaaactggagacaggtggatattggtagatggacatcacagaacagtagctgcaaaacaattaggctgcaaaacaatcgatgcatatgttattgatttaggcaaagatatccgcttaggattggaaaaaacagcagataaagcaggaataaaaacattcaatgatattgaaattattgatgatgataaacatccattaatagctattacagaaagtatacaagacaacgagaaaagtgattaaatggcatcagaggaaattattagagaagtttataaagttttagaagaaagaagggacaatcctattgattcctacacctctaaaataatgcaggacagtgacaaaaaagcagaagataaaatacttgaaaaagtagcagaagaatgtggtgaagtattgcttgctgctaaaaatgatgagaatttagtttatgaatctgttgatttaatattccacactttacttatccttgtttacaaaggaatagaaatagatgaaatttttgaagaatttgcacgtagaagacattgaacttataatttaagttccatattatgcattccgcgttcaaaacttcctattttaactctttttttattgaattctttaaatcctattctttcatataatgatttggctcctgtgtttctgaaatcggcatcaagagttactctttttagattattccatttagcatatccaattacatcatccaaaactttactgcccaaaccttttcccctttgggattcatcaatagctaattctgcaacatgaaaatctcctttctccacatcgcataatacaaaatagtctaaaatatcaacaataagcaattttaaactgaccgtctttaaactatgataaaatgcaggttttttagaaatccagaatatcagcaaaccaataatattattatcatcatctaaaataactttggtatcctcaagagattcctctttttttaattgcttttcaattgttgaaatagctttatcagaattcttaaacagcaagtcaaatgttctaaaatcaacgtcatagattaatttagccacttttctagtgtcatgtttggatgcatcaaatgtttcataaatcaatttatcgacctttaattatagttagagcaaatactcctgcaccgaacccgttatcaatgtttacaacagctatccccggagcgcatgactgaagcattgcgtttaaagcaacaactcccccttcacctacaccataacctacagatgttggaacgccaataacaggaatatcaactaaaccagctacaacagaaggcagggccccttccattcctgcacaaacaattaatacttccactccctctttaatcatgtgagctatttgagggaacagtctatgaattccagctacgccaatatcataagaagttattgcttcacagcccccttcttcaactattacacgtgcttcttctgcaatatttatatctgatgttcccgcagttatgatacccaccttacctaaggttttaggaacttccctgtttctgattaccaatatctgagctcttttattatagtccaattcaaatccttccaaatccaaatcatctgctaatttttcatatctttctgaagataacttggttacaattagattttcgggattttcactggtgaaataattattgattatcaataaaagatccccgtaatctttacttggagaaaaaaccgcttctggaaaacctgttcttgaagagcgtgatttgtcaaatttagcaacttcatcaaattctaaaatagtatctgcctttaaaagcctctcgcattcctcaatactaatttcttcattgattaacttttcaagaatttctctcatattatcataactattttatacaataattatatttaaatatatattgactatgatggcaaaaaagattttaactcagggaattgttcagggtgtaggattcagaccttatatttacagacttgcaaaagatttgaatttaaacggatatgtaagaaatttaggaaatgtagttgaaataatccttgagggagacaatattgacttatttattgacagactgcctaaagaattgcccccgatagctaaaatagattctatgaaaaccgaagacatagccagagagggttttgacgattttacaataattgaaagttccgatgagttttcaggagtatctgtaatacctccggacatagctatctgcgacagctgtcttgaagaaattagaaatccaaaagacagacgttataagtatccctttaatgcatgtactgactgcggcccaagatttactgttattgacagtgttccttatgacagagtcagaacttcaatggatgaatttccattgtgcgacagctgtcttgaagaatatggagaacctctaaacagacgttaccatggtgaagccatatgctgcagtgattgcggacctcaaatgaaaatatacaaaggtccggaagaaataaatagcaacaatcctattaaagtagctgcagataaactaaaggaaggtaaaatcatagccattaaaggaataggcggaacacacttagtagttgatgcatataatgacaaagccgtcaaagagttaagaaaacgattaaaccgtccaaatcaggcttttgcagttatgagtaaagatctagacagtgttaaaggttatgccaaattaagtaaaaaagaaattgcaaccataacctccaacaaaagacccattgttgttttaaagaaaaatgacaattacaatttcccagagtcattagctccaggtttgcacaatatcggagtcatgctgccttactctccaatgcattacctgctttttgatgaaggagacatcgacacatatgttatgacttcagccaatactcctggcgaacctatgatgattacaaataaagaaattctaaatttaaatggaatttctgattattccctaatccataaccgtaaaattttaaacagatgcgatgattcagttatccgatttagaaacgatacactttcatttattcgcagatcaagaggctacactccagaaccatataaaatcaattatgatgtaaatgatttgaatgtacttgccttaggacctgaacttgatgttacctttgcaatggctaaagaccatatgatttatacttcacagcatattggaaataccaacaaattaaaaactttaaaattcatgaaagaagctattgaaaatatgaaaagaatcactaaaataaactattttgatgcaattgcatgtgatttgcaccctcatttctttacaacaaaactagctcatgaatttagtgatgaatttgaatgtgatgtaataggtgtgcagcaccatcatgcccatagtattgcactggctaatgattatggtatcgatgaaatgattgtaatagcatgtgacggagtaggctatggaagtgatgctacaagctggggaggagaaatcctatacaccaacattactgactttgaaagattaggtcatctgcaggcccataaaatgcccggaggagatatggccaccaaacatcctataagaatgcttttaagtattatagatgatgaagatctaattagcaaatatgttgattatttcaaatacggtgacactgaaattaaaaatatttacagacaattggaagccggaattaatgttggccttacaacaagtaccggaagagtattggactctgtttcagcagctctggaaatatgcaacaccagaacatatgaaggagaatgttcaatgaaattggaatctgttgcatattactccaaaaatgacattgaaattccatttgaaattaaagacaacatattaaacacccgtgaaatccttcgtgaagttgtcagactatatcaaaaaggagaaaataaatcagatattgcaaatgccgctcaaaagacaatagcaaaaggactgtcccagatagctattgaaaatgcagataaaaaaggagtcaatgttattggagctacaggaggagtattctacaacgaagcaataaccgatacctgtaaaaagtacattgaagaaaacggatacaatttcatccagcataaaaatacctgtgccggagacggttctgtttcactaggccaggccattgtagctaaaacaaaacttaattaaaaaaataaaaaaaagaatagatacaaacaacagctaatttatttatttttaagagttcgttccaaaatatattccgctctgtttttaagattttcatataatcttatttgattcataagttctgaaatagcttctgtttgaccattatcaattcttttttcaatatccaataatttagaccactcatcaccagaaggcaattgtggtgtattcagcatatcctcattgaagtttacattgaatgtattcttattaatagtaatatgaatattaacttcatgatctaaatcataatatttacgcggtctacctctaagaatctttttatatgaagaacttaatattccaatgttttccatagccctcaggtgttctataattgctttttgaccaatattgagttcattggaaatttcacttacaaacattggttcttcccttaagagatttatgatatcccttcttgttttacagcccattacatcaagtatatcctctttgtcaatcccataatctgaatcttcataattaccatttatttcaatgattgatacagtatttggatgtggattgacatttttagatttgtccttatttttttcaaattcgtttgtatctttcataaatataaattataccgaaacctttatataactttttgttactataataacatacgagaaagataactttttgttactttaatatttggtacaaaaaactcttattaataacccttgttttttgaaccattttcctatatgtccataaattccaaaatatgccaatattaagtatcaaaaataaaaattctctacacaagggttatttaaagagttttaaaaatttgaaaaggtgactgaatggctaatgacaaaaatgaagaccaaaaagaagaagaaactaaaactcttcaggaaaaatatgatgaacttcttgaagaattagattctaaaaataaagaattagctaaaataaatgaagaccttgaaaaacaaaaagaagaaactcaagagtatatttcactatctcaaagacttcaggctgatttcgaaaacttcaaaaaaatcaacgagaaaaaaagtaaagatatcatcaaatttgccaatgaaccacttatcaaaaatatcttagacagttatgaagatttagaaagagcacttgaaaattctaaaactgaaaaagaattaagagacggtgttgaattaatatattctaaaattaaagatgttttaactaaagaaggtttagaagaaatccctgcaaaaggggaaaaattcgatccatttaaacatgaagcacttatggttgcaaatgatgaaaatgtggaaaatggatatattattgatgaactgatgaaaggatataccttaaaaggtaaagttatcaaatactctaaagttagagtctgtaaaaaataatgtttattaaattattatacaatcaaaaaataaaggtgattaattatgtctgatactaaaaaagaaaaaattataggtattgatttaggaacaagtaactctgcagcatctgtacttgttggaggtaaaccaactgtagtaccatctgcagaaggtgcaagccaatacggtaaagcattcccaagttatgttgcatttactgatgacggtcaaatgttagtaggagaacctgctagaagacaagctgtaaccaacccggaaaacactatcagtgcaatcaaaagaagtatgggaactgattacaaagttacaatccacggcaaacaatattcaccacaagaaatctctgcattcatcttgcaaaaaattaaaaaagatgcagaatctttcttagatgaaaaagttgaaaaagctgttattaccgtacctgcttactttgacgacaaccaaaggactgcaacaaaagatgctggaactattgcaggattagatgttgtaagacttgtaaacgaacctaccgctgcaagtttagcttatggtatcgataaacaggaagatgatgatgtaaatatcatggtatacgatttaggtggaggtaccttagatgtaaccatcatggaattcggtggaggaatatttgaagtaaaatccactagtggggacacccagttaggtggtaccgatatggataatgttcttttaaaatacttatctgatgaattcgaaaaagaaaacggaattaaccttatggatgatgatcaagctgtacaaaggttaagagaagctgctgaaaaagcaaaaatcgaattatccactaccttaactactgaagtaaacttaccattcattacaatgggtaaagacggatctcctaaaaacttaatcgtaagtcttacaagagctaaattagaagaattagtagatgacattgttaaaaaatccggaaaaccaatgcaacaagcattagatgatgctaaaatgagcaaatccgacattgataaaatcattcttgttggtggacctaccagaatgccaattgtacaaaaatatgtagaaaaattcatcggcaaaacaatcgaacgtggtattgaccctatggaatgtgtatcaatgggagcagctatccaaggtggagtattagctggagaaattaaagatttagttcttttagacgtaactccattatcattaggtattgaaaccttaggtggagtatcaaccactttaattgaaaggaacacaacaatccctaccaaaaaaagccaaatcttctctacagctgcagacaaccaaccatctgtagatattaatgttcttcaaggagaaaggaaaatggctgcagacaacacctcacttggaagattccaacttgtaggtatcccacctgcaccaagaggagttcctcaaattgaagttacctttgatattgatgcaaacggtataatcaatgtatctgcaaaagacaaaggtacaggtaaagaacaagctattacaattacttcttcaaccaaattatctgacgaagaaatcgaacaaaaaattaaagaagctgaaatgaatgctgaagcagataaacaaaaacaagaagaaattgaagttagaaacaatgcagattccttaatttacacatccgaaaaagctttagaagaattaaaagacaaagtaagtgacgatgaaaaagaaaaagttgaaaaacttgttggtgaattaagagatcttgtagctggcgatgacattgctgctattaaagaaaaatctgatgaattatctgaagtagttcaaggaattagtgctaaaatctatcaagaagcacaagctcaagctcaagcacaacaacaagctgacccaaatgcaggtgctcaatctaattcctcagatgatgatgacggcacaatcgatgcagattacgaagtaaaagatgattagattaaataataattgttttattatttccaagtaggttagataaaaatcagaatcaataaaaaaactagctatcaggaaaaacataaaacaaattatttattctattttcttattttttttaaataatacttataaggtgactaaatggcagaaaagcgagattattatgaagttcttggagttgacaaaaacgcttcagaaaaggacatcaaaaaagcttatcgtaaactagctatgaaataccatccagacgtaagtgaggaagagggagctgaagaaaaatttaaagaagtaagtgaagcttatgccgtcttatctgatgatgaaaaacgtcaaagatatgatcaatttggtcatgctggtatggatggatttagtgcagaagatttctatcaaaatgtaaacttcgaggacatattccagggcttcgacataggaaacatatttgatatgttcggatttggaggaggttcaaacagaaggggcagacaagcaggacctcaaagaggatcagacatatacaccgaagtcaaaataaccttagaagaagcttttaatggtgtagaaaaagaagttaaaatacgaagaagtaaaatctgtccaacatgtaacggaaataaatcaaaacctggtgttgaaccaaaaacctgtccaacatgtaacggaacaggacaagtaaaacaggtaagtaacacaatacttggtcaaatgatgaatgtaagaccttgtagggactgtggcggtacaggtaaaatcattactgacccatgtgaagaatgtcatggaaaaggtaatgttagggaaagtaaaactattaaaattgaaattcctgcaggtgttgatgaaggtgaccgtttaagagtatctggcgaaggtaactgtggagaccaacctggatacgaaggagatcttatagctagtgttcacattagcagaaataaagaattccaacgtgaaggagaccacctttactacgaacagcaaataagtttcccacaggcagcactgggagatgtaattcaaatcccaactattgaagggaaaactgttgaatttaaagtaactcccggaactcaaagtggaactgtatttaaacttaaagatcaaggaatgacttcagtaagacataaaggtagaggaaatctctatgttactgtaaaagttgttgttcctaaaaaattaaaccacaaacagaaaaaattattaaaagaatttgacgaaataagtggaaatgaaatccaccacgttgaaaaaggactttttgacaaagtcaaagaagttatcaatagttagttaattaattttaactaattatcacctctcttttttcctacaaaattattgaatttgtaatcaattaaataataatttaaactacttttttaaaaatttataatgatgatttgattataatactagctattataaaaaactagatatttaaattaaataatgtatatgtaaaaaaagaaaaaagtaagagaattatgaattctctttaaggactgatttttattgtgtttccagtttggaaatcgttccagtaggaagttataatgtattccccgctcattaatctgattcctaagcttgcaataccgtctttattagtaactttgtgatagaagacaccgtttacgttaaatgatacgttttggttagctaatggtttaccttgaccgtctaaagttaaagcagtaaagttactgccgtctaaatgtttcatatttaaatccttagttactaaagttggcaagacactgactctgtttccaatatccaatccgtcatacattgttgtaatagtgtaatttcctggtcttaaagcaattcctaagcttgcaacaccatttttatcagtagttttagtatagaatactccgttgatgttaaaggttacattcttgtttactgctaaagatccgtctttgttgtagacagttgcttcaaatctggaagcatttaagtagtatttggttaaatcgttttgcatgattaatgattttacagttatgttaaatcctttttcttcaccggttaacgggttgtaagctgttaaaatgtaatttccaggtcttaacataatacctaaatcagctaccccgtctttatcagtctttttggtgtagaaaacaccatgaatgttaaatttaacttcaatgttagccagtgcttttcctgtactgtcagtaaacttagcatagaatctggtagcattctgatacattttaactaaatctttacttataatagtcggattaatagttacagtaatattcttacttattttattatacatatctgagccattatatgaaacagtagcctgataaacattagatactaagttaagtcccattgaagcagtaccattagcatcagttgttttagcataagtttgaccattaatagtaaagtacacagtagcattagctataggattgcctaaataatcagttaaaacagcaaccattctggtaccgtctttgtaaatcatcacaatgtcagaaatgtttaaattaacttttttattaatatctacagtgaaattagtcctgattacctgtttatcataattactgtctccaggataagtaacagtcacattatagtttcctgcagttaaatctttaatggttaattttgcagatccattaacaagaactatattataaacatttttatccacagttacagtaatgttttctttaagatctttaggaccattaacagtaattacaacatcttcaccagctacacccgcatcaatatctacttttaaagagtctttagctttattaacagttaaagtagatgaatttgtagttggaacaataacttttgagtcatcgacagagtaaactaaagtgtattttccagcatttaattgtccaatgacaaaactagctacaccattttcatcagtaaccatgtaataagttttaccattaactttcaaggttacatttatattagataataaattgcctttagtatcccttaaagtagcattagctattataacttcaccataatcaagagaaatatctttaacatcaataattccttttcctaaagaagcaccaccattataagttacactctgaccgtcaacagtagcagaaatagtataattaccttcttttgcttcaaaaccattaacaacattattagctattgtacccttagtcatgcttaaagtagcatttgctgcagacatgttgaagttacgtactggtaaagaaccattataatcagtaaaattggttccattaaatactttgaaagctaaaacagcatcctgcaataaacctgttttgttggtaacatctaaagttaaaaccaaataattatctggagtagcaatctctttacttaattcagttattacactattatatccagatgaaagacgtataactgcattgtaataagttgcattattgcttccccaccaattattatctaaattaagagttatattaacaccattaactttaccaacttttacatcaccataaataacagaatttttaattataatagcatcatttatagttgaggaagtaacctccactaaatattcaacattatcaaaaatacatccgtcaaatattcttgtagagttaattttttcataaaatatatttacagatagcaaattggaaaatgttgaattatatacataaatatctttaggagtttgacttctacctcccccaacagtattccaactgttaaatccgccaaatacataagatcccatagtagatgatccatttccgtcaacagttacattattaaagactattttttcagaacttccaaaaccaagacaggttacagatctatctccctgatagatattacttgaattaacaagttccaaaggagtttttccagttactgaaattttagtgttttcaagagttatattaccaatttgacctacattaaaagaagcaataaccctataatctatgttcaaagaagaagcagatatactgtcaataatctgagaattattcatgtataaattaccctgatttgcaattgttgaagctctagttgcatgatttgctacaaaagttgtattatcaattgttaaataaccatcattgtaaattgctccaccagcatatgcattttgacgttttactgggtctgcatgaccattattaaagaaatatgaatttttaatagttagaatacctgcagagttaatagctccaccataattaccttttccattaataaattccactgtatcaatcagtacatgaacatttttctcaacatataatgcagattgtgtatcttttccaactctattaatagtcatattagctattttaagagaacctttaccttgtaaagctgtgataaagtatttggcatcaggattaaaaattattgttttgttttctccatcaccaacaattgaaatatccgtatttacctgaatatccaaatcagcattaagatttccagtataagtaccttccaatacatgaacagtaactgtcctagatttagattgagcatattctaatgcatttttaatggttttaaacggtttagctaaagatccatctgcagtactgtcattacctttagcatcagacacataaactgtgatattatctaaaatagtattaattttaacagttatagttccatttttatatatgtaatttttaccatttgcatcataagttccgcttaaactatatttaccgtcttcaaatccgacataattataagtagctatgccattaactacatcagcaattcctgcataatttccatcaattaaaaatgtaacagtgtttccactaataactgctccactaggatgtgttacttgtgcagttaatttacctgctaattctgcaacatttaaatcattgaaagtaattgtaagtccagttacatttgcaacaccattattagcaacaggtgtggaaatataaatatccttaccttcaggagcattattattttcaaataaagaatcattagaaatagttaaatctggaatattgctggttttaccatttgttacagaaaataaataaatagctccacccatagtgttagcagtgttatctttaaaagtaacattgttaaaggtagctcctgaaacagtagctgctccaccattagctccggagttatttataaatttgacattttcaaaagttgcaacaggaacaaaactgctactacttatgtaagcatatacagcaccaccatcaccagcagcacggttgtttataaaagtatcatttataaatattgtttttgcaccaccagatacataaacagctccaccattagttccagcataatttgaatcataaatattatttatacttataatattttgggcataaacagctccaccttcagcattgctatttttaggattagtattatttatgaatttagaattagtaacagttaaattgttagttcctcttataactccaccaagagtagcacctacattatctgcaaaataggaattgtttattgttgcataacctaaccacatatttcctttattgttaatataagttaaattattaaatactaattttgagttttgagtatctatatcatataataaattactattagatgtggaatttttaataatacaatcattcatagttaatgaagatccgtaaattattccccaattccaattaacattagttgcttttccattagtaaatgttaaattagtaagagatacatctaatcctttatcaaaatagaagaaataatctttatcctgaccatcaataattgttttaccataattttcaccaattaaatttaaaacagctattctattatattttaaattaacattgccagtacctaaataagtaccatccataatatgaatagtaatgttgattgatttatctaatcctgcagttattgcatgattaattgtgttgaacggattatttttacttccgtcaccagttgtatcattaccctttgtagaaacccagaattccgcaggggttctgtcaatattgacagttaatgtagctggattgaaagtattattttctccattataattaccgtttatttcatgtttaccattgtcaaataatttggaaacagaaactgatgcaaaaccattatctgaaccactttcacctactttcataccatctatattaaattcaatatttctaagagaagcaatagtatttcctgcatcatcagttatagttgcacttaaagtaaaagtagttttatcagtgaatacattattaaatgtaataacagcattcataaaaccattattataaattaatcccattttagaagaagaatttacaaatttattttgttttaatatattattcccttctatatatattactccatattgagcccaataaccagtctctgtattggaattagtacaattaataaatacattattcattatttgaccattaccgctggaaatttgaagagccgcatcattgtaattaccaacaatatctttaaaagtatttccagttattttagcatttttagaattggatatgtatacagatgctccgcaggaatatcctgtattagtagcattgtaaaaagaagaattatctatataaacattacctttattgttattaaaacaaatgtcaggaccctgatttgaagccttgttgtttttaaatacagaattagttacttttaaatccatacctttagaaacaatagctccttgggaaccagttgcataattattttcaaatacacaattatcaacagttaagttacctccacaattaatcatacttccagtactagcttttccattaatgaaagaaatgtttatcaaagttaaagcagtatctccactaacagatttaagaaatgaacttacactttcaccatcaataaatgttttatcattcccctgaccaataatagttaaagaaccgccatatttttcatgagctaaactaatacttaaatcagtattattatctccagtgaatgttcctttacttaaataaataacagcattatcagaagcattaacacttgaaatacctttatttattgtagcataaggactattttgactaccagtatttgaatcatccccagtagtattcacataaatcgttttatcataacttatcccatcatctaaaacatgggatgaagcactatcaactgctaacacatcagcagatgaatcttcttgtgcactaactgcaccaagagttaaaatagctagtaataacatactaaccaacatcattttatttaatttcataaaatttcaccaaaaaaatttaaaattatacttaaaaaatatcaagcataattaaaatataagtatatttaaaataatatttaaaatttattaaaataaattgcttttgaaatatgttaaaaaaagaaaaaaaagtaagagaattatgaattctctttaaggacttatttttattgtgtttcctgtttggaagtcattccagtaggaagttatgatgtattcgccactcattaatctgattcctaagcttgcaataccgtctttattagtaactttgtgatagaaaacaccatttacgttaaatgatacattttggttagctaatggcttaccttgaccatctaaagttaaagcagtaaaattgctgccgtctaagtgtttcatggagagatcttttgttactaaagttggcatgacagtgactttgtttccaatgtctaatccatcatacattgttgtaatgatatagtttcctggtcttaaagctattcctaagcttgcaacaccgtttttatcagtggttttagtgtagaatacaccgttgatgttaaaggttacattcttgtttactgctaaagatccgtctttattgtagacagttgcttcaaatctggaagcatttaagtaatatttggttaagtcattttgcatgattaatgattttacggttatgttaaatcctttttcttcaccggttaacgggttgtaagcagttaaaatataagatcccggtcttaacataatacccaaatcagctacaccgtctttatcagtctttttggtgtagaaaacaccatgaatgttaaatttaacttcagtgttagctaatgcttttcctgtgctgtcagtgaatttagcatagaatctggtagcattctgatacattttaaccaaatctttacttataatagtcggattaatagttacagtaatattcttacttattttattatacatatctgaaccattatatgaaacagtagcctgataaacattagatactaagttaagtcccattgaagcagtaccgttagcatcagttgttttagcataagtttgaccattaatagtaaagtacacagttgcattagctataggattacctaaataatcagttaaaacagcaaccattctggtaccgtctttgtaaatcatcacaatgtcagaaatgtttaaattaacttttttattaatatctacagtgaaattagtcctgattacttgtttttcatagtttttatcaccagaataagtaacagtcacattatagtttcctgcaactaaatctttaatggttaattttgcagatccattaacaagaactacattataagatttgccatttaccaatacagttacattgcctgttgcatctttaggaccaacaacattaattacactatcctcaccagcaacactagcattaacatctactttcaaggaatctttagctttattaacagttaaagttgaagaattagttacatcagaaataactttactgccacttacagagtaaactaaagtgtattttccggcatttaactgtccaattacaaaactgacagtaccattttcatcagtaactaaagtataagttttaccgttgactttcaaggtcacattaacattagctaatggattatctttagcatccattaaagtagcattagcaattacaacatcaccataatcagcaacaacatcattaacttcaataatacctttaccaatacttgcaacaccattataagttacactctgaccgtcaacagtagcagaaatagtataattaccttctttagcttcaaaaccattaacaacattattagctattgtaccattagcaatactcaaagtaccattaaccatagacatattgaaattacgtaatggtaaagaaccattataatcagttaaattagttccattaaagactttaaatgctaaaacagcaccctgcaacaaaccggtgttattagtaacatctaaagttaaaaccaaccatgtatcaggagtcatattaacaagggttctgtttgcatcaacaacagtaaatactggttgagtattgttaccccaccaattgttatttaaatcaatgattccagtagttggactgcctaaattagtccatgaaacagcatttggatttacaatataacaattagtaatgttaagtatgccaaatgcattagttgttaaaactttacctttaatatcaataatacaattatttaaagatacattaccagatctgtttaaattaggtctaaaaccaacattgttaatgttattgatgtttataaaagtacaattatcaaatttaataatattttgccagttatactctgcagaagaaccataatatgatccaaatatatctccagcagctattgattcattgtatctgaaaatacatccatatgattcaactctatttaaaccagctaaatatatgtaaccttttttattttgaatatctgttcttccagcatcagttgaagttcttccaaggtcttgaattgtagtattaattaaagttataccagcatcaattcctacaatgtttccatagtgagatccactccaccagtaagcttcttcaactaatgaattctgtaaagtcatgtctttaattacaaaaatatttgatcccctgtatgcataatttgcaaagaagtaagaattattaactattaaagtaccattgttagttaatcctccaccatatgatgaaaaaccatttcttacaaatgaacagttgttaataatcatatttccagagtttaatactgctcccccaagagttcctttattattttcaaagtaaatattatttaaatgaacatttgaacctggcaaagcaataataggagaatgaatattttttacattttgatatggatatactgcactagcatctgctttagaaccattaaccatactcatattttcaatagtaattatattactgcctttagctattgtaaagaaatcattagtttgattaccgcataaaatagttttattaactccagcaccagtaattgttacgcttacagtagatgaaagctcaatatttgtattaccttcacctgaataaataccttccaaaacatgaataaataacacataactttgagaatatccgtagtttaatgcttttttaattgttttaaatggtttagctaagctgccatcaccatttacatcatcacctaatttatcagaaacataaacagttacattattttttaatggttttaaagctactttaacagttccattaatgattttatcacttgcatctgcaaatacataatcaccagacaaagtataagttccatttttaaatccaagataatctagtgatgcaataccattaacaacctcagaagttcccatataagtaccattcaaatagaacttaacagaacctccaccaattacagcaccagaaatatgagatacagacatagacacagtatctgctaaaaattgagtagttaaattattgaaagttatagtaagattagttaacttagcatcaacatattgcttattgtcagaatgttctatgtaaatatccttaccattaattacagctgtgttatctttgaaaatacagccagttaatgtaatattagaatctacagaataataatcagaagtatgatgaggagctaagtaaattgcaccaccataatttgcagaattgtttataaaagtacaatcaacaatagaacccataacagtttgaattgctccacctttatcaccaaaacaatcaataaaagtagaattaatcacatcacaaagcattttataattattataagtatttgaaaatcctataaatgcagttccattatttttcttgaaataatcatttttagataaaataaaagaaagtaatgaaccagtgttatttataaacttattattaatagaaataccttgctgagtagccctaactaaaccaaaattattttcaaatacagaattagttatattaatataacctccttcaaggaaataaagattatatgcattatttattttattattagctaaataagatttatcaatagatgaaacaccagtaatcatacctgtattattgcaaaatgtcaaattatcaatagtagaacttccatctataatcttaccaccataagtgttaacattgtcagaaattatacaatcttcaataacagaaggtgcattagtagttattaatgaatataatccactaatatattttgttattgaaccgtttttataagttaaattttttaatacgacatttgtgtaactaccagtttttaaaaaccaatttctattttgaccatcaattaatactttattatatccttcacctaccaaagttaagttaccaaggttagaaaaagttaaattagtattattaactccactataagttccactatttatatggatagttggatataaagattttccaaaaccgtagtttatagcataaccaatggttttaaacggattaagtttagaaccgtcaccagttaaatcatcaccatttacaccatcaacccataaatcaataggagtttgatcaatattaacagataaaatacccggagtcatagaaacattattactgccccaagtaccattaataactaaatcaccattaggaactaacttagttagagataaaacagctaaaccattagtaactgctgcttgacctacctgttcaccattaatataaaaagtaacaccattatatgcctgagtttgacctgaaacattgtttccatctacatcagttactctacatgaaactttaaaagtaggagaagttgtagaattatttaaaaaagtaataattacattcatacttccaccattaaatatttgacctttacttgcagaagtagaattaacaaaagcattacctttaacaaaattcttaccattaatattaattacagcactactttgccctttattgttacagttgataaaagtattgtttacaataataccatttccattatatccggaattagcatataatgcagcatcatatgcattacctgaagtggatatattaacaaacctattattcttaattatagtactattatatacattaatatatgcacctgcaccagtacaataagtgcttctagcaatagaattttcaaatacacaattcataagttgtgcattttgcatactacttgcaaaaattgatcctccataactattaacactattattcctaaaaatagaattagttactttaaaatcattagattgttgataaattgcaccaccattataacctgttgcataattatcctcaaacaaacaattatcaatagttaaaacagcattacttgtaatagcaccaccagtattggatttaccattaataaatgcaatatttttaaaaacaattatagaatccccactcattgacttaaaaataggagccatctgttccccatcaataaatgtcttatcatatcctcgaccaataaaagtcaaagatccattataatttttatgagccaaattaatacttaaatcagtattattatccccagtgaatgttccttcacttaaataaataactgcattatcagaagcattgacacttgaaatacccttatttattgtagcataaggactagtttgactaccagaatttgaatcatcaccagtagtattcacataaatcgtcttatcataacttatcccatcaccaacatgagatgaagcactatcaactgccaaaacatcagcagaagaaccctcctgagcactaacagcaccaagagtcaaaatagccagtaataaaataccaactaacatcactttatttaatctcattaaaatttcaccaaaaaaatttaaaattatacttaaaaaacatcaagtataattaaaaaataactatatttaatctcatatttaatagttatcttgaaaattaaaaaaataataaaatgtgaataaattattataatttgttcactaaaatagtattagaagtagcataactaccatagacagatgtaataatgtatttaccagccatcaaattaatatttaagctggcaacaccattaacatcagtaatcttgttataaaatactccattaatgttgaaagtcacagtctcattagctaatgcacgaccagtaccgtcaactaaacgagccttaaactgactgccatccctataattcatagtcagatcactaccttccaaagtaggtaaaacagttacttttttaccaacttgaagaccgtcaggatgaatagctgttaaaatatattccccaggatttaaattaatatttaacttagctacaccatccccaccagtttcacgagtatataaaacaccattaatgttaaacttaactttagcattagctaatggattaccctgaccgtctaaaaatttagcatagaactgagagtcattgcgataatatttgaccaaatcgttagcttctactgttggcagaactgtaacattaaatgacattaataaaccatcataaggattatgtactgttaaaacatactttccagcccataatttaatacctaatgtagctataccatcatcattagttttgcgaacatagaatacaccattaatattcattgacacgttagtattagctattggattacctgcaccatcaattactttaacatggaactgagactcattaagataatatttaaccagattgtcccccaatattgtcggtaaaactttcacaatagcttttgcaaatgcattgtctgattcagtaggaccataatatgcacataacacttcatattcgccaggtctaaggttaatattcatagttgcccaaccattttcatcagttgtgcgattataagtttttccattaatagttatagctattgtacgatttaccaatggatttgaataggaatccaataattgtacataaaattgtgttccattacgataatttttagtgcagtttaaggcaaacagatatgttgaatttcctgaaacaaccaaagtagtttttacagatgattttttataggtatcgtcaccgccaaaagttgccttaatatcatagaatccgggagataaaacagtatccaaaaatgccttaccttcagaatctgtaatagcataataactttgattaccaactgcaaatttaatttccttgcctttgatatatgttccgttttcatcaattaaaacaacatagtaattactgctaccacttaattcagaatctccagcaattaaaactgttttagtagtattgcctacagactccacattcacatagttaactccataacttccaagataggaattactgcctaaataataagtggaaataatatatctgccataatctaaatcaaagctaaatattaccttaccatcttttgcagttactcctttgtaagatccgacaaaatcaccatcaattgtagaaatattagctaaaatagtagcataattaataggattacctaaaacatcacttaaaacaacagtgaaattcatagactcattatcataaccattaacatcaccagattcaatgttagtagaagtcctgttagaatcaaccaccaatatataagatgaaccggatgatggaatataatttggattatctatatgataactaatcagatacttaccaacaccaagacttaagagtaaacgagctacaccatcattatttgtagtggctgtgtagtttgttccatttatatcaatcatgatttgcatatttttaacagctgcattcctgctatcaagtagttttatcacataatacttagcttcaccaacattcataataacgtcagatgcaagaattgtagtcggcatacgataaacagacacggtacttgaatttttagcaaacaaaccataatatgggttagtgtattggtaagtaatattataaataccaggatttaaagtaatctgcaaacggccatacccataaatgtcagtaacaacattgtaagtttgctgccaatcaccggaagaaattgtaacagcaatattcttaccatacaaactatatgcattagtatcattgaaagaaattacaaaatacctattttcaccataatactgaacaaaatcacttgcattaatagaaacctgaccaggtgcagtttgactatcaacaacaatagtagcagcaccagttgaatcaatataccatatatcaccatcaaaatcaaaagtagctaaataagtaccttcaccttgagcaatacggaaagttacttctccattaccatcagttacaccagtataagtttttaataaaactcctttgtacagatttaactttatagttgcattagttactctgtgaccaaacatatcagttaaaacaacagtataaacaccatttaatggaattttactatagtggaaacctgaaataactgttaaaaccttattaacagtaatagttccactgccttttgcagaaccgtaaacatcatcacctgcatagctggcagttatctgataagtacccggaagataattaatagttaatctggctactccatcatcaccagtttgcaaagtaaaagtatcagacaaattgccctgagttataacaaccttaatatactctcctctaattaatgtaccgtgttcatcccttaaagtgatattatactcatttccaacaccatagaaaacaacatcaggcacttcaattgttgaattaacaggacggatttcaacataagatacagaagagcttggcagataccagccgtcacctttatactcacatttaatagtatattttccaacatccaaacttaatagtgcatcagcacgcccagtagaatcagtagtaataacagcagcccttgttcctcctttagaatcaataatagtgattgttatactttgattaacaattcctacctgtccatttgttaaaactgcataaaaattaacatttttaccataaaaagtgtaattataactaatcaaataagtaacagatggactaatagtaatctgagcagatttattacacccttcaaaataaccattaccatcataataaacagatatgttatatacccctacaggataagtcaactcaaacttggcatagcctttttcatcagttactaaagtgaagtactctttttcaccatttggagttgtaataacaacagttaaagcctgattgaaaattctatgaccgtttacattaattaaagtaatttcataattattattgtttccataaactactacatcatccattattaactgagtgttattatttctaagtgttaagtctaaaagttgattatcaatccttgcataaacattaaagtcagcagtagtttcattttgaacaacatatgcatcagctttattatttacaagagaagtgttaagtggagatattattccataatctgatgagaaataaacatctctagttggaagaaccttatccaaactactaatatttccattattatcaattaatttatttaaagcagcaataatatgagtgtttgtaacagcatctaaagacatgattacccaattatcaagagttaaagatccgatatgtacaaaaatcctattaccatcaggtttttgattagaaccccaccagttacttgaataatcaacttcaccgtcataaacaaaaatatcattacctccgtaagtagcagaattattcaaaaatacagaataatgaacaatcttagtacctgcaagagcaccaccataagcagctttattttcaataaaaacagaataataaacttcattagcagtagctattcccctatatgaataggtagaatccagattacctataccggaattgtcatttttatagaaataagaattattgattaaatcagcacttacataacaaacagtattggaatcaaagaaagaattatttacaacagccccttcaattaacctaccattatttttaataaaagaacaattgtttacttctccatgacaggttccataaacactgcgtcctaatccaagtcctatgcgattacttgcataataatcaccaggtatgaaattattctctacaaaagaacaattagtaatgtatgcaaatacagtacttttagataaatccccaactatatttttacctaatgaagatgaagaagaataaatagtaggatttaaattaacaatacctacagtattgcttctaaatactgaattggaaatagaaatataattccagacagggaaacaaacattgtatgcttccatacccctataagtgtaaatattgctgcatttttcagcagatatattattaatagtaatattggctccgcctctaattaatggacctacaatgtttttaaaagtgatgttgtccacatatacattaccgttattttgaacaccattacttgttgaaacaataccaacagaacggatatcatagaaattggaatttaaaactgttaaatttcctcctttaacaataatcaattcattagaatactgttttaaattaactgtaaaatttaaatttttaagagtcaaactaccccattctttaactatgaatatattacggtcattttccctacttaaaattacattaccaacaccaacaacagataaatttttaacaatttccaaatttgaattccaattatttgtataagtgccgtttaacaaataaatagtatttccatttaatgctttagctattgtatgatccaaagttttatagggattatcatgacttccatcaccaaacccgttgtgtcctgttggtgaaacataccaatcataatcagttaatcctgtaccgacaataagtcttaatctttgagaattaattacagcataaacaattgaactttcattattgtttcttaaataattagaaaatgtaccattaactaaagttccactactataatcaaatttaccattttgagactcgaatttaacactcatttgaggaagtaaagaaggattatccaaatatttcatggaatccccatcagtatatttatttaaagttgccctaaactccgcattagtacctactttaatcggagactcatcacattcaaaagtcattacaacccaatatttagtgtctgatttaacatacttaagagaaggtcctttatttaccccccaccaattataatttgctgaaacattatttgcataagcaccattaccataaatttcgcctaataccacagaataagttatattaagattagaattagcaatattaatactgctatcaaaatatgatgatttaatagttgcatcagaattaaatagagaagacaaacctgaataaccggaagttctaaagtacacatcacttatattaactacagagttttctgctctaaaacccgcatcagcagttgtatttttaactaccaatgtaccattattacatgctaattgccctacttttgagttaataacagtcatggtaatgcttttaaaaatatcaacatcaaaattagggtttgaagaaattccaaaagtttgagaattattcacaaataaattatgaaaattataaattgcaggattcttatttgaatagcttataatcaatttactattaacaacactacagtctcccaaattaaaaatcatatccgcataattagaaccaacacaattagaaaatttagaatcataaacttttaagtcgccttcattgtaaataactcccataaaagaattaatattcttaaattccacatttgacaatgttaaaaatcctttattgtaaataacaccataataactagaatattcagttgtttttccattgacaaagttaatattttccaaaattaatgatttggactcgaaaatattaaaaaatgtactttgtccattaccattaactgttacattgcccgttaatgatttaattaccaaatttttatttatttcaatgtttaaatcacctggactgctataaattccatccataagaataacagtagaattatcactagccatattaactgcttcaccaattgaagaatatggtttatcctgactaccatcaggtactatagataaatttgcagaaggatttacataaacattgttatccccattatctccaataatagagtctgtatcatagttattttcaacaattacattatcatcaacattagtactgttaaaatcatcactagcactagctaaacttattgaagacaatataatcaaaaataacatgaatataaatgcattctttttaacaaaaataattaacacctcttaattaaattatacttggttataaatcaaccataatattattatttttaataaaaagaagtataaaaaactttctaaaatattagaaaaaagaaaaaaagaaggtttaattattcattttccctatcttttctgcgtttataacctataaacagacagattataagaataatgattaaaccaataaatgtaaatattgtgtttggattgtctaattgcttagttacatcctcttcatcaatctcatatgctttaacatcatcactgctggaactggatgaactagactctccagcatcagatgaactagatccgccagcactagctgaagaagctgcatttgcagtcaaacctacagtaagtaagttttcattagcattaccaccatctatttggcttaaactattagcattagaactgccattaactccctgatttgaagtaggatttccaccttgagcaggtccaccattaggaccatattggccaccaccgccaggacctaaattacttccaggaccaggaattccaccaccaggaccggaaggaccaggaccggtatttccaccaggtttaccttggcctccaatttgaggaccagtatgccaaataggatttgtcttagtaatcactgtagggccggaagcaggcttatcattacctcccggagtaacagttccatttccatttggcttgtctggtactacagtaggagcccaattaataattgacctgactaatggcttaaatacaattttatcacctaaattaaaaggagaatcatctgggactccttttttaccattagattcccagtaattataccttgcatcaacatataaatgtgaactgtcatatacactgaaactttcagctttaggtgctttgttatttacaatattagaattatgtataaccatattagcagatcctaaataaaatgccccacctgattccaaaccaagattattagagatagttgaattaaagatattcaaattattctgagtgtggccatagtaaacatatgaaccgtaactgatagctccaccataacttgcagaattattgcttataattgtattagtaattaggaagttattagatatgtctaaagcaccgcctttacttcctgcacgattatcagtaattatacaaccatcaatacgtccatcatttgcctgaacagataatgctccaccattaactactgccttattataacggacaatagaatctttaagagtgaatttatcaaatgttccataaattgctccaccatcaccataattcctataaacataagaattcaagttagaattattaccttcaatagtggaattagccacattatttgtaaaagaacaattagttaagttcaatgaagcttttggtttatatgttgaatattcaccataatttgaaatagttccaatagctcctcctttataagcattattatgatcaaatattgaattagcaacttctaaaacagtatttttgttaaatattgctccaccagtacctaaaggaacttcacatactgatctgtgttcataacgaacaccttcatcaatagaccatccggtagaatacctttcaagcatacaatgatccaaattaagaactgcaacattcatgtaaaatacagtattattaattgtaaaagatttagatgaatctgtgtaaatagccccaccatgaacacctttattatcacgaattactgatgaaagaatagtagttttaccaaagtccgctatagctccacctctatgagcataatttccagataattcagttaaattaataactaaattaccgtaatttaatatagctccacctaatccagtatttttacagtcaacagtataccagtactccttgcctctgtcatctacagttttatttatgaaatcaggattactattatcaaaataagcagaagagttgcaaattattgaattattaatgtataaagtaccattattaacaaataatgaacctccattaacattatgtccattagatacaattaatccatttattgttaaagtaccattagttaaaatagtaaataactgactattatttgcatcaataaatactttacccggattaatagctaaaatagtaatatttttatcaataacaagattagaatcattaaatgttccatcaagcaagtaaattacacaatgatttaaagatttacctaaagcaaaagccagagaagcataaggacgctctttactaccatcacctgcagtatcactaccgccaattgcaacataaagtgcaaatggagtattatctataaccaaatcatgcaatgcataaacagctgcatttgcacgtttagatccattaccactaataagataattgtttataactttattaaacaaattctcattagttataatcataactgcataatcatctcctttcaatgaataagaaaatatgttattatgagctacagtattacttactgatttgccagtaaagaagacagctgattgattagtaacgcttgaatttccagtaatgattatatcattgtattttattgaatcatatgcagaattataagcataatatccaaatatggaaaagccactaatagttaaattattatgattaaagttagtatatccagaatcaacagaataaacaaccttatcagctattcctgacatattattataagcaatttcattatctttagaatttttaataattacaacattttcaagattgctgaaagtcatattattagaaattatatgatttgaagaagtatcaagtaatttaatcattacattactttttccaccagataaactattattaattacataattacccataccgccaacaacaattacactagagtttgttaaattattatttttaatataaactttagaaacattgtttaatgttaatgtagagttaattaaagttaaattagtaatattaactgatgaagcaccactattaagaatcaggttaacaattgaacttacattttctttataatatgtgatattaactggaatatcaatacttaaagtttgacctttagttaaattattaagtagcaacacatcattgtttttaataattttagagtttatagtatcattaaagtatattccgcaattattatcatcaataacataataagtaacacctaactcaacaatagaagtattattctcaacaaatattggatttgttacattagcataaattaaattaccagtaatatttgtattatttgtaaatttaattaatccaatagccccttgtccaatacctaatatatcatgaatttcagtaattttagataaattaccaccaaagatattgaaagtgttgtttataatagaaatgttgtctgacatatatgtgccaataccataaacaccgttagaattaccataaagataattattcacaaaagtgacattataatttttatgcaactcgatgagatatgccatatccttagaatgaataacaatattattattagaaatattcaaatcatggggactgccaataacattacagcttgctataccgtaagctgcaccatcagaaataatgttaatattatttcccataatttcactttcagttaaaacatcagcataaatagcttcagttacaccagtaccaatcatgataatagtatttccggaaattctaaatcctgaagacattactttattataagttaatcttataggattataagcaggcatactaataccataagcataagcagcttttgaattaatataaatattattattttttagaattatgccattgcatacatcaacaactgaaatagctgaattagcaggacttttatccttcaacattaatgtaatattattgttagataacgaaacatcatctacaccatttaagactatagcttctttattcatattatagaaattaaaatcacgaattaatgatccgctagcatctccacttaatgaaatagtaacattaaataaaagattgctttgtttattactaataatattgattttttctgttatgaatacatccttgttagataagaatgtaaagaagattactttagtcttatttgcttcaaaagtataattcaaataacctctttcatcaaagtatttgtagaaattgtcatcattaataactaaagctgttgcatcataaataaccccattaatcatgttgtcagagttattgtctgcaagttcatcagtaatctctttgtagataccaacactagcattagtttcaattacattacctgatatggtagttttatagattaaacctttaatagaaataccataactttcactgcgaataacattgtttaaaatattattataataatatctcatgacatttgatgtggaagttacagatatacctacagcatgagtatcaaccatattatttgaaatagtattgttacatccaataaatgtaatagcattatcatgattaactttaattttattatcatgaacataagaacaattatcagtgatactaatacctacaccataattcttaatattaacagtattgttaaaagcttcagtataattacttaaaccgatagcacaataaatatctgtaaatgttacattattatgtgcaacaatagcagaatatcctttttcaccattaactaaaataccattaccctgactagttccagttacgttattataggtaacagatatattcttacccattgcagaaactgaaatactgctttctataatagtattattatatactgtagcattatctgaatataagctaataccataactgccacgaataatagtattattagcaatagttgtgttgatatggttttcataaaccaactgtaacacaatagacattgctccattacaaaatgctttaaggtaattatctgaaataacgttacctaaacataacggtgatccaccataatctgcatgtccaaagggattaaagtaaatcagattactaactatcaaatcattataatccagagtttccaatttatttttagaaattatattataatgacattgacccataaccattacacaggtaatgtaagtactcatatcattaccaataattctattatagctagaccatcccataggcattgcataaacacctgcagcattagctattctaattgtattgttaacaattgtattattgttagatttagttatccaaataccatgtaactgacctacatatattccattaatagataatgcacctttagtattgttaattgtaagtcctgaaactgtagatccatcactacctttaactaaatgaataaatccatttgaaattttagaagtattatctaaaggcattaaagttaactgacgatcaataacaaaacctctatcagatatattgcctatttttaaagtatctccagctacaattcctgattcatttttgatttgaccattgaatttgtagaaataattatcataattattttgagtaatttcaatagttttgccgccaataattgggcttaaaacaatatcctgattaccaatatccaaattattagattcatggttaataattacgttgtcattctgttccaaaacaattgtagaattatcagtatcatctattgcactaactgcacttaatgataaaataaaacaacaaatcattaccaaaatcaacataccctgttttttaatattttcacctccctttaaattaattaaataaaattatagtccaacaaaatagaataaaaatattattaaattgactatgttataaatatctgacatgatatatatttaaatttttatacaatttttaaaaagcatatctgaataaaaacaaataatataaaaatttgatgaaaagttaattaaacgtcactttcaaaaacttgtgtgatttgaattttcactagtttttgagtcacgaatttttttcgttctattttttctttatttttaatttaaaagcagtaaaattaatatattaagtggagctaatatattaatatgtctagtatcaaaataaaagctccatatgaatttatggagtcaaaacaatttaaacttttcgattttgttcctgagttttctgaattccgtcaatttgatgatctttatcgatttggttgcgaaaatattgagaataatcttatcagattggaaaaaagaggtaaaatacattttgagaatagagttgcaatttgtccatcttgtaaatcacataatgctgttaaaaatggtacttatgaacgtaaacttatttttttaagaattggagaacaaatttgcactattcaaaaatataagtgcataaaatgcggtaaagtcttttatactgatttattatctcttgtttattctaattcaaatattacattgcctgttattgaatgtattgagaatttatatcaaatttatggagcagggctccataaaatacgatttgatttaaaacaacaacataacattgaaatctcacatcaaagcattgaaaacatcttattgaactctaattatcaatttaactatgataattggacttattctagatattacttatttgatagtctttgggttaaaattaatggtgaatggaactatattttagccttattcgacgttaaattgaatactctcgtttccgttaaattggtcgaatcagaagattctaagaccatttatcaatttttaaacgaatctctaagaaatcagaaaaaaatatcaataggcacagacttaaaacacgaatatcgtgaagccatcgataaattaaaagtaaaacaccatttctgcaaatttcacgtgaaacaagcagtaaacaaaagatttaaagattactttgacaaaaatccattatctgaagacgaaaaagacatattaaattgtttaaaacaggacatttataaaatattggatgcaaaagacttaaatactgctaaagaacttagaaacgaattaataaacaaaaaatatacaaaaaacaagttcacaaacaaaattctttggaaattcatcattccttacttcaaaaaattaacgacacacctggaaaacacgaacatcccatcaacaaacaataaaatcgaaaatatcttccaaaaagtattcccaaaacacataaaaagaacaatgaaaatagaacaaggacttctagccagattcatgctaaaactaaattattggaatttaaacaatgaaaaagaaaaaaatcacacaagtttttgaaagagccaattaaacaattaaaaaatattaataatattcaaaaaaagaaaaaagtaagtaaataaaagttatttacttattgtctaatagtaatagtgtttccaatttgtaaattctcccagatagaagtaataatatatttaccggacaataatctgatacctaaagaagcaataccattactgtcagttactttattatagaatacaccattaacattaaatgttatattttgatttgcataaggtttaccttgaccgtcaattaatgtagctgtgaatttgctgccgtcattatatttcatgtctaaattatcagtaaacattacatttttaactgtaattttattggaaaccatacagtctttgtatattgcagtaacaatatagtctcccggaagtaaaccaattcctaaagtagctacaccatttgcatcagttgttttagtgtagaatacaccgttgatattaaatgttactttttcaccagctcctgcaacactaccatcctgtttaattactttaactgaatatgcagatgcatttttaaagtattttacaagatcatggttctcagtaagtaaagataaaactgtaactgtgttacctttctgttctccattaggaccaacagctgtaataatgtatttgccaggatataactgaatatttaaaccagcagtaccgactgcattggtttttttagtataccatacaccattaatattaaatttaacttcagtattttttaataaattaccatgcccatcatagaatacagcataatattgagtgtcgtttctaaacattttagtaacatccctacttgaaatagtagattttattaaaacatttacttcagcatcactgccccactgtttagcattggaatcaaatttgatgtaaactgaatattcaccagctactaaattaagacccattgagaatttaccatctttatcagtggttttagtgtaagttacaccattaatagttatttttacatcagctccagcaattgcattaccgtttaaatctttaagagttccttctaaacgggttccgtttttataatacattacaacatctttagctgaaattacagtataaaccatatctccgatagttaattttgaagtagcagaactgcctaagtagtaattattttcactagcattggcagatattggatgtgatcctgtgaaagatttaggtatttcataaacaaatttagctattccgttttcatcacttacagcttttccagcatatcttccatcagtgaagaattcaacagtaattccacttacgccattgcctaaaacatttttaacagtagctgtgaaataaactttattacctgcttttccaattacttcatctactttaatgtttaattttcctttagttacaattaaattagcagttgcattaactgatttataattaactttagataaaacagcagtaattgagtaatatccaggaacataggactcatttaattgatattttaaagtagcgacaccatcattgaaaacagcacttccaatttttacaccgtttatgtagaatgctgcttgagctgcaagaccaccggtgtatggaagtttagcagttattttaatggttgcattgtctaaataagatacagttacatctgcaaatacaacattttcaaagatatatttgtaattattgttgacaatattgtttttactattatttacaccgtcatttccactgccttcttttccaaccaagtaattgttagtaatagtattgttaacagatttagtatctaaatctacaggataacctacattagatacaatttcattattatctattatattaccagttgaaatagctacaaaacgaattcctgcatttccttctttaattgaatcataatttttaaatgaaattgctttaccattaccattggaagttattttattattggaaataacattattacttgatgcataacctgcaaatccataaaccatatttccagttccagaaataatatttccggaaattttattgttgttggaagaataagcttccattccataaataacttctgcagctgcattaactttattgtttacaatagtggaagattgagataattctaaagtaataccataatttacattatctgctgaaatttttacatcattatctttaattaaattattttttgaattataacctgctataatacctgttgcaaaataatttccgataacttccacattattgtcaacgaatttattatttgaagaatatttagaagatcctgaaccggtttcagatccaattacgcccataccatataaataattgtcttttccttcaacatgaatattgtttccagaaataatattgttacttgaatcaaagtagaaatcaatacctactaatgaattagtggaaaaattaccattaacagtagctctaggttgatttactaaagatttaacagttacattattgtttaatacttcattgtcagaagaataaatcattaaaataccataggttctgaaaatttctttaacatcatttttaccgtcaatacattttgaagcttcatataaatgtaattcaccagttcctaaagtattaattacgtttccagaaatagcacaattttctgcaccatatccgagaactgtgtaagttaaataattaccgtgagagtaaagagtgttatttaccacttcaacattacctgatctgtaaatataaatagcatatgctgcattcggatcaacaacactaatattattgtttaatatcattacctgattagtatcaactacattaactccccatctatttaaagaagaagagtttttattaatgatagttacattttcaatccatacatgatttgtagttactttaaacattgaatcagtaaaaacagcatttttaccaaggattttaataccttcagtaataagcattattttattgttaaagtttccaacaaagtttaaagtatctctcattttaatagctgaatttaaattaccgttttcatcaaagaaactagaataattactttccgtaactgtgtaaattgtaccattaaaaacatacaccggttttgatggatctacagctccttcaggagttaatattaaagaaccatgacatttgttgtttgaaattgtgtaagtatctttatctgcttcagcagcatcaattgcatatttattagtggtagttatgtcattacctgtaataacaatatttgcagggaatttagtgctggacacttttttaagtaaaacaccaacaccagtattggaaactatattattatttgtaacagttaaataatcatatttacccatttgaaaaatacctgcagaagtattggtagttacattattatttttaattgaaatataattaccttctgcctgaattccataaccgttaccatgaatgtcaacaacattatcagttacattggaataatctcctgcaagaattccagcacccataagtaatgcattttgaattatattattggaaactaaagaggaattacctacagcaattgcatagtccccacctacagtttcattagtgttgaaatctttacctgtagcattgataattttattatcagttacaatagtacctacaccagtagaagaaatggatctgtaattaccgatgatagtattggaacttgcattgttataatttcccataagctggatagcataattccaggaagttggaagaacagttgcttttatagtattgttgaaaataacattataattagatatagctccaacaaaagctcccccaccataactggacaaataaattccatttgcatcatcagtgtataaataattatcagctatgtaattgtaatgagcaccaccaagtacaattaaagaagtagacctggaaccatgcccataagttgctccataagtagctaatacattgtttgtaatattattataactagaacccggatttaaagcaatagggaaagaacttggaccggaattgtttattttattattgaaaatattacatttggtagcctcattaaggaatattccctgaatatcagtacctttatttgcaatatttaagttagatacgctacttccagaggattcttttaaaagaaccacagtacaatcctgcattttattagttgatgtacctacaacatttaaaggtttatttaaaataaattttttatcactgaaagttccatccaaactcatagtatctccagaattaacagaagatgatttgagagtaccattctcgtcaaaataagtaccataattagatgaacttactgtatgagacgcaggtgcagctataacaccactatcagaatagtaattataactaactggctcataagataccatactatctgaaattatattatcatcaactgttgcattaacatcttcagcagcactaactgctccgagagatacaaaaatcaataataataaaattaaagaaaatttaatattttttaccattttatatcacatcattaattatattaaatataatttaagcaaagttcaataaagtataccttgcaaaaaatacattataattaaagttatggtaagggaaaatatttaaaaattactataaaaaaagaaattaaatgaagaatgatttaataatcatcttcatcgttttcgtgtttgtttctagcatacccgacgacaaatattgcaatcaaacagattactgcaataataagtacaacaggagtacttgattgaccagctgcagatttagatgcagaacttttagaaatttcatgagcagtagctccagattgacctttagatgaatctgattgtgaagaagcatctttagattgaggtgatgcaatttttgcatcagccggatcaacagaagtatctaatcccgccgcagttgccccaccagcttcaccactgccactttgatcattattagtagttccatttaccaagacttggtcattattattatcatcagtatctgaagtatctccatttgaatcatcaggattagaactatcagagctactgtcatctttgtaaagaggatcagttaatgtagcttgagccaatatttgagaatacttagctttatcagcagaagataatgaactagactgtataagtttcatgttgaaatccaaattcttacatgtgtggtgacaacaagcaacaccatactgaatagccatttgaatcatattatctgctaatttagtcaccatgtctggactagcatcccatttaccttgataatttaaatacatcatccatgcagccatagattgccaagcagctgcttgagcaacattacctacaccacttgcaagacccaaataagtattagctatttcattacctaattgagtgtttaaattcttattagctacaatcaaaccaccatataaattttgcatttgagcagcataggataatgaacctgcacgtgtactgaataatgcattataatataatggatttaatattttactacgaatttcaaattcaagctcttcatcgtaagttctactaatatagtcatttttattccttatatctacaaatgcagtgtcaggtttagcacctaactgtttagctgcattgtataaaccaccaaaccaatcatagtaatcatcagaatcgaagaatctccaagtactatcaaagttttgagtaatcaaatcaactttaccaagcaagtattcatagtttttcctttcgttgttaattacgatattaccatgttcatcaagagtccaggaataagatactctgctaagataaatatccgctaaatccgaattaattgtagtgatattccagtttgcagtatttggtataagagaattcataccagtaccttccaaaacagcaccaggaagaccaaataacctatcagtcatcggattttcagcataatgctttttcaggaagttgtttgaaacatcatcatcagtggaatttaaagctaaactaacagctgttaacattaatttaatccaattagtattacttgtaaccatacttgcaaatacatcaactctaggtctgtttaccactgaaccattacttaattttacagttaaattattaattggaattaactcaacaccagtaatgtctccagatctggaccatgtcggtttacagccgaggaaatacataaattctgcaacaccaataccttcagtccttaatatttcagtaccccacaatattaaagcagtaagttcaggccagcttccatgttcttcataataatttgcaagaagcaaatctacaacatttactgcagactcataagctgctttagaaggcatttttgaagcatcagaactgtgaccaatatgtccggtaggtattgaatcactataagcaggatctgcaaacaaacctgcagtagtataactaccagataatgctgctaacaatgcattccattcattattgttttgtatttgagaaattacttttgaagcaaatactaatgattcatataagccagaagatttgttataaactttaaactcatccatttcagctaatttatcaacactagctgtaccatttacaagattttcaacaaatgacctgaaccagttaattacaactaatttttgaccttcatactgacggtcacctttaatatcatcatagtaatccttattttttaattctggataaatatgatgcaatatttgagtatatacatcagttcttgaagttgttattgtaataacttcttcaacaagttcagttccatttaaaactttaccaagagtatgtaaaccgaaagtattgaaatcttctgccatactatccaagtaattatgtaatccttcaagccaatcatcaaatttttgaccatcagcaggtttgtcaaaacctaaagtaggagctaattctaaaattaactttttataagcctctgcattagctgaaacattattttttacttgttcattatagtggtcgatgtaattggataatgtagtataattaccatataactctgaaattaccattgcaggagtcatatgagtgatcatcatagaacctatcctatctctagctaccatagcttccccagggtttgatacaatatatggatatatagtaggagttaatgttaactcaaatgtccagtcaccttcatgaacaccaatatttctaccaggtaaccactctacagtaccgtgagtacctaaattaataattgcatcacaaccaatagtcttatctaaccatttataaaaggtaacatattgctgatgaggcggcaatgtcaaatcgtgataattttgaatctcctcccaacctctacttggttggaaagtgatgaataccttaccaaaccacattcctggaattacaatatatgtcttattatataccattatttctccaagacctgcaccccaacggtcaaccatttgcttatacaatgtttgattcatatctttagtcaagttataaaactcatctaatgtaatcaactgatgatgttccattaactgattccaatatttttcaacatactgatttaacaaaccttgagcccaggtacctttgttacccatttcaattattaaatcagacaaatcatcaacagacggaatgtcggacttatccattccaatatcatatcccgcatcagctaaatgctcaagtatatcatgagcactttggaaaacatctaaataagatgcaccaatttctgctttacccggcggataattgtacaaaacaactgacacaactttggaagaattatccatatcttttaaatctgcccatccagtagtcattttgaccattttttctatacctgactgcacaacatgtactttacccatattatctttatatgataaaataacaggaccaaagactccttcaaagctaggaatagaaactgaaaatgtccactccatttgagcaccaagctcactgtcaaaactggtttgagaaatatccaccaaacctttaacaacagttaaattaattttaaccaaatcatcttcagcagatcctttaccataatctagagaccagctgtataatgaagctatagctgatataccaatttgagaagtttgagtaagagttaataaaattgaagacattgatggagtaatacctgttttaaatatattaaaagcagatctaccatttgcttcataagttctaatcaaagcatccacaacacttccaccacagtagtaagaagcaatagctatgaatttggtttcaggatttttcatattcatatatttgttttcaaattgtctgaacaattctgcaggattcaattcagttttcatccactgctcatattctccagtcatccaatttaaacttccctttttatcatcattatatccaggatgtgatagaatccactgattaatttcactggcttttggaactacagaaaacattccaaaatccggatggtaaataccgcattcaggacttaattggggagccccaccttcctgaagtgtaggatttgtgtatttttgaggattaattaaataataaacatatttcaagtaattttccatgtttgattttaaaacatcagaattattaatatcctgagcctggaaataagaacctatatatgtattttcaacagtattgtaagaattatctgctgcacttgctcctacaaaatgaatacctatattcttaattatttcatcattataaacaccaaaagtataagcaacattatattttgcattagctggtgaagagcttaacaaattctttaacacctgagaagtaaaaagactatatgaaccttcagcaaacatatcaacatgcacgaagttagcatactctaataaccattctctagtcttgtcatagtcagttgtacttatatatgcaacccttttagataaactcattaaatagtctactttttctgagtgtgattcataagatactaaaagcataatatctggaacaaacatgtaattaactaaaacagaagaatgacttccaagatttacattttctgtgtgagtctcataagtagaatagctaagttgaactttataattgccagcagctaaattaccaattgaataagcacccccagcaccagttttaccagcaaatactagattatttgatgaatccaaaactgtaatattaacacctgccaaatccactccgtcttcaacccaggtttttgtagttggattataagaatccttagtatgaatatcaatactactgtctccagcattagcagaaattacatcagtataataaatattgctaacttcatctacactaacacctataacatcccctagaacatcattactaactattgtttcgttgttagaaacatcctgcgcagatactatgcccattgtcataataaacattaataatagacaaaaaataataaatgcacttttatttaaccttttaatcttttcaccccctgttccaattaattattttaaaagtatagcaatattattataaattactataattgtaaataatactttacaatatataaaacttgctaaagttttgaataactaaaaaacaataaaatgaaaattaatttataaattatcttaaagattattaaaaaatgttaataattcatacataaaataaaaaatagctaaaaaaagattaaatcaaatttcatccaaataaaaaaaactaaaaataaatattaatggcatgttaagagtaacccaccttctgtttaacagcattcatcttagcgaactacttttgcctcttacagtagtcatcagcattttttgttcttgcatcctatggaatggccgtttcaccgattctttcaatgtcctcaattaaatatcatagtcaaccattaaaagacgtgtcgtttctgctccagagtcatacctctcagtatacgtttttcaacgccatagtctgtaacgatgggcggagtttccttagttaaaaaaccaacagctgtctttaacttgccatatttataaaaagtagcagggcctagatttgaactagggatctcggggttatgagccccgcgggatcaccagactaccccaccctgctatacgaataaaaagatagtaatttaaaactacaatatataatatatgaaacacactatataaatgtttctataaaaataaaatgaagataattattaattatcctctaaacttttaattcttttatcaatttcttctaatttttcctcagtctctttttggaaagctttagaagattttttgaattttttaaagcttttttctaaatcatcaacagattgagtggttttatcaaatctgtcttcaaggtcttttaaatcattagtagtagctaaagaccagctttgaattaattcttcgcttttttcatctaaaaaagcatcgattttattagaaaaagcatcagtatttaatccagacatatcaatatcacttaatttaattttaattcttttactcattgattcttctttagactcttcaactgtgtctttttctctagacaaatcatcatagtcagaatcattttgcaatatttcacccatatgcggatctgcagtagctggaacataattacgtaatttctgaacagatgcgggattattttgtaaatagtaataaactaaaactaaaatagctactattaaaattacaattgcaacaacatcaataggacccataatatcaccttattgttttttgagtttagcttctttagcttcgatttctttaagcattttttctaattttttctgttcagtctgtgcttctaggcgagctaaacgttcattaatttcactgtgcaagtaaccaacttcacttcttacttgtgttgttgattgtcttatagctgaaaggctgtcttgttgctcttgaggtaatggaattggattatccattaaacgtttagattcaatatctttttcaatcattgacatcttcttaagttctatttctttttcaagaagtactatagaagttttagatttagcaacactcttccattgaacagcaacaataatcacaacaaaagctattataaccaatataatcaaaataaaaagttggtcaggtattgttggaatatccataattgcctccatattaatttagtatattaataattaatataaaataaagtatataaatattattataattaaaaaaaggtttgttaagatgattgattcttatttaaaagcaggtaaaattctttcccaaataagaaaagaagcctcaaaaatgattaaagaaggaacattagtactcgatttagttgaatttgtagaaaatgaaaccattaaacagggagcaggaatttcatttccatgcaatgtatcaataaatgaagtagctgcacattatacttctccattaaacgatgaaacaatgatttatgctggagatttagttaaattagacttaggtacagaaattgacggttatattgcagattcagctattacagtaatggcacctgggaaaaatttagatgaacgttttacccaggacgaaataaatttaaggcaggatattattgaagcatctgcagcaggactggatgcagccataagtactgttagagcaggagtaactgtaggagaaattggtgctgctgttgaagaagccataaacgaatataaattaaatccaatagctaatcttacaggacacagcctagaacaatacaatctgcatgcagggatttcagttccgaatatagacaaccatgatgaaactgtccttgaagagggtcaggcagtagctattgaaccatttgcaactgacggaattggattcgtaaatgatgctcctggaacatacatttattcttttttagctaacaaaccatttagattaaaacacactaaaaacgtattaactaatattaaacataactacccttatttaccattttccggaagatggttaacaaaagaatttaaagaaaacagactgaacgtgtctttaaaacaattatcagaagcaatggcaatttatccataccatccacttaaagaaaaaacaggatgtcttgtaagtcaaaaagaacacacagtaattgttgaaaaagaaggctgtacagttacaaccttataaaaaaaataaaaaataaaaagaagatttagtaataagtaggagtcataactcccatttttgctcttctttctatttcttttttacctttgtcttttttacctttagctaatttttcaagtaaaccaagaccaggttttacatcatccataggttttgtttcaattaaaccagcatccactgcagctgagaaaatatctgctccagcatcagttctggttaatacagtagaccatccgtcaggagcaccaacagatccggttgaaatatctgcaaattcacagacataatcattacagatattacatcctgcttgttcatatccgtgagtagctttaatcggaataccttgaggttcatcactgccttcagtgtatatccagaattttccttttccaatatccatttttgttactttatccaaatcaacatccattaaacctttagtaaaagtatctaatgaagccattgggaagttttccatacaaaagataccgactaataatttaattttatcagcgatgaatcttgtagagaatggatatgcctgcatttttctaataccttgcatttgacaaggagtaacaacagttccgattgattcaataccatgttgacgtgctgcttcttttattccccatacattaggagacattgaatatttagttccagcagctgaaagaatttcatcagcggtagtagctatttctggaataggaacccagtcatcacctgggtctccagctacaacagcaccttcaataatattattttctaatgcataaataagtaatgcagaagcaataccaccgtcttgagctacttcctgaattcttttatcagtggatctagctgctacagcttctttgtaagtacctaataccataatcaactcctcctaaagtcctgtatcctttttaatttgtgttaaaggtaaccatgatcttggacacattgtgtaacaagaaccacatttaatacatctgtcagtattaatagttggtctgccttcaaccatatctatagctctagtttgacatgcaagagcacaacttccacaaccactacataatccttgacggataatgttgtttaataaatcacaaccgcatgcattagaacaagctgctaaatcaagtgcaggttgtaagtattccatatctccattacataatgctacaacagtttttgcaatcatttcaggagctactggacaacctggaagtgctacatccacttttactaatgagctgattggtaagaaagattcatgtttaggttgagcttgttgtccaccacgagcataagttgtgaaacaaccgtttaaagcacaagaaccaaatgcacaaattaatgcagatttttctctagcttctaaaagttcgtgtacactgtgttcatcttgtaaacatacagaaccttcaattaaacataagtccatttctggcatttcccataagtcaactaaagtttgaccatatacaatatctaccatctctgtaagtacaacatctaaaatgtcatagttttcagttaaggacataccatctccagtacaaccacttaagtgaatgtaacctatacgtggtttgttggttgctgtttcttgtttggtttctgctacaggagctgctgtttcttcaacttcaggagcagattctattttttgtttggtttctgctttaggtttttcagaaccaccaaaagcttttctaattttatcaaacattattttaccccgatttcttttaaaataatatccatagcttcaggaattgccttttcaacaggttcagttaaacccatttcaacatcaggagaggaaatctcttgaggtttgcatccaacaataatcacctcacaatctttagcaagctcgtgaagaggctcttcaacaggccaggaatgaacattttcatattttcctctaggcatgtcataagggctaaatattttaacagtccctggttctgcatcaaactcaacaacatcaattacaataacttttttccaatattcatcaggaagagaaaaaataaagtgtgttgctccggttccagcatcaataaacataacttcgtcaggcatctctttgtcttcgaaatattcttctaatttatgaataacaaatggtccaaaaccatcatctttaaataaaatatttccgcatcccactacgattgtctctgcatgataaggcatataatttcctcctagctccttatattctcaccatatcgtttttaagtatacttttatcctcatcatcaactaccattacgtgagttgcacatgataaacatgggtcgtaagctctgataacatctgcaccatatttatgatggaaaccttcagtagctggtcccattgttggaatattccaagtagttggtacaatagctgaatagaattggattttactatctttaacattagccatgtgtacattagtacccctaggtccttcaattacaccaatacctaatttaccagttcctctgtcatcataatctgctctagctggagcggaagtatcaatttgttcaagaagatcaatagttaaattataattatttaacatttcttcagctctagctacatgttgagcaactacacctttatctttaaatccgttgaatttatccattcttgccctaggacctgtttcaacgtttttaccattgattaaaggaatggtggtacatgcttttttacctatttccggatcatcataccaagcttcaggtaaaacttctgagaaattatcataatcaaattcatcgagattaccgtatgatgcactagatgctaaaagtggtgcatctacaactcctaaaccttcaggaagttctcttgcagcaatgaaagatttcattaattccacatgtttttccatatccggtttaaaagcttttaacctatcaatcaatttatcttttgtagctgaagtaatgtttctagccataccacctactctaatatcagatgggtgaataccttcaccagcaagcatatcaactacatactgtacatttttcctaacagcagatacacttttaactgcagtagtgaaatcttcttcaggtacaaagtcaggtgcaattaaaaaatggtgaattgcagcactgttaacaccatgtgcagctaaagtagcctgtcttaataattttcctgctttaggaacttcgatatctaatgaatggtcgatagcttctacagaagctaaagtatgtggtattgggcagacaccacaaatcctttgacataaaacaggagctgtttcaggatttttacctgcaaccattttttctaaacccctaactggagtgatacttaaatatctaccttttgtaacaatcccttcatcatcgacttccatgacaagttcggcatggccctcttgacgagatgttggggatataactattctgtctttcaaatgtgtcacctctcttttcaaaaaaaattagaaactaacatttaatatttataaccaatattctatatataatatagtttaaattacaaatagaaaactataaataatataatattaattttattaactaatctacgataattaatacatggattaaatttataagttaaattaacctaatataatattattgtaaaaaaatagtacatacaatgtactattaatcaaaatttaattacaattttattaattaaaatggaggtaataccttggataaatcaaatataataatttctatcataattgttatatgtattgctgctggagttgccgcttatggaataaccaatagtgaaaatccaattttcagtaatttaaatagtttagactctggtagtggtgattctggcaacggtattggaaacaacacaacacaccatgattccccaagtaccagcagtcatggaagtggaggaactggagcaggaagtggaagtggagttagttcaggttccggctcaggctcaggttctggatcaggttccggctcaggttctggatcaggttccggctcaggttctggatcaggttccggctcaggctcaggttctggatccggaggtggtaaccctcataccccaactacaaaaataactcaaagtgaagcaagagacatagctaatcagcatattgagcaatctggatggtatgcaggaaccccagtattatctgcagacagaactctttggtatgttccgatttatgatcaaaacggtaacactgtagatagtatggcagtgaatgccaatactgctgaggttactaaaaattaaattattctttttattttattttttaaaaattttcaaatttaaaataataatttccaatatagttaactataaatactaaaacatacaaaatttagtattgttgtatataagggcccgtagcctagctggatagggcgtcggacttctaatccgaagaccccgggttcaaatcccggcgggtccgtatttcttataaaatctttttttaaaaatacaaaatttattaacaaatattattttaacatgggcttgtagcctagtctggaagggcgtaagactcctaatcttaagatcgagggttcaaatccctccaagtccgtatttttttactaattttactaaaccttagcgatagctttctttaaaaaaaataactttgagacaaagaaaaactttatatatgttcatatgaatatatgttcatatgagttcaaatgatgtatgtgaaatcaaaagtatcagaacagatattgttgatgatattgctcacaagatgaaagatgatgacattattcagaaaacatgtaatctctttaaaatattaggagatgcaaacagagtaaaaattattttagctctccaatatggggaattatgtgtttgtgaactatcattacttcttgatatgagccaatccagtatatcacatcaattaagacatttaagaaatagtaacattgttaaatttagaaaagaaaacaaacaaatattctattctttaattgatgaagagatactcaatatccttgaagaaggcgaagaatatgcaaaccaatcatagtgcacataagcatgacaatttagaagaacatcatcatcaccatgatgaagatgattgctgcggacacaaccaccacgaggaacaccaccatgaacatcaccatcacgatgatgatgactgctgtggacatgatcatggttctggatgtgcttgtgaagcagatttattagaaaatattgataaagaagtagatgtagaacagtctaaaaagccattgggaatattcgcagtaggaataatccttttagcatttggatatggtctagaaatatttaatgttgttaatcctgttgtaagtcaagtaatcttcttaatagctgtaatctacgtaggaagacatataataacagacggaattgtacatttatttgaaggtaaagttaaaattgaattattaattacaatagctacttttggagcattccttctccagtctggagaagaaggtgcaatgttaatgattcttttctatttaggagaatatttggaacattactcattaaacaaatctaaaagctcattaatagaacttgttaaattaacacccgatacagccatggtaaaacatggtgaccacgaacacgaaaaagcagtatctgatattataatcggagacattgttgttgtaagacctggagataaaatacctgttgatggaattattgttgaagggacaacctctgttaatcaggcttcaattaccggtgagagtttggctgtaagtaaaagtattggggatgaagtatatgcatctacaataaatgaagaaggatatatcgaaattgaagtaaacaaggacaacaacgatacaatatttgctaaaattattgaattgattaaaaattccgaacaaaacaaggcacatatcgatgtatttattgacagatttgctgaatactacactccaattgttgtagtactggctattttagtagctatattgcctccaatattatatggagcttcaataactgactggacttacagagcattgacacttttagttatctcctgtccatgtgctttagtaatatccaccccagtatccatagtatcagctattaccaaaggtactaaaaacggtattattattaaaggtggagaatatattgaagaattagccagaattaaagaagttttatttgataaaacaggtactttaactgaaggtaaacttgaaataaatgaagttcaggcatgcgacggatatgataaagcagaaatacttaaaatagcctgctccatcgaatccaaatccaaacatcctattgcacatacatttgtccaatataaaaaagaccacagcctagaattggaagaagtggaaaactttgaatcaatagctggaaaaggtttaaaaggagacatcaacggacaaacttactttataggtaacaaaactttattcagtcaggatataaatcttgaaaacaataaaatgagcaccacagcaatcatcggaactgaaaatgaaatttatggtttgattaccctaaaagataaaatcagagacgaaactccatctacaatagccagtctcaatgctaaaggaatcaaaacaaccatgattacaggagacaatgaggcaactgccaaattagtggccgatgaaatcggattaagtaattactatgcagatttacttcctcaggataaagtcaatatagtatccaatgccgtttccaaacatcatgatgtagctatggtcggtgatggagtaaatgatactccttctcttgcccgtgcaaatgtaggaatagctatgggtcttgaaggtgcagatgtagctattgaaacagcagacattgtgttgcttgaagacaagttatccaaaattaatttacttgttgatttagccaaaaaaacaatgggtaaaatcaaattcaatgttgctttctgtttaagtgtaaaagtaatattaatgatactcggtatcgcaggatacatcagcttatgggaagcagttcttattggagatatgggaattactttacttgtagtaggtaattcattgttacttgcaaaatagattggtcaaattatctattttttcttatttttttattgatttcattttaaaatattgttttaagaattaaaaattgtttttataaaaaactatctattttaaataatttacaaagtaaactaaacttgcaaattaattatttaaaaagtgataaatttatgaaaatagaaatcctaatgctgctggaatctgaaatgaaaggcaataatccaacaatcttaaatgaaaatgaatatgaaatcgaagaaattgaattatttgatgaagatgatgatttttcatctgaatcatctgctaataaattcaaaattgttgaaatggatgattgctacattatgtgcaaaacaccaaattctccattaacatataatgaaaaaagagaatttatggccggattgattctttacgacaacactaaagagaaaaaatccaaaacaacacatttttgcgttctgacagaagctgaaaaatcaaaattagttacatacaaagctaatgaaaatgcagtatattatgttgaaattgttggactaaaaggcctgaagtgtaaaaaagagttaaaaagtattaaaaaatacttaaatgaactttagctattttttaaaagttatctaaagtagttaaagtttcagcttctcttttttctaattttttatcaaaagaaatttcaccgtattttcctccgcctcctggagtaatgtgtatggttttattcctaaaagcctcaatagccggagaaattgacggatctgttttagctatctcttctatagatgcattaaccaatatatcaatttcagttccaaagttatctatcagattttgccattttctctgaactgtttttgttgtaactcccttgtcataaactgttgatattaattcagccagaggcattaaatgaacatatttaggtctgaaatcaggatgtttcggttcatcataatcagctatttcacttattctgaaatcaaccccttttttaattgttcccccacagctgcatttcatcttattttccttagctattaacggatcaactaatttgtagcatttggtacatgcagtcatatgatatttaccaagatttggcaccaacccataatttgctttaatatctttgttttttattgctttttttattgatgagtatgacatatcttcaagctcaatttgattaaactccctacctaatctgtgtggccacggagagtgtgcatcagaatttgtaagaaacgggaaatccttaagttcagctacagtatctgccataaatgtatctgcagacaatccaagctctacaaaatcaggagccttgccatagcaatcataaatactgtcaaaagatttatacattcctgtccatggagtaaaagcatgagccggtccaattaaacaatcatactctttaaccatttctaaaagttctgctccagaatactttgtcctaggtctcccgtcactttccttatttttagaaaccagtttttcagacagttcccttgcagtaccaatatccggaattattatcaaatgatgaatcctgttttttccttcaacttctgttgttagaacaaaatccatatcatctgcagtgtaaattccatctcccttacaagttgtactttcctcaataatgtttaaccagcccggatgaaatgcatctccagttcccaaaagttgcaatcccttaagttttgatttaggagccatattttttattagcatgtctttagatgaagccattgaaaaacagctgtgaacatgaaaatcagcattaactaacatggataataattagctattaataatatattaaatcatctaatattttcttaaactctttgtaatccagacttccttcatgtttttttaaatcagcatccagattatcttcattaactattccattaattgaagttaaattttttaaaaaatcattagctctatcaattacattaatcaaatcatttctggttgttggataagccaattccaaaataggtacttttttatctttaatcaaagccattaccaatttacgttcattagaacatccagaacctccaaataaaatcaattcatttaatacatcatacatttttttataatgatcaggtctttttccaatgacaataaacgcatctgccaattccaaaaccctggaaaataatgttaaacgacctttgattcctgaaggcaattcatttgaaaaataagaactgcccagtaaaatattatccctatttaaagtatatggagcctgagtatcatcacattttccaccggaaacatccatattattatactttgagaaatttgttggtgatatatattcatgaccgttcttttcaattaatggaactacaatcatagcagcatctggaataacagctactttcatgattaataccccctcattttattaaaacagccaaatcttaaaaaaaagtaaaaaaaatgatatatttatccaatatatcttaaatcatcactactgctagcattagctttgttaatgatgtcttgttccatttgttgagctttagccaacatttctttagtttcttcagctctttcttccaatttatcagtatcaatttcaaaattaagtaaaacagccaatttatttaaaatagcttcagctgactgcgcatcaatgaaatatcctggagtctgacccattaagcagataccattcatttcctgacgaagacctaaacctaaaaacaaaccggaagctccaacaattccaccgtcattagatcttatttcaacttccgcttcttttaaaagttctatgttttcttcatcagtagctgctccaaaaatcttagattcttcaacaggttgaccagtagccattccacctaatgtaaatattttactagctcctttacccttaacaaagtttaatatatcctgacatacaccatattgaccttcaggagataaagcttgagtgtttccaacaagaataatgatatccaaattgtcttctccaacatttttaacataatataattcattaatcatgttttcaattaatccttcttccccaacaaaaacttgaggaggaaaacttggagaataaatttctgcaaatttagtagcattaaattcatcaatcatgtgatctgcagctaatttacctacatgaccaatacctggcaatgcttctataaaaacaggattgtttaattcaacatcctctaaaacagtaatttgtgtgatttccatctaatcatcctttttattcatagcttctttttttaatattcggcgatattttccgtatttatcctcaatagaaaatttgggaggataaataactttaagctcaccgccacattgagggcaagcatcctccattgtataaattttacaatcaggacatttgttcattttcatattcataaaaatctagctatccaactctcttaagaaagaaccatttccttcagaagcttcaactatttcaatacatctgtcagctgctgctttaagagctttttcagccaaaatgtaatcagtggattttacagttatcctatatcttggtgcaccaacacattgaaccttgatttcttcctcttcgtcaccattatcttcagctgctttaagagcttcaataatgacatcaacaccatccgggacgaaagtttcaatatcaacatacccgctgatatgaacttcaggaggagtaatatttttattagctatttcagttatagcatcagcccactcttgagatataccttcatcagtaagagattttgcaccatcatcagctgctgtttcaaaagcaccgtaaacatcaccgaaaatatccattagctcataacctacttcatcgtaagcatcatttaaagatttgcctaatgatttagcagataattccaggaatttttcagctttttgttcaattttccaatgctggatttttttagttctttgatcttccctaattctttttaaagaagcatctacatgtccttttttaggatttactctaagaacacggcaaactattttttgattttctcttacatggtctctgatattttttacccaaccagaagatacctcagaaatgtgaataaaagcttctttaccatggtattcttctaattttgcgaaagccccatagttaagaactttataaacagtaccaataataagttctccttcgtcaggccattcttgatttttccttaccatataatcaccaaaaataaaataaaaatttaaaaaaaaatagaaaaaataataagctagattaaaaaatttcgattgaatctagtttaaaactttatcaatatgtgccataattttagctttagcaccacgagatttgacaagtgttttaccacaaatgatacattttacatctgatgcagcacgatcaaagatgatttgttcattgtcacaatctaaacattttacttttaaaaagtttcctctacctttactaaccatgttaaccaccttatttagctacaaattctgctttaccagttctgaatgattttttaatttgagattttccacattctttacatttaagtcttaaatctaattttttaactggtttgtttccggcaggtaaaggccttgggtaacctctatatccagcagttacacgtctgaattgtctttgtccccattttaactcactagcttttctttttttcgcagtatgtacttcatgcattgtgtgttttttacaatgtggacagtaagttcttttttcttttggtattttcatatttccaccattaaattttacactaaaaagtgtccgattaattaaattattataaatctatatgagaattttatccagtctgaaaaatatcaaagatctagaggattaaaactttattgtaacatactccgtttacacaaagcagaaatccaaattatataaaaaatataatttcttattatcacaaatagatacggtttgtatttatattctttacaatatttaaaggtttagattttaacaaaacgggctttatgatttttaacaaaaattttagcattgattttaggtaaaactaccagatcttgtggtctgaagggaccataaactctttcatcaactccaacaatagaatcaacatcatcaaatacaagcattgtaactagttctgaatctttagctatttttatagattccaagtcaacaaattcatcattatctcttgctaactcagatatatcatcttcaactttagcaggtttaatatttgacttttgaatttgtttttcaatcggctctgccttttcatcagtaattactttcgctttggaaatttcatcgattctatttaaaaccgcatcatcctgagaactttcaactccattatctaaagtagtgctttgaggtttaggagtttctttaataggagctttggtttcatttggaatatcttcttcagaagatagtttttcaagtgaaatgctttttctatgatttgttaaagtatcaattaaagaaaagtaaaatttttcttcctcgggagttaaattaagaggtgttgtgtcaattaaatcaaattgcggtttgcctgcaaataaatggtaagacctgtgaatattaacaaccgctgcatcagtaattttgtgttcacgtctttcacaaatttcagtagctattctttgagtatcttttagcagatactgttctgcagcaaatggatcattgcctatatgggttcttaactcatccaaatatttatgaatatccttataaaaagagtcttctacacgggccaatgtaccgttactacgctcttttttttgaattttacgtaattgttgaaagaattgatccacttaataccatctctgaggagtttaatataaaaataaaaaaaagtttatagatgaaataattattcatctgattctaatcttggagcaagtaagaaactaagtttaccatcaccagtaaccatattgagagttaattttaatggcatgtcagtacctaaaccgatttcagcttcttcagagaatttgtctgctttaagcatttccctaattttgtccagtgagaataaagatttttcctgagtgttgatattttcaccatgaaggtatttgacacttgcatcaccaaattcaccatcagcagatgctctaaagtaatcttcatcaacttgaagagctattttatctgagaaaatatcaatatcgttaattgcatcctttaaaattccaaagtgaactttgaaagatgcaggatgttcaagttctggaggagtaggattatcatattcaatatcaatcaatcttattttgaaagttcttgtagcatccccttcaaaagtaattatgaaattaccttcatctaaagacatgataactctatcttgagattttgcacgtttaagaacactcatgaattccccagtatcgatattaatcttttcaggaacatcacaaacatactcatcaaataaacttgcttttaattctaaatgtacgaatgttatatgactacggtctaaggcatctaacctcataccttcactatcagtttggatttgtacttcatcaacaatagatgaaatagcatcaaaactggtttttaatatactagaatcacttaattccgctttgaacatatataatcctctaataagaatttattaattattaattagataattatatttttatctttattacttataaaacattaggtcagtatttaaaaaaccacagcaattctaaaaaagaggattaaacagattatttcaatctgttaaccataacatcatgtgctttaaattcaatttcatcatctaactcttcaattgaatctacattatacttattcttcatagcattcaatattaaatagtccgcaatgtgagggttttttggtagaaaaggaccgtgcaaatatgttccaataaagtttttataaatcattccttcctcaccgtcttcatcattattgccatgccctgctataacattacctaaggttttataattatgaaatgtccttccaccatgattttcaaatcccacaacttcttttggggccaaacctaaattattttctattaaaatattgccgattaacctattttcctgacttaccgttttaatatcaaatatttcaagacaagagacattatccccattaacatcataatattcatgcccaaacatctgatagctgccacagacagttaatatgactccgtcattttccacataattttccaggtcatttctttgttttaaaaggtcattggaaacaatactttgagttctgtcagaacctcctccaattaaaattaagtcaatatcctcataatcaaaatccatatcatgatttagagagtaacttttttgattaaccttgattcctctccattcacatctttttttaatgcattttaaattaccaatgtccccatagatatttaaaatatcggaatacatatcaacaatgttcaattcaaaactcatgctttttcccctttaagtttcataagtacttttctagcttcaggcattgccgtgaatgttccaataatatatgccttatcattttcagctacaatttcttctacacacccaacaacatcgctttgatcttttgaatggcaaatttcgatttttgatgttggaaaatctgcatattttaatcttaaagctacttcttcagctcttgttccaacacagtaaaatttatcaatgtttggagtggcagctatttccttaaagtatgcatcccaaatccatgaaatatctttaccgtcaggagcataatcatttaaaataaacatgaatgatttcttatcttcatcaaattttatagttgagaaaacttcacttaaaccaacaggattcttagataaaaccaaaacaacatcacagccgtttacagatatcctttccattcttccaagtttatattcaaaattttcaatttgctgttttattaaatcataactgaaaccgttttcccttgcaagagcaatagctgcaagagcattggaaacattgtagattccaagtaaatttaagttgattttagctgattcctttttatctttaactgtaaactcatatcctccgtttttgaaggtaacctcatcaatcacataatctgcttcatggtttttagccccgcatttggaacatgaaaatttaccatgatttccataatttatatattcataatctaatttatgtccacatacctggcagaagactgattcttcaacatttgcactatctttactgaaaggatttttctttaagctatagtacacttttggttggtcagagtcttgaaaataaagagaaatcggactgtctgcatctaaaataagtgtggaattatgtcttttgcttgatttttgaactaaattaattgtgttttccacttcaccgtatctgtctaactgatctctaaaaaaattagttataattatgtaatcacttggcaaatatctggtaacattaggcatggagccttcatctacttcaaatattccccagttataatgatctcgatggttttgaataaaagagctagtaactcctgtaatcatattagaaccatttaaattagatacaatatcataatctttacctttaaaaatgtgatttgctaaattgtttgtagttgtttttccgtttgttcctgtaataagcgctattttatcacatttttttgcaaaatcatttaaaatatctggtttaacagcaagggctatttttccagttaaagatgttccttttctgcctgccatttgaacaactttatttccaatcatacccgccaatattgctatttttgacctcatttctaatcacaacatataggtaagttgttatttaatatgcctcatataagagtattaaattattctctaaatttatacattaaataggcatcatatttatatttttgctaaaaaaacacagcaaatatgcataaatagtgatgaatatataactattttaaaaaatatttgtttaaatattatttttatagtgcccttttacaataattaatcaattcaaaataactgttttttaattaattatactttggtttagataatttcatcaactaatttttaattttttgagctgtattaactattatcaacatttatttaataaaattttataaattagattttcattataaatcaatgatttattatttacaaaactgtgtaaaattttaattttattaaacaattaaactataaaattagcaccagttttacttttcaaagattcaatgttcactttcaaacaatttactcaattaacattccattttataatttattcagaaataattatcattgttattaagttaaactgatttttttatatttttaaataaaaataatatatttcaaagagttaaatgcaaattaaaatgattatatactaaattaaacataattacaaaatgaaaaaatataatagaggagcaaatttttcatgaaatttaaaaatagttatatggaaaattttctaaaattcttcatttgcatattagtatttactaaaaactgcatctaacaaagtagcagataatattggagagaagaataatggttagatttataaaaactttcatatatcatcattctattgatttgttaactgataaagaaaggaaaataaatgttatatttcaaattattattgtaacatttttttacattttcctttcaactattatgacttttaaacagaattatgaattttttattcccatatttgtaattggaatcagtttttgtatacctgaatttatatttaaaatatttctaaaaaaaatagacaaatattacaatgtatacgataaaatcagacccgacaaattttcatttgatggatatgcattagaaaacctaataagaggaattagtgtttcttcatcatttttaatcttttttatagcaataaaagcaacattacctggattttgtgtagctttttccatgatttacacagtaacattcatattcctccgaagaaaaaaatactgggagatgtttgaacccagatttgaagaagatccagacccagtgaaattacgaaaatttatcaatatattgtcaggtgaaggaggagtaatctgtggatgtgcttcagttggagcatgtttttatctaattgctaatagttttaatggaactgatcccataccagtaactactttgataattgtaacaataattgcatttattttattttcaatgtcattatgtattgatttatggaataaaatacttccctgggacttaacagaatttgaaattactgtactgttgcaaatggtatttgtattggagttacattactattggaatggttagtgactggtgtttggttagtttaatgaataattgtttttattgtattagtcattattaagaaataatttattaataagttgagttttcttaattaactgttatttagattgataaatgaattatgaaattataggatttaaatttaaaaaatattgtttaagaagtattttagggagttctttgattatgaaatgaatccaaatataatatttggttttataactatctttttttctttattttttgctctttaaaaaattggtgtgattttataaataatggagtctgtaaaattttataggcttatttgagtttaatgtgttttcagtcaaaatataaaatattattgtatacaactatgaatttaaacagcacatataattgtaaaattgattcatatgtttcctacctacaaaaaattaatgataatgaaaaagatgtgatggtggtgtgtaacacctgctgttgatacaataaaatgtatacgatattatttttgtaatttcaggtttatcctttttattcattgcaggctgttttcatagctgacacatattcttttaatggttctgctgcattttcaccatgctcctcaatgatttttacaatagcacttcccacaataactccatcagctattttcccaatgttagaagcctgttcaggtgtgttaataccaaatccaacagctaatggcaagtcactgactgcacgaatatcatctaaaatagatttcaggtccgtttttatttcactgcgcattccagtaactcccaaagaagaaacaacataaataaaacctgttgcatcactggctattttttgaatcctttcctttgaagttggagcaatcagagaaatgacatcaacatcattagataatgcaatgtctttgatttcacctttttcttcataaggcaggtcaggtgatataattccatcgattccaagttcaccgcattttttaaagaatttttcataaccataaaagaaaacagggttaatgtaagttaaaaatactaatggaacatctgttttttggcgaactttcctgactatttcaaatacatcgtcagttgttgtattatggcctaatgcccttatatttgcatcctgaattacaactccttcagccataggatctgaaaacggaattccaatttctattaaatcgcaacctgcttcttccattgccaaaatatattctactgttttttcaattgtcggatctcctgcagttaaaaatccgataaatgccttaccgtccttaaatgcatttgctattttactcatttaactcaactcccctatattttgcaattgatgctacatctttgtctccccttccagaaagacaaaccatgataatttcgtctttatccatttttggagctattttcattgcatgtgctactgcatgagcactttcaatagccggaatgattccttccatttttgacaagtattcaaaagcattgactgcttcttcatctgtaacaggaacatactctgctcttttaatatctcttaaatatgcatgttcaggtcctactccaggataatccagacctgctgagacagaatagacttcagatatctgcccatattctccctgattaaatattgatttcattccgtgaaatattccgatttgcccattagttaaagctgctgcattataaggagtatctactccttttcctcctgcttcacatccaattaatttaacatccgcatcatctatgaaattgtaaaatgctcccattgcattacttccaccaccaacacatgctaaaactgcatccggaagttttccttctttttccaaaaattgttcacgagcttcagcacttattactgcttggaagtctctaaccatcattggaaaaggatgcggccccattgttgaacctattacataatttgtatcatgaactctcccaatccaatctctaaatgcatcattaactgcatcctttagtgtttttgttcctgattttaccggatgaacttttgctccaagcaattccatcctataaacatttaaagcctgacgtttggtatctaactcacccatgtacacttcacattccatatccagaagtgctgctgctgttgctgtagctaccccatgttggcctgctccagtttcagctattactcttgtttttcccatttttttagccagtaaaacctgaccaagcacattgttgattttatgagctccagtgtgatttaaatcttcacgctttaaataaatcttagctcctcccaaatcttcagtcattctttttgcatagtataataaagaaggtctgccagcatattcttttaaaagtgtatttaattcttctacaaattcagaatcattcatatagtgataatactgttcttccaagtaaatcaattcattcattaaagtttcagagatatattgtcctccatattccccgtatcttccattattcatgtttttagcctccatgactttttttattttattttcatctttaaatccgtcactttcaacaccgctgcttaaatcaattgcatatggcttaaattctccaatagcctgagtgatgtttttgctatttaatcctcctgccaaaaagaattcttttttcaagtcttttctaatcaaatgccagtcaaaggttttccccgatccttttccactgtcaagcaacaaataatcagctaatgaatcatcatatttagacaaatccgtattttcagatacttcaatagctttaataatctttaacttataatctgttttttctttcaaagttttaatataatcttcgctttccattccatgaagctgtgccacatcaattataccatcattgtataattttaggatttcatcagtgcctgcatctacaaaaacaccaacactttgaatatcttcgcagagtttttccttcatttgttttgcaagatcataatttacttttcttttgctctcagcaaatacaaaacctgcataatctattttatacctgtttgcaagttcaatatcctccagtcttttaagtccgcagattttaattttaaccattcttcaactcccgaatcatcacctttttgtctggtgatttcattaaagtttcacctattaaaactgcatcaacattattttcttttaatctggcaatatcttcttttgttttaataccactttcagaaataaatataatatcttcatctacacatctacgtagacgaatactattttcaatatctacactgaaatcttttaaatttctattgtttacaccgacaatatctgcacctgcatcaattgcccttttaatttcattttcatcatgagcttcaacaatagcagacattcccaaaacacgagttatagtcaaatactgttccaattgttcatcagacaaaatagctgcaatcagcaatactgcagatgctccaagtaatttagcttcataaatcatgtactcatcaacaacaaaatcctttctgagtactggaattttaacatttttagctattttctttaaataatcatcagaaccctgaaaaaagtaaggttctgttaaaactgaaatagctgatgcgcctgcagcttcatactcttttgcaatgtttacataatcaaaattttcagctattaaacctttagaaggtgatgcctttttaacctctgcaataattgcaatatcatcactgcttaaagcttttttaaaaggataattgaatttgacatcaatattgagtattttatatttgagtctgtctaatgaattaacctttttattttcagatactctttcttttgttttttcaactattttatctaacatgaaatcaactgtttgtatattcgatgaatttttcaagctgttttttagccctgccagaatcaataatttcactggctaatctaacaccatcttctatagaatctgcttttcctgcaacatataaagcagctgcagagtttaaaactacggcatttcttttaggtcctttttggccatttaaaatagataatgtaatttctgcattttccctaggatttccacctacaaggtcttctttagaacatctctccattccaaaatcttcaggagctatttcataacattttaacctgccgtccctaagttcacaaacagatgttttgtcactaactgaaatttcatccaatccgtcctgaccgtatactgataatgcagacttaactcctacgtttttaagcacttcacaaagaggtttcacaagtgattcatcataaacccccaaaacctgcattgtagcacctgcaggatttgtcagaggccccagaatattgaaaattgttcttatagataattcttttctgactccagctacaaatttcatggccaaatgataattttgagcaaataaaaagcacagattaatctcttttaatattttcaagcttttttccggttcaatataaatatttacacctaaagcttccaaaacatctgccgccccacatttgcttgatgctgatctgtttccatgtttggctaccggaactcctgctgcagaaattacaattgaagatgttgttgatatgttgaaagtgttggatccgtctccaccagttccaactatttccaagacttcttcatcatttagtaatttaacacaatgagccctcatggcttttgtagaagctgtgatttcttcaattgtttcacctttcattgacagtgcagttaaataagcactcatctgaacctcactagattctccggacattatttcatccattgccccataagcttccttcgcatttaagtcatttccatttacaacttttaaaatagcttccttaatcatttaattatcctccttaattttgtttatgaaattttcaattattgtaattccgtcaggtgttaatattgattccggatgaaattgaagaccgtaaacattatattttttatgtttaatcgccattatttctccgttgtctgctgtttttgaaattatttttaaatctttaggcaaagtattttcaaccaaacttaaagaatgatatcttccaacagcaatctcatcatttaaacctttaaaaatagggtctttatttaatttagctgttgatgattttccatgcattaatttgctggcataagatattttacctccaaatgcatcacatattgcctgatgtccaagacaaactcccaaaattggtattttatcataaaatttcctaacaacatcaacacagattcccgcatcttcaggccttccaggacctggagataaaataatagcttcaggatttaaatctttaatttcatcagcagtgattttatcatttctataaacttcaatatccctatttacctgtccgattaattgatataaattatatgaaaagctatcatagttatctattaataaaatcataaaattcccccgtcagctatttttaaagcatcaataactgctgctgctttatttaaacactcgtcaaattcattatccggaacactgtcagctacaattcctgcacctgaccttatgaaaactttattattacgtgcaaaagcaatcctgattgatatgcaggtgtctacattgccacttaaatcaatatatccaatagctccaccataaatccctcttttattattttcaagttcattaataatttcacatgctcttatttttggagctccggacagtgttcctgcaggaagtatggaatcaatagccgcaagtgaatccagatcttttcttaaagttccagttactgttgaaccaatatgcattacatgagaaaacctctcaattgacaggtatttatcaacattgacagatcctatttcagatatttttccaatatcattacgtcccaggtctacaagcatattatgttcagccaattctttttcatcacttaaaagctctttttcaagggccaaatcttcactttccgtttttcctctaggtcttgttcccgctagtggaaaagtgtataattttctattgtttaatttaaccagggtttcaggtgaagcaccggctatttcaatgtcattacttgaaaaataaaacatatagggtgaaggatttgtagttctcaagaccctgtatgtatcaaacaagcttcctgaaatatctgcttcaatcctgtttgacagtacaacctgaaaaatatccccctctttaatgtaatctttagccttattaaccatttgacaatatttttcacgtgaaaatactggtttgaaatcagattttaatgtcagaggttctatttttgctttttttcctgttttaattaatctggctattttttccaaatcatcacaggctttcttatagttttcatccaaattgtctgttttcatatttgcaatcaaaacaattttttgtctgaaattatcaaatgcaacaaccttatcaaacaacatcaaatcaatgtctttaaattgatcctgattttcagcatcgaggtttagggaaggttctgcatatttaatataatcataagcaaaatatcccacaaatcctccagtaaatggaggcaaattagttaattttggagatttgttttgtctgaccaaatctttaataacttcaccaggattgtttgtttcaataattaccttatcatcatctgttaatttggaactgtcttcaaatttgctgtctcccttaatttgaacacatccattttgacaggtaaactctaaaagcggatcaaatcctaaaaaggtgtatcttccccatttttgtgaatcttcaacactttccagcatataacaatgtttactgatttcttttaaaatccttaatacttctattggagtagccatatctgagtataactcataagctactggaattcttttatattctttattttttgcaatttcttttacttcttccaaacttggggaaaacattttaatcactataatataattagaataatgtactatttaaatccttgttgtacttttttgtacattttaaaatatttgaaaaaaaattataatttgtcctgttctttactgaaatcaatgacaatttttttaatttgcctgctttccaaataaggaagattttcagtaagttccttttccaaattacgatttatttccatccttttttgaatatattcttcaccgtcatactggctagaatactgtttatttaaattagaatatttggttattaaaggctgaataaccctttcaatgtcctcatttaacttatcattaatgaatttttgctttttaacatccgccaaatatcctattaatgttataagaaatcctaaaataacaacagtcagtgcagaaaccagatatttgtaagaatcaataaacattacacacaaagataatcccacaacgattattgcaattcctatctttttagtatccatatcaaaaacacctaatttataattaattttcagcatatataaaatattattttttatctaaaaatttccactcaatctttaaagagttcaatatcaaatataaagatataatagctaaaactgtaattgtaatcattattaaatcattgttaaaaagtattgcatccttgtccaaataaaataaagcttctgcaaagaaattgttcataatatgtgcagcaacaggaaccagaatgttgtctgttttgatatacaaaatacacatacataatccgaagacaaatgctgaaacaatacttccatatccgtgaagaacaccgaaacacaatgaagatattaaaatagccacattaacagggacaaccaatttcaatctgtttaaaataattcccctgaaaattatttcttcagaaattggagaaattaaaacagttccaattaggccaccaataaaagccagattttttaaacttggaattaagttaaaacttaaaaaactttcaatatttatgctgttggccaaatacaacattccatatgaaaaaaagacatttacaataacaattaaaaacacatatcgaaattcaattttagaaaagatattctgattagtttcagccgaatatttccttgatttaatcagaatataagcaataataactgcatacatccattccatatctacattaaatccataaaaactagctaccatatatactgaataaaaacacaaaattataattaacagttcaattaaagtagtgcatttaattgccttattaaatgatggcataataacgaaatcctaaaataaaaaaagaggtgaaaaatcacctaatattataaagtaaaccttgacaacggctttggaatatctgcaagtaaggcattacaataaatgttattacaaaattaataattaaagttgatacaacaccggttgcagtagctacacccattataggaactgcagaaacagtagcaaatcctaaaatcattaaaactgctaaaactatacttacaacaacacaaataattacactaacaagtattatcattccaatatatgttgtaaaacatcttgaccaaccgatagacttagcaatatttgttatctcttttacatcaaatgcagctttcattgatccgtcatttgtagccatatgagaaatagctaaaaatgaatacaatgcaaataccaataaaataacaatccctactataaatccaacaatagttaaagaaatattattggcttggccacagccccatagaatacctaaaaatacaataattggaataattaaataacccacatacacaacaaaacatttaattccttcaaccagcatcaaagtccagtcttcaaactcaggaagttcatcattaccattaatcattccttcagtagctattttaataattctataattataacctaaaatgaagaacataggaatgattaaaaaaccaaataagtaaaacactcctaaaatcaagagattttttacatttttagatgcatattcaaaggaatctttataaatatctaatatcatctctcactcaccatcatcaatgatgaaaacatcctcaatgttttctttatctaaaatcttagttattctaaaggctaaaagtaaagaaggattatacctagcattttccaatgcattgattgtttgtcttgtgacaccagtcaaatctgccaatttttgttggcttaatcccttttcattacgaaattctttaattttagtttccaaaaaatcacctaagtttttttatacttagtaaaaaataatttactaatatatattagtattctatattataaatttaaccaccaaccggcatcagaaaatggttaattaagaataatataaaatactaaaaaaatcaatatataatattattaaataaactgagatgatataaaatggctatacatccaatcgaatacagatatggtactcccgaaatgaaatccatttgggaaactgaaaacaaattacaaagaaaactagatgtggaatctgctctagctcaggcagaaggaaaacttggtataattcctcaggaagtggcagatgaaatagcagctaaagctaataccaaatatgttaaattagaaagagtagatgaaattgaagctcaaaccaaacatgacattgctgcattagttaaagctattggagaagtttgtgataatgacgccggagaatatgtccacttcggagctacttccaatgatgttgtagacagttcaaattctttacttttaaatgattcaattgaagttttaaaagaaaaagtagaaagattaactaaaataatgcttgatttaactaaagaaaatatcgataaagtttgtattggtcgtactcatggtcaacatgcacttcctactacatacggtatgaaatttggtatttgggctgatgaacttcacagacaatatgaaagattagaaaatgctcaaaaaaatgtttgtgtagctatgatggacggtgcagttggtaccacagcagctcttggtgaagacggatggaaaatccacaaagaagtagctaatatattgggattgcctgcagctacaattactaaccaggttgttcaaagagacaaccatgtggaatttatttcaacattagctaatattgcaagtactttagataaaattgctctggaaatcagaagcttacaaagaactgaacttatggaacttggggaatactttgatcctgaaaaacaggtgggcagcagcacaatgcctcataaaatgaacccaattacagcagaacgtatttgtggtgttgcaagaattgtaaaatcttttgtaaatgctgcacttgacaacaatccgctctggcatgaaagagacttaaccaattcctcctgtgaaagaataatgtttccggaaagctgtattttaactgattacatcctcagtttaactattaaattaatgagcaatttagtattctatgatgaaaatattgaaagaaatttaaacttaactaatggattaatcatggctgaaagattaatggctgaacttacaagaagcggaatgggaaaacaaaccgcatacggaattgtaaggagaaatgctattaaagctaataaagaaggcggtcttttaggagaacttatcctagaagaggaagatgttcaaaaatacttaactcctgaagatgttgaaaaaattatgaatcctcatacttacataggttcatctaaaaccattattaatgaattacttgaacaatctaaagaatggtttaaatagaacatatacataataagtaatgaggtgaaaaatatgagtgatgtaaaaatcttaaaatctattgatataacatcctacaccattatgggaactggaattggagtattattctcagttttattctccataattctactgatagctataggcatattaaacgctcaaagtattggagtagtagcttatattatcccaacaataatcgttggaaccataatgtgttctatatataatagatttgcagaaggatatctttacaattggttaacaaaaagaatgaatccaattacttttgaattaaacgatgaaaaagagattactaaaatttcaactgtgccaaccgcacttattgcatcaattataacaacaattcttgttattttactttgtgcaataactatattcattgctccaattatcatatcagcaatagttcaaactttaatgtttagtggacaaactgtaatggcatttgcactttaccaagttgcagcaatgataatgcagccatcatttattgcaatgtccataatcggatcattcatcataacttttgtatttaccttaattgctacatacatctataatttacttggaagtaaaggcaaaggaattatccttgatttatccaaagacggtgccatgacctctttaaattctattgacccagtaagtttaattattgtattaacagtaatcagcctaatattcaacattattttagctatcattactttaattagtggtggaaatgcttaccaagcattaggtaatattgttggtggattaataaatggagttataggtggaggtcttttagctatattctataattttttagctacaaaacttggaaaattaaaaatagagttaattgacaattaaatcaattaactttttgtttctttttttattgcaggaacatatcctttaagagcaagtgacagggatatgactgttactgaacttaatgccattgcaagagcagaccattcaggcatgaacattattccaaaaccggcataaagcgctcctgctgcaagtggaatcagtataacattatatgcaaatgcccagaataaattttctttaattctagtcattacctttttagaaaactgcacagcagcaactacattttccaaatcaccttccattacaacaatatcaccactttccatagcaatatctgttccgttacccatagctacaccaatattagcctgtgtaagtgcaggtgcatcattaataccgtctccaacaaataaaactgtcttgtcttctttttgaagatttttaacaatatccaatttgttttcaggtaaaactccggcacatacattatcaatacctactgcactggctacagttgatgctgtttttttgttatctcctgtaagcatatatgtttcaatgcccattttatgcaattcttcaatagttcttttagaattagctttgattttatcagataaacttaaaatacctttaatttccctatcaacacctattaaaattatagttttactaaggtcctccagtcttccatactcttccaaaacactttgaggaatttcaatatcctgagattctaaaagctttttatttcctgctaaaatatctttatcattaacctgagcttttaaacctttacccgttatattttcaaatgatgaagttcgaataagttccagattcatatcactggcttttctgacaattgccttagctattggatgattggaatttttctctacactggctgcaagttcaaccaattcattttcactaattccataacatataacatcatccacttcaggctgaccttcagttatagttccagttttatcaaatgctgcaacatcaattttacctgcattttctaaagtatctccatttttaataagaataccaaattctgcagccctaccaacacctacagttactgctgtcggagtagccagacctaatgcacatggacaggccacaactaaaattgaaattaaagttgtaagtgcaaacaacaaagtagagtcaaatacaaagtaccacagcaggaatacaacaacagctattgttaaaattgtgggtatgaaatagctaactgcagtgttagctaatttttgaaccggaggtctggaactttgagctttttcaactaaacggataatatttgacaatacagttttgctgccaatttttttagctttaatgtgtaaaacaccatcctgattaatagtgcctgcaaatacttcttcaccatctcttttagctttgggaattggttcaccattaatcattgattcgtcaacataagaatgtccgccgattacttcaccatctacaggtattttatctcccggacgaacaagtaaaatatcgccaatttggatttctttaatattcacctctttttgagacactatattcccattactgtcaagttctattaaagtagctgctgttggctgaagaccaataagttctcgaattgaatcagaagttttctttttagcttttgcttccaaatatctgccaataagtaaaaatgatggaagcataatagctgtttcataaaacataaatgaatgatcaagaactatgttaaatgttcccaaaatacttgatatgtatgcaacagttatacccatcgaatacatcacatccatgtttaaattcttatgaacaagaccgttgaatcctgctttaagtgtaggtaaagatacataaagaaatggaagaatacttatgattaacgaagttattcccatagacaatccaaacggatgccagtgaatatacattaaagccattaaaacagctgatgctgcaaaaccaactataatcctatttcttttatcttttaaatcatttttataaatttcatcttcatttatttcaagttgcccatcaattccaagtacttcaaatcccaaagaattaataacttcttccatgtctttgacagttacttttgttttatcataattgatacgtgctgtttgtgaagttaaatctgccttaacatcaaaaatgccgtctaaacgtattaaaaagttttcaacattcatgacacaggaagcacaatgcattccgttaagtttaagagtaacctcatctgtgtgaagttcaaatcccaaatttttaactaatgtttcaatttcatcaaatgggagcttttttggattgacagttaaatgtaatttatttgaagccaaatctgcatctactgattccactccttcaaccttttcaaaagttttatttaaacttaaaacacaggaagcacaatgcataccttcaataggcaaatccatttctttaagttttgccattatatcacaaccaaattttaatagattattttcagattaaaattaataatcacacatatataaattgtatacttcttaaataaaaatttatgtatacctaaaaaaagtttaaaaaaagaaaattaaatgtttttaacaagacatccattctgaataacctttaatatattgtcattgtcagctaaaatacttacatcatctaaaggattgccattgactaaaattaaatcagctattttattttcactaactgaacctaatgaatcttttttacctataaattcagcagcatttattgtcccgctagctatagcttcatcattactcattccagtatctgttaaatgaatcaactcttccagattatgaccatgggcaattactccactatcagttcccattaacaaatccaccccttcttcataagcaacagatatgttttccttgtgaactttaactatttcttttaatttggctgttttttcagctgcataattatcccatgcaggaaatccgctatgatataaaaaatcatgaacaagcattgtcggaactaattttacattattttcagccattttatgagatgtttttttatcaatgaatgttccgtgttctattgaatcaaaacctgcatcaacacagttattgattcctttcagactgtgacagtgagctgaaacctttaaatcattaacatgagcttcctcaactattgttttaagttcttcaacattgaactgaggataatctggagatgtgtttgttgttaagactcccccactagccattactttaataaagtctgctcctgctctttttatttcacgggtcttttttaaaacttcaagaggcccgtcacaccttcctttaggaaatcccggataaactatttccatatcaaaaccagaaggtaaaaataaatcaaaatgtcctcctgttgatactaaaggagtaactgaaatttccattttaggagctataaataaaccttttttttgagctattttaactccgatatctgcagggccacagtctttaattgttgtaacacctgcatcaactgtctgttttccatgtttaattgcattgtaaaaatgtagtgctaaaggatttgccatgttttcttctttgtgaaagccattagccataatatgtgcatgacaatctataaacccaggcattagataattatcctgcccatcaatgattttaacattgtttttagtagaaactttctttctagatatttgtttaatgtgtttatcttcaattaaaacattgcatgaagtttgaatttcttcattcggatttaaaatgtttacatttttaattaaagtttccataataaccacattatttataaaatagctattttaccattatccccatcaacttcaactaaaacaccatttttcagttcatcagtatcttccggagagtcgaccataggtatatcagacattatagcaccagtagcaataatcggttctgcatttaaacatataatagctttaggtgcagtattattctttttcatttgaaatataacataagaaccaacagttgaaccttttccaccaggaatgaataaaactttgtccttaatggattgacctttaagttcatgatttggatcaattacaatgcctgttttaggatccacacctcccaaaaaactaattggctcactgcttactattaattctccactatcttttcccttagcaatatttctacaatcaatcataaaaatcaacttaaataataattctttgatataattttataaaaactattacttaaaattaaagagcatattaaaataaaatgaattatatgaaaatttcaaaaccaaaaaaaatcatgcataaatgattttaatgaatttattaaaaatttaaaaaatgaaaaaagagccataaatctaaacaacatcttttttcatgacttcccttaaaacagctgtagcataagaacctttatttattgaaaattcagttaaaacaccttcatctgttggaatagctgaagcatcccaaacttgaattctcatagaccttcttaaaccatgacttcctaaacgaggcattttaggaacttcaaagtcttctttagttaaattatagctatttaaaactgatttttccatttcaccaacttcaccaccggcaaaaggtactttagttccatataatggagaagtaggattagcttcaaaattatcaattaagttttggaactcttcaggagttttatcacgaactattctctcttcattgtcaatgataatgtctccttcaacatatctgttaattcccatagctacccttctgctaactgcatcattaaataaataagattgatatgcatggacaaacatcctttggagaggttttggaagtgcatgcaaggcatttttataagctttatcatctaatggtccttttttagcatatttaatcagttcacgaaccatcattttctcataacgcattcctttactcatcaattccaaagattcttccaaatttccatcatcataagcttgtcttgctttttggttttcttcatgttcttcacttgtaggatttccaatgtatcttctaacagcttcttttaaatcattttgaactaaagcttcacctaccaagtgagtgtttgttcttggcttaccaaatctttgccagccaaagtaattaggaacaccagtaacttccaattcctttaaaatgttattagctatttcagcacttttttcaatatcatcaatatcccgaataagaatttggaatttatttccctttagctgtcccatcctaagttttttacgtccacgaacaacctttaaaaaatcagttttataaatggttccttccaaatccttaacttgcctgaactgttcttcagattccatattagatatgcaaatccactgacgggtacgggcttttttatctttcattcctgcaaagcccattctttttctactaatatgtaaatctcttgcaatatccaaaacaacatctaaagtagtcctacctactttctcaatccaaatccaaatattaggcccttcaccagttggagtcatttcagggatttcttcaacataaaaatcttcatactgatttctaatagttccgccaatccctttctcattagttacataagtattagcatttaacattgtatcacggaatttaaaaaaattatataatgccccgaccgggatttgaacccggggaataggatccgcagtcctatgtgttatccaaactacaccatcggggcgacattaaaaatagttatcagttaatattatgattttaatagtatttaaataaaactattatattctataaaaaatactaccagatatataaagtataggaataatctccataatttcggctagctacactaacatcctcacctaatgctccggaactggccagtacttttccgcctaaaacattgttttccttaaactgataattcttaagacctaatttcttgaacttctcacgacacagcttagaaactttccttacagaatattttgaattatgattttcatctaaaatactggaaatatcttctatgaaaaccctgtctgtagaattaatccctgaacttaataactccattgtatcctgagctgatttgaaattatgtgaatcactggaataattcggattagacatagaaacaattgaattaaccattaaaataactataagtaaaatcagaactgctaaaaatgcatcaataatgtagaaatatcctttttcatctttcataaataaggattataataaaaaatagataaaatttaaagaagtgtgaaaaagttaattttcacggatgtgttttaccactttttcttttttaagtatggattcgtcacatgccttttggactttttctttcataatttcaaagtcttcaggtgttgtgtctccaacgaactttttaactttagtataagcagcttccctaaataatggaaccagcttttcaacatttccgtcttctttaattaaattcggttcaccagaattatcaactttacctatttcacgaatagggacatcatattttgctactgcctttttaatatctccaacaatttcaggaggtgcaatcagcattaatgaatctgttgaaactcctaacggatctatatttaatgtttcaagcatgtttaatacttttggagcaacacagtcacgaatttctttttcatagaactccaaacctactcctgttgtattggatatttcatgggcatctccacgcaatcccccatttgtcacatcagtcattgcatgaatatctttaattaaatcagcttcaaaaagtgcatgtgatgcctgaacaaagtttacatttaatgtatcccatattacatcaaaaaatccgttatataatgcagttgttgtaatggttcctccaccagaaccctctgtaagtaaaattacatcaccttcagttgctcctttccttgcagttggcggataatcggatacaccaacacttcctacagcagaaacaaatctatcacctaaaaccatgtctccacctacacgcaatgtacttccagccactattggaacatcaacaagttcagacactgcagctacacctgcagtaaagtcaaatatcttaccaacatccccatcatctgccaagtgaacatcacttaaaatagctacaggatctgcccccattacacaaacatcccttaaagtagcccttgtaacatgaaatcctcctaaaaacggatagtcacttaaacgtgagtgtattccatctactgcagttgttacataaacatcatcgtttttaactggtgctttaactactcctccatcgtcctgttcagaaggatttactaatgaagcagtatttgtacttgaaacaatttctgcaatttttctgtgaacgaagaaatcacctgctcccctggaacctactcccatttttcccatagccacatctgctttcggaatatctacaatttcttttaaaaaatcatcatcaagagaattcaattccaaagtagtttttacttcatcaataacagcttcagccattttacaggagttttcttcagacaaatctttgtattctctaattctacttgccaaaagagcagtcaaatcttcatatgtgtaatcatcaattctttttcttacaaaaccttcaatatccataaatataatctccaattataactctaaattaacaaaattctttaatatctttaaacctgcaactccacttttttccgggtgaaattgtgttgaaaataaattattcctacttaatgctgcaacaacatcaattccataatcacaggtccctgcaattatttcatcattatccggaacaacatgataagaatgaacaaaataaaagtactctttatcaacaccttccaaaattggacattttttaacaacatctaatttattccaccccatatgaggtattttaagtccttctggaagatagcatgcatgaccttcaaataattttaaaccgtcaacatcaggactttcttcacttgagtccataagaacctgctgacctaaacaaactcccaaaaatggtttatcatcatctacatgttcatgaattacttttttaaattcttcaagattttccattgcactgccaaaagctccaactcccggaagaaccaaataatcactatcagctattttttcaatgctgcttgtaatttcaacatcacagccgatttttttaaatccattggaaatgctttttaaatttccgcttttataatcaataattgttatcataattctacttccagtcaatagctgacctaatcattcctccaaagtcagaaaaaacaattttatcagttcctaaagtttttgagtgagcatcaagttctgcaactacattatcatatcccaaatctcttaatggttcaactaaacgaggaccatcagttacagctattgattccccttcaatttcttcaacaggaaatgcatgaggaacaccgcatacaacatacaaatcaacagggttttcctttaagtagtctgcagcaacttttccggttacaggatattcgtccaatcctccagtaatataatcaatatccgttttcagtccctgtttaatattaactgcatgattcctaattcttgaaagaccaatattttcatctaaattagctacaattattggtttattttcaggattgatttcacgataatcaaagtttaaaatatctgcaaataaataagaagtttcttttttagcattcaatacaaaagcaacttttttattgtctcttagtgcctttatgatttttttagccacttcttccttattatcaccaaaattaggttgaatatattttccctgagccattcccctggttttttctatttcagtagcttttttaagcatttcaatttgacggtctgcctcttcacgaggaattataccatattcaacagcagaatctaaaaccattattgctccttcagtattatctccttcaccaaatcccccgtgagattcaacaggaataactgtacaatctaaattagcattagctattgcttcttttaagtcttcaccaataatcatactagcacaagtacctacaacacctataaactccggtttaaacatatcataagcttcttttaatgtattttctagtttttcactagctcctaaaataaaatcattttcagccattgccgtagttaaaacacgtacaccgtcactttctaaaagcctgccagttctaaaacaacaaccatgaggtccatgcattataataacatcaacattcatgtctcttaaagtataaagagatgcagctatgggacttggtcttggatgcattttttcacctattcactaaattttttatatataatattaaattttcttaatttataaaattaagttttaatagtataaataacatatatctaatgtatacaaattatgtcaaataaaaaaaggagataaaatgaataaaaatgtagcgattattctttcaatagccgccatattcattacagcaacctgtgttggagcaactgtgattaatagtgacgtagatatgaaacaaaatacatttgacggaataaagataaatgttccccatgataccgaatttatacaaatacccgacggatttaaagaaaatacatacggaataacaattcacacatttaaagacaatcagtcaatggttaatttcttaaatagtttgcaagatgcaaaaattgtatctttagcagatcaaccaccacaatctgttgcatttacccaaggcgatactacaaacatattagtaactaatggaaaagaaggaatatgtgttggtgctagtgaccaaaatttagtgcttaaaatggcaaacagtgtaattttcagcaacggacatccatctgaaagaaatcacggagttatgggagtaggtcaaaaacatcttgataaagataaagatttcaaccttatggttgggcttatgattatagtagacaattctgaatttaacattaatttatataatacagcaatagctgctacagtaactgaaactaatactattatagacaataataatttcaactttgaggaaaacataacttcagatccgtcatctgaaaatatgactgctccggaagagaataaccttacacaggaagaatgtgaagaaatggtaaatgattacttggaagacacaaactgttccataagcagtgtagatgaaaatgatggagtatacacattccatatagaaacacaggacggtcaaagtgccggagtaataactgttgattcacaaacaggagaaatgaatacagaagaatttgaaattcctgaagaatcagatgaagacatgtattcagatttaaatgcatatgatatggaaagctttgattatgatatggaaagctttgattatgatatggaaagctttgatttctagacatatgtgaaatgcgggaagtaactttccccaattattttttttatagatgatagtatggacttgaattcaaaatcagtagaagaaaaaatcagacaataccgtgtttttaaaagctgttcccaatcaacccttataggactttgtgaagtagccaaccatccaatgagtcaggcaagattatgtgcattagctagcgggttttcaggaggaatcggcggcacatttgatgaaggaacctgcggtgcactcacaggagcattaatagcattgggatttttggaagatgatgaaattaaaataaaaatggatgctaaaaaactctatgatgcttttaaaaaagaatatggttcagttcagtgcagcataatttcaaaaaatggagaagacaaatctccatgtgttgactgctgtgtttatgcagctaatgaagcaataaaattattaaaagaataacttcttatttttacttttttcataaatacttttcaaacactcttagaaaaagaaaatactatttattaaactaaaataaaattatgaaaagcacagacattaatgaaaaagttcttgatgtttatgggcaattgcctcttgattggcttacaccagaagacatatggtggaatactttaagaaaaattttaaatgaattagatgaacctgaaagtgttaaaaaagagatttatgcacaaattcaaaaagatattacataaagaggcagttaacctcttgtaacaatacttataacatccttatcctgcaattcataatctgcagcaattctcatatttttacgagcatctactgcatgcataaagttatcaccaatatccgaatgaacaagataagccaattctttaggaaccgcacctttaggcactaaaattccatcaggtaaaacatttcccttttggtctgtgtatttgtgttcatcctgaaccggataaactacaatcatattaagcaaaccaaatatagcttcatttaatgctgtttgaatacctgttcccccgtatttttctaaaatattaactttaatatactctaaagctttaagctgattatctgacaatttatctttttctaaaatttcaaagtcagaatctccaggagtataactaatcagtcctgcttcagctgctttgactaaagctatttcagattctgcagatgcaggtataacataaggatatttttcctgcattcttttaatgttttcctcagcagttggcaaatcagccttattagccacaataagcattggtttagctatatgcaatatattacgaataagttccatgaaatcttctttttcccatttggtataatccggattaactttccttttagcttcaataatatcttccagagttattccagtaccagacaactggtcaaaaatcactttagctatgtctaatttttcagcttcaattttacgtacaagtctgacccagtttctgttaagaattccatacatccacattacgatttcatcttctaaaaattcaatatcatctaaagggtcatgagatccggcttctacactttgtccttcagcatcggtggatccagaagcatcaataacatgtattaaaactttagcctgcatcaaatcatctaaaaattgattacccaatcccttaccttcatgagctccaggaacaagtcctgcaacatctattaattcaacaggcaacaatctttttccatcaatacatatggaatttctaggattacaagtaacattcaattctttacaaggacattcactaataacatgagcaactgctttattagcatcaatagtagtaaatggataattagccatttccacgcttgaagaagttgcagagttaaagaatgaagattttccaacatttggttttccagtaactgcaatttgaagcataatatcacaataaaaataaataattaattatatatttaagatttaaattatataaatctaatacaaaaatataagtgaaataacatggatggcaataaaccctctgctctaaaagttcgtcaaggattacaggaattcatgacccagtcaagagaaatgagctttggaacagaatttagcaaagaattctttgatgttgttaatgttgatgttgaattagacaacttaggccttgcatttaacaattataaaataatcaatttaacagacatacacattggccaatggttaaatcccgagtatttggacggagttgttgagtatgtaaacaccttaaaaccagatatgataacactgaccggagattatgtttcatatattttagaaggctatgaaacagatttaaaaaaatcttttaaaaaattaaaggctaaagatggaaaattggctgtcttaggtaatcatgaccattggcttggagctagtgaaatgagagacatcctaaaaaaagctgatgttaaagatttaagcaatgatgtctacacgcttaaaaaaactggaaaaaacgacaaccatgaaaaactgctcaatattgcaggagtagacagctatactgttggtgctgatgatttgaatagtgttttaaacaaattacctgatcaaggagctgccattttacttgctcatgaaccggattttgctaaaatatcctgtgaaagtggaagattcggacttcagatatcaggacactcccatggcggacaatttattattcccggaaccaatatagcaccattcagaggtccaaaatcaacaaggtaccctgttggaaagtataaagttaaaaatatgattcaatatacaagcagaggccttggaacaaatatgttttggatgagaataaactgcaaacctgaaataacattattccacttaaaaagcaatgaaaaacaaaaaatagaaattaattagattaatatggaaaataccaactattcaaatgttaataaagctaaaataatcctaacttcaatcataaccggaataattaacatattaatagtcatagctatgccaatgcttagtgctgattttgttttaggtccctggacaaatgcaataatcataattgttttattaaccgttgcaaacacgattttatggcccatttttaccaaaatcctgatgaggttttttatcataacctttggaataggagctcttcttttaaacggacttatgttttatggagttgcatattaccttccggaagttaaaataggaataggaggagctttaattgcaacattattcataaacatagctacaacacttatattcaatatagcaaatattgacttctacaatagctacatcatcaaaaagctttctaaaaaagttaaaaataaaaaaagagctgccaacaaacatcctggattaataatgcttgaaattgacggattagctaaggaaatcctagatgaagccattaagaaaggatatatgcctacacttaaaaggtggattgaaaataaaacacataccctaaaagaatgggaaaccgacctgtcaagtcaaacaggcgcaagccaggcaggaattttacatggaaataacaaagacattatagcttacagatgggttgaaaaagaaaacaacaataagattatagtttcatctaatttttcccatgccccactaattgaacagaaaatatctgatggtaacggacttttaagtgataaaggagccagcagagcaaacatgtttagtggagacagtgatgatttcatatttacatcatctaaaatcatagaacttaataaattatataacaaaacatggtactcagtatttaccacatccaatagctttcagagaatatttgtattattcttatgggacattcttaaggaattaaaatcccagatagtccacaaaattaagaatatacagcccagaatgaaaaggggaattgtatatgcaactttaagagctggaggaaatgtgtttttaagagaagttgtaacagaaaccttggccggagatattcttaatggagaaataaattcagcctatgcaacttatgtaggctatgatgaagtggctcatcactccggaatacgggataatgatgtttggagtgttttaaaagaaattgatttggaaattaatcgcctggaaaatgccgaaagtatttccaaaagaccttatgaatttgtaattctttcagaccatggacagggaaacggagctacatttaaacaaagatatggaataactttaggaaactttgtaagaagatttttacctgaagatatgaaatcattaaggacagatgaagaatcagaccacttcagaaattcatatattcctaaaaatgaatctattgaaaatataagggaaaaaatggacaatataaaaaatcatgacatttttgaggagtatgaatccctacaaaacataaaagaaaaaagtattgattttttaaaaatcgacgaattatacaaaagtgaacaaatccagacactcagaaaaaaatatagtgatagtctagattacattagaggatacgaagcttcacaacatactactaaaaaagcatctgactctgaattgattgttttaggatctggaaacttaggtttaatttacttaacacaatggaaacatagattaacctacgaagaaataatatcattattccctgatttaattcccggacttgtaaaacatcctggaattggatttatactagttaattcactagctaatggaggaatggttattggaaaaaatggtatttactatttggaaagtgatgaaataatcggagaaaatccattagctgattttggaaaaaatgcttccaaacatcttaaaagacacaatacttttaaaaatatgccagatattcttgtaaatagtttctatgaccctgaaagtggagatatctgtgcatttgaagaactgataggcagccacggaggacttggtggaactcaaactaaaccgtttatattatatccttctgattgggattgtcctgacgagcttgttggagctaaatcaatatatgacttattaaaaaatggaatgaaaaaactaaaagaggaataaaatggaaaataaaatttatataataggaatcggcccaggatcaagtgaatatttaactaaaaaagctgtagatacagtaaaaaccagcgattatactgttggaagtataagagcaatagatttatttgatgatgttaacaataaaattgcatttaatgtaaaggatttattagataaacttgaaaaaggagtggatttagctattgaaggcaataccgtgtcaatattatctactggagatcccggattttcaggtgttttaaatactgttttaagaatagctaatgaaaaaaattttcctgaagaaaaaatagaagttattcctggaatcagctctcttcagctagctgctgcccgtaaccacattcagtgggacaatgcaaatgttatgacttttcacggtagagaaaacatagaagacattttaaaagtcataaataacggcaaaacaacaatagccctcccgtctaaaaaagtcagagacatggctcagtttttattggataacggtgtggacgaacaccgtgaagtagttgtctgtgaacgtttaagttatgatgatgaaaaaattgtccggtctacattaaaagacattgcaaacagtgaatttacttacatgtgtattatggtaatatattagaaatatttaccctttaaattcattttaaaaaccatttaccatttaattttaaaattaaaacttttataattagttaatcatagtttatgtgttaattttttaaaaaaagttaacagttggtagatactatgattagaaaaataaacttaataagtttcattttcctatttatttttttgataggcactgtttctgccacaacaattgaaaatgaaactcaaacaataaacaatgatttagaaatcagtgacgacgagaacattcaagcaatagataatatagaaacatcaaatgaaatactttcgacaccaaaagctaaaacactaaccataattaattcaccacccgttgaaatgtattataaagacggcagcaaacttatagcaacattgaccgacaataataactatatgcaccatccaataagtaatgccaaagttataattaatattaatggagttaactacaccaaaattacagattcaaggggtcaggttatgttatccctaaatttggaatctggagagtatatggcaaaaataatatttgaaggctgtgatttttatcatccctcaagttcaaattccaaagtaacaatcaaacctacaataaatggtaatgacattgtcaaataccataaaaatgatacacagtactatgttgaatttagcgacaaaaaaggaaaccccataatcaattgcgaaataacacttaacataaacggagtattttacaaaaaaattacaaatatggcaggaatagctaaactaaatataaatttggatcccggaaactacataataacttcgtacaatccaaaaactaacgaacagcgttccaataacataactgtattggcgacaattagctgcaactatgacctggtcaaatactacaaaaataaaaaaacatattcagtttacctacacaatttagacggcagctatgccaaatattcaaaagtaaccttcaacataaatggagtattctataccaaaacttcagacaatacaggttatgcattcttaaatattaatttaaacccaggccattatataataacagcaatgtacaacagctgttttgtttcaaataaaatacttgttaaacctacaattcagacaaatgatttagaaatgaattttaaagacgggagcgcttttaaaacatttgtaacaactaatgaaggaaaacctgtaggagctggagaaaatgttacatttaatataaatggagtattttacaccaaaactacaaattcaaacagtattgcatctctaaacattaatttaaaccctggagaatacataataaccagccattacaagaatattcaaattggaaataaaataattattcaccctgcaaattcaacagtcatatctgaaaacttaaacagagactttacctatgaaatagctattccgaattatgtaaatgtaactcttcctaaagtagaagccaaaaataattatacagttaaacttggagaaaagggaattgtaaaactgccaaaaaaacagatatttgaaatcaataacggattgaaaaattatattctttcaaattatgaaacaaacgataaaacaagtatattgattaatgacaaatatgttttcatacctcttggtgaaaataaaatcaaaactggcaaaaccgcaagaatccaaaaaggcaacggcattttaatttattccagcgaaaattacacctatattcaatattataatagtgctgagagagacatcagtcaattcggagtcactatagataaagaaggcaaaatgggtgaaagaatcaattacattgaaaatggtgaaataagagcaagtgtcctatttaacactattggatttgatgaatatggaatcagatataatttagcactagctaatggcttagatcctgaaactgaattaaattccaattatataatacttacaaataataaaataagcccaataaagttcacatcaactaataaaacaataacattaaatacagctagagaaaaaatcatcggatacataaccaatgaaaaaatcaacactatatttaaaacaaacaacaatttagttgaaaaaacagaaaccataacttacggaacccatcctaagtataatgcaaacaataactttgaaatagttcagtcctatgccattatcaactccaaaattaccccaacagacatagaaaacttagcttttggacttgattatttaactagctataaattaaaatatgtgcagggaatgtttttatccggactaaatactgcttatttaagtgatttgaatgctgacaaatatgctgaaaagttatcccttaactggcagcggacaaaaacagcagttgttttaggcggaattgataatgacaaactttatatccacatagccaatccaaatatggggatgtctgtaattggaaaaaatgcaactaaaataactgaattcaacttcataacatctctacttctatcaaaaatagaacagcaggtaatgaaccctattggaattatttacagcaatgacatgaccagttcatttgatgaaatgatggatgcccttctaaaatcagaagttaacctcgtcaatcatggagattcaatatatgtattttgcaaaaatggaaacaaatcagtacttatcctaaacacaacaacaggaatctgcaaaactgttctggttgatgatgattttgcatataaaggagctactcaaaaaacagacaaaggtgaatgtacagtctgcataattcccaaattgtttgaagaaagcttaactaatcaactaaaaaacatcagaaaatttgtagacaacggaataatccaaataaataaaaatattgataattttatgaaaaatatccacccatcaactataataggatacaatattggtgttttatctctaaaaattcttggaggagctgtttcaggaatttcaacaattgtatttttcccagctacctttgcaatagcatttcaatcagtggccaacaaatacagagtgacatttgttgatgaagacgacacccattattggtacagtcattttacaccaagcagaccaggttattttcaggataccaagttgtttttaattcctaaaggaaaccaggaagtggactatgtcgaagtacatatcaattcggacaattctttaaaccgtagccaagcgaaatatataagcagtggtaatgtaagaaacttaaccaaagaagaaacataccagtattttgatgaagaatattgggatccacttaacactcctagaaaattaggaaaatattaaatggtggtgctatgggagataattggaaaaaaataaaagaaaattttcaaaataaacctgcaatatcaaaagtgctttattttttaacacttgttgtattggttttgattattcttgtagaactttgcggattacagttcccaatagatattggaaccctaaacatggtcttttgggtgttaatagctatatttatcctggtagaaatagtgtataaattaaaaaaataaaaaatttaagttaaaatgttatattttaactttttatttctttttttaaagctgaatagcttcttgtttaacttcagtattatcttggtcttcgtataatattttagctaagttcaataatttttcctgacctttaatttcatctttaaataaaggaacttgagctataatttgttctgggaatttttgatcaattaaagctaaacgtttttgttgtagtctgtgtcttgaatggcagaaatcacaatctgtaatatccggcattacctgatttacaattacactatctacagtaatgttatagttttctaaggcgcctaatgctctttcagattcatagatagacatttcttcaggaattacaaccattttaaatgtggttctgtccggatcagataaaacttttttagcttcatcaatttgctctttagttctttttagctcttcactagtttgtggattatcggcagcatccataaacggaataagattttttaaagaattagctgcagaacctaatttggctttaatcatcatcattttacctacccaagagtccattacatcagggaatgataataatcttaaggtatgtcctgtcggtgcggtatcaaatactacaacatcatattcatttgaagtcatgacagataaaaatacttcaaatgcagctgcttcgtcagcaccaggagaagatgatgcaatatccatttggtcagacaagaagtctaatcccattaaactttctgaagtggaattagctttttgagcatcaagaactgcttgtttttgagccatagcttcatcaggatctatttcaactgcaaataagtttgttttaatttccctaggataatggccaataggcacttccaaagagtcagacaatgaatgtgccggatcagttgatacaattaatgtttttttaccttgttctgctaaccataatgctgttgctgaagaaattgaagtttttccaaccccaccttttcccccaataaacataaaagttgttttatctttgttaaatttaaaataatctttaaatgccaagaaaattacctccatattaaaaaattaattttagtaactaaaagtaattttataattttttcctatataaacgtttactatctaatatataagttaaaaaaatcataataattatcattaaaaattttccaaggagtgtaaaagcatgaacgagcttccgaaattagatactaaaacaacaaaagaaagcataattaaattcattcaagacaaagtatctgaagctaatgcaaaaggacttgttgttggattaagtggcggaatagattcaacattaactgcatatttagctacagaagctgttggtaaagaaaacgtatttggaattgttatgccatctacaaccaccccaacagaagataaaattcatggaacagacattgctaaaatattagatattgattataaagaaatggctattgacagtgttttaaacgaatttctatatattacacaatataaaacagaaaacgaacaattagctattggaaaccttaaagctagaattagaatgtccatcatatattattacgcaaattcaaaaggttaccttgtaagtggaaccggcaataaaagtgaaatactaatcggatactttacaaaacacggagacggagcctgtgatattgaaccgattggagatttatacaaaactgacgtgtttgaattagccaaatatatgggagttcctgaagaaataatcaataaaccgcctcgtgctggtttatggaataatcaaactgatgaagatgaaataggaatgacctatgaaaacttagataaaattctctaccagtataacgataaagaaacttcaaaagatgaaatagctaaaaacttagatatttcaattgatgaaattgatatgattataaataaagtaaaaaggaatgctcataaaagcaaagttcctgaaagccctgaaaagactgtaatggtgatttagtgacagaaaatatagaaaaaaaatggcagaaaaaatgggaaaatgataaactttttgaatctgaccctaatgataaagaaaaattattccttactgtagcatttccataccctagtggagctatgcacattggacacggacgtacatatactgttccagatgtttatgcaagatttaaaagaatggaaggttataatgtattgttcccaatggcatggcatgtaaccggagctccggttattggaatagctgaaagagttagaagaaaagacccatggaccttggatttatacgaaaatgttcataaagttcctaaagaagaacttcctaatttagcagaccctgaatacattgtaaggtacttcagtagtgaatataatgaagtaatgcatgatatgggatattccattgactggagaagggaatttagaacaattgatccaacttacaaaaaatttgtagaatggcaaattagcaaattaaaagataaaggactgattataaaaggagaacatccggtaaaatactgtccaagagataaaaatcctgttggagatcatgatttacttgaaggtgaaggagtaggagttaatgaattaaccttacttaaattcaaaatggatgataaaattcttgttacagctacattaagaccggaaaccattatcggagctaccaacatttggttaaatcctgatattgaatatattgaagtagatgctgaaggcgaacactggattattacaaaagaagctcaccacaatttaaaacatcaaattaaagatttaaacattatccgggaagtggaccctaatgatttaattggaggatttgttgaaaatccatttacaggtgacaaattaccaatattcccggctagctttgtaagcggttcatatggtagtggagtagtattttcagaacctgcagatgcacctgcagactacattgctcttcaagacttaaaaaacaataaagaattaatagccaaatatcatttggaagacattattgatgatgtaaatccgattaatgtatgtagtgtaaaaggatatggggaaattccggctgcagaaataattgaaaaattaggcatcaaagaccaaaatgaccctaaacttcatgatgcaactaacgaattatacaaagtagagcacagaaaaggtattatcagcgaacatattcctgaatatggtggtaaaaaagtagcaatagctagagaagaatttaaagctgatatgattgataaaaacatggctaccactatgtatgactttgctgaaagacctgttatttgcagatgtggtgaagactgtgttgttaaaataatggacaaccaatggttccttaaatattcagatgaagaatggactgcaaaaacacatgaagttcttaatggtgaaacaatcattcctaaagaagttaaaaacaactttgaatattatattgactggttagatgattgggcctgttccaggaatgtcggacttggaaccagacttccttgggataaccaatggttaatcgaacctcttacagattcaactatctacatgtcctattatacaatagccaaatatttaagaaacatgaatgctgatgatttaaaccctgcattctttgacaaagttcttttagatattgacagcgatgatgtaaaagtcgacgacgaaactgtaaaagaaattcaggacgaattcaattactggtaccctcttgactggagattatctgcaaaagatttggttggaaaccacttaagctttttaatgttccaccacagtgcgatttatcctaaagaaaaatggcctagaggaactgtagtctttggtatgggtcttttagaaggaaataaaatgtcctcatcaaaaggaaatgttattttattaaaagatgctattgaacagtacagtgcagatgttgtaagacttttcctaatggcatcagctgaaccatggcaagactttgactggagagaaaaagaagttcttggaaccaaaagaagattggaatggtttagggaatttgccgccaaagtagaagaagttaaaaactccccattggatttaaccaatatcgaaaaagttgaattaaaccgtacaatcgatatttggatgttaagccaattaaatcaacatattaaagaagctactgaagctttagatggattccaaacaagaaaagcacttcaggaatctttattcttgcttaaaaaagatgttgaccattacttatacagggtaaaacacttgcttgactctcaagaccctgctataatctatgtactttcaacagttcttgaagcatggatcagactgcttgcaccatttactccgcatacctgtgaagaattatgggaaacttatggtggagaaggttatgtaagccaggctagctggccggaagctgacgaaagcctagtaagtccaaaaattgaaaaatcagaagaattagttcaaaacattattaaagacattaaccagattaagaaaatggttaaaggaaatgtggaaaaaatccatgtttaccttgctcctgattggaaatgggatttatatgaaatagctgaagaaattggaaaaccggatattggtcaaataatgggaagagctattggagcaaatatttatgatgataaaaaagaaatagctgcagtagctaaaaaaataggtcgtgaaatgactaaaaccaaatatgtaggtaaaattgatgaaaatcaaatcattagcgatgcgatagactacattatggaagaaactggcgataaagtcattgtacatactgacgatagctatgaccctgaaaacaaagctagaaatgcaatgccttacaaaccagctatttttatggaatagggttaaaaaccttatttcatttacttattttttaaatccgctaaacaaaattatatatatacttatataataataattatgaacttccaaaactgcaataaaattgttattttattaattgttttaagtatcatcacaatgattttacatatagactggatgacatttcctatttcacactttatagagataattttaatgtttttagtagctatttatcttattttgtgcattaaacaccatgaaaactcaggaataatccttagcataatatgtttagtactactttgtgtgctgctttatgaaaacggaccgtatatgattcttcacatagaacctttcaatatacctttaacatttcctctttaattaaataactttttgataaatttaaatacaaccatcaccataactcctattaaaaaatagttattattttaaaatttttaataggagagatgaaaattgaataaaaaatataaactagctatatcagtttactaatttttctttttgctctaacaatcaattcagatagtgcaaagaaatcatattattaatcattcaaactgttattaacctaaaataaatgataccatatgacggttttagaaaaagattaattaaagagttcaattaccctttaatatttttataatttacgggcaaagactaaatacccagtatgaccaaccatacgggtttttggtctgactccctgaggtctaacttccagacctctttccaatgtttccaatatttcgatattgtaaaaattaagttttttagctaccctataagctatttctgcctgatcaatatatggtgcataaactgctaaccatccgcctacttttaaagactcataaacatcttcaaaaatttcaaaaggctttggcaaatctaaaaagaccagatcaatgttttgttcatcgattccttccttaatatctttgtttttaacttcaatattattgattccaaaagtttcaatgtttttttgagctactttagcaaaatcttcccttatttcataggtataaaccttaccggtgccgcccaccacatttccgaaattcagtgcaatagctccagcaccagttccagaatcaacaactctgtctcctgaacctaaacccgtgtaagccagcacagttccaatatcttttttaactaatattgaacaacgtctatccattaaatcaatgaaatcattaacagtaggtttaacaattttaaatgtgtggtccaagtgacttttaagctcatcacctatttcacaattagctatctgttctttagtaacaatacctaaatcactttgaaattcacagtcttctttaagaagatacttcttaccacgttcatctaaaatcattttcaaattaatcacctaattttctaattcagaaagtctttttactctttttaatgaatccggatgtgttgagaacaattccataattttattagatgtagaaacatcaacatttctttgactaagttcccttaactcttcttcggaaatggatccgtcaccatcgaaatctatttgtctgaagtcatttaaatctcttgtagcattatctacatcattaacaaaaaatgcacgaacagtatttacatccttaattgtttcatcgtcacatcttgcagctccgtaagataatttataaagagctgaaactaaatctgctggacgatttccatattccacactagcttcatctgcataatattctcttgttcttgatataaataatacaagcaattgtcctataagatagaatacataacccaatattccgataataatacctgcattgttttcgttgttgcgtgaaaacataaatgataatgcaatataataacaaatcattggaactaagcttacaatagctgtaacaatcatgtcattatgtttaatatgacccatttcatgacctaaaactgcttttaactcatttctatcaagcaaacctaaaattggacgagtaatagctatatgtccacttcttttagacctgccatatgcaaatgcattcggaacatttatttcagaaagttcgatctgtggttttggaacacctgcttcacatgcaagttcttcaaccatctgatgaatatttggagcttcactttcagacaacggccttacattcatagaatgtttaactaatgtagggccaaaccagtactgtgcagctacaatacaaagacttataattaagtaaaatgatggtccaccaattcccaaatagctaccagccaatataacaaggaaatacacaatagtgaacaatataatcatagtaagtgccattcttactttaagtttccatgtacctttcatttaatacgcctcataattttataaattttttatatattttataactacctatttattaacctattctttcttcagaaattggtccgcttgaagaccaatatgattcatatattccaggattatactggcctcctgaagttgaaaatacacttctataaattggatttccgtgttcatcatactcaccagtttcataatcttcctgccagtcatcatattctttttgtgagccgtaagatttgtcagaattatctgaagaagttgaaatctgattatcttcctgagaaacattagtaacattattagttatatttgtttcatttacatgattattatcacctgcagtaggcattgaaacaaaataaagacaaccaacagcaatcacaactaacacaacagccagaattataattatcacatttttattatccatattaacacatcttaaaataaatatataaactttataattattaaattatacagtaccacaatcttaatttaataaaaaatacataaattattagcatataacttacggtgattgaatgagcggaccttgggtagaaaaatatagaccacaaaatttagatgacattatcgggcaaaaacagattgtaaacagactccaaaaatatgtaggtgaagaaagcatgcctaatttaatgtttacaggacctgcaggtgttggaaaaacaactactgcaatagctcttgtaaaagctattcttggggagtattggagacaaaactttttagaattaaatgcatcagatgcaagaggaatcgatactgtaagaaatgacattaaaaatttctgcagattaaaacctgtcggagccccatttagaataatattcttagatgaagtagataacatgactaaagatgctcagcatgctcttcgtcgtgaaatggaaatgtatactaaaactgcttcatttatactttcttgtaattactcctctaaaattattgaccctattcaatcaagatgtgcaatattcagatttggacctattaaaggagaagaaattgcaaacagattaaaatacatttgcacatcagaaagatttgaatacactgatggaggaattgaagctattgaatactttgcagaaggagacatgcgtaaagcagtgaatgtacttcaggcagctgcttctgaaggaaaacaagttgatgaagatgcagtttacgaagttgtttcaaaagcaaaacctcaggatgttcataatctcataacaaaagcattgtctggagattttatgggtgcacgtaatcttttaagagaaaccatggttttgcaaggaacaagcggagaagacatggttagtcaaatctaccaggatgtttccaaaagagtatttgaaggaaaaatggaagcagacatttatattgatttaattgaagcaatagcagattgtgattttagaataagagaaggagcaaatccaagaatccaactagaagctcttttaacccaattcttataaggtatagaaatgttatggacagacaaataccgaccaaaaacactggatgaagtggttggcaataacaaagaaaaagcattaatccaaaaatgggtggataactggaaagcaggaaatccgcaaaagccattactcctagttggacctccaggaattggaaaaacaacacttgctcaagcaatagcccgagaattctcagaatacatagaactaaatgcaagtgataaacgttctcaggatgttattaaaagcactattggagaatcctcttccagcaaatcattatttggagatgactacaaactacttattcttgatgaagtagacggaattcacggaactaatgaccgaggaggagtaagagctattggagacattattaaaaaagcaaaacatccaatgattctaatagctaatgacttttattcaaaacgtattgcatcacttaaaacaaaatgtgatgttttaaaaatgagtaaagtcagaagcccgagtattaacaaattacttaaacaaatagccattaatgaaggaattaaagcaaatcctgcagcacttaaagaactggctaaaaaatctaatggagatatgcgttcagcaataaacacattccaagcactggctaatcaaaatgaagttcttgaactaagtgatattgaaaacataactacaaaagatgacaggtcaacaataatcaatggagttactgctgttttaaaaagtaaaaatcctaaccatgttaaaaaagcattgatggttgaagaagacccgacacttgtaatggaatacattgcagaaaatattccccgtgaatacacaaagaaaaaggaaatcaaaaaggcatatgaaaatattgccaaagcggatttgtactttggaagagctagaagcagcagatactacggctattggaaatatgcaactgatttcatgggagttggagtcagtgatgcaaaagacgaaacttacaaaaagtttacaagaatcacttcccctacagtatttacattaatgggacgaaacagaggaaaaagaaacctcagagacagaatagctgaaaaaatgtctcaaaaactacatatttcacacagcgtagctatttcaatgttcccctatcttgaaatcatgtttgaaaacaatgaacttgcctgggaaatatctgactttttaggttttgaagaagacgaaataaaacgtttcagaaccagaaaaatacctaaaaaagttattgaaaaaatggaaaaacagaaagctcaaaaaagagttgaacaaagagatgcaagagctcaggaaatccaggacggattaatggctacaatcccacctcaaaaagaagttaaagaggaacctactgaggaaatacaagaagaagttgttgatgaaataaaagaagaaactgttgaggaaatacaagaagaatctcaaaaagaagttgaagaaaaacctaaaaagaaaactgacaaacaagtttccttattcaacttctaattctttttcaatatactcataagcttttaaaacattttcacgatactgaggagctacatcttctaaaaattccataaaagatgtagacaaatcatcataatccttggtttcaattatttttttaccgtccatttccaaaaatgaattgatccaattaagaggtacattaatcagcggataaatctcattggttttattgctaaatgtcaatccatttcccttgaaaatatccgaaaatatggagtttactttactgtccaaaataatcggattgacaatcaaatcataacttccaccataaaccaattttacaccatatttgcgagtatatggttccaatataatttcaatcaaatcattattttcaggaattaaaattgtgctgttcggttttatttcatcagccagcactttagaagatttggaacatattttttgaaatagggagtttctaactacttcaatacccggatattctttattaaatgtagattgtctttttcttgagaatttggaaaatcttaggttattaatataaattttttcagcagtatagctgacaaaacgtgtatcaacaccaattatttttaaaaatttcaatacatcctttttagatgttgtaaattcatcttcatccctttcaatggcaaaattaaatatagaatccattttatctactcataaatcaagtgtttttctaagtgttttttccataacatcaacaggtgccttctctcctgtccagatttcaaagctctctgcaccctgatacaataacattttaattccataaacaggagttgcacctgccttaatagcttcactaagaagtactgtttcattaggattataaacaatatcattaacaaccaaatcagaatgcatatcctctgctttaacaatagcttcgtcatttacatgaggactcattcctacaggagtagtatctattaaaatatccgcatcacttacataaccaactattttatcaattgaatcaaaatcaacattatctgttaatttagagtttttaagatcctctgctaatgattttgctttatttatatccctatttaaaatatgtatactttgaggattttcacgagccagataaaaagaaatagctcttgaagccccaccagcaccagccactacaatatttttatctttaatcgaagttacttccccaatagctttaatacatcctatcccatcagtgttatatcctttcatttctttaaaatcaattgtatttactgcaccaattaatttagctatcggatccagtttgtccaaatacttcattacattgattttatgaggaatagttacattaaaaccttttatattaagagattttgctcccaaaatagctgatttcaagttttcaggacaaacattaaatggaacataagcatagtccagccccaattcttcaaaagccgcattgtgcataggtggagaaaaactatgttctacaggatggcctatcaaacctacaatttttgtacttccattaatcatatactagtgatatttatttaattgtataaatatttctttttacagataattaattatggattttaatatcactaatttcaacgaaagattaaaatcaataaaacttagagagttgatagttgcaggaatagcagccataatccttggagtaattttaagtgaaatatttccagctatttatgattctgatgatttatactttgttgtaattacaattttaatattagtattcttcatttatgctctgaaaggcacatatggattaaaaacgaatattcattctgtttttgaaactggaaatcaaaaagaaatcatttatgtatttttaataaacatattttttgcaatggtttttcttgcattattttccagtttagacattatgattggatttctagaccccagctgggaaacaggatttgaatttgactatgtaagcctcacaccaattgcattttttatagatgcacttggaacaattattcttgcaccaattgttgaagagctagtttttagaggagtgctgcttaatcgattaaaactgagaatcggaattattcctgctattttagtttcttcattcttatttggaattggacatgaatttggaggaatgataagtgcattcctatttggaatttgtatgtgtatcctctatttaaaaacagacaacattttaattccgataacagttcatttcattaataatttagttgtaactctcttagaatcaacacatattgacacaataatgttagaatttccttggataattccaacattaattatatgtttaatatcaagtgttttgctaattttatacatttataaaggatttaagaaggtaaaaacccttacttaaattcatactttatttattcagtcctcttttcttaacctgttaactgccacttataaatatattaaataataaaatctataatattatgaaattattgataaattaatggagggcaatcatggaatttacaagacctagaggaactagagattttctttttgatgaaatgagagaaagaaaaaaagcagaatccatattacgcaatgtatttgaaaattatgcttatcaggaaattaaaacacctttatttgaagaattgaaattatttacaacaaaatctggagaagaaattgtagaccaattatacaatttcaaagacaaatctgatagagaattaactttaagaccagaaattactgctccagtagctagattatacttaaatgagcttcaaaaaactgcatccaaacctatcaaactttattattacggaagctgttttagatatgaaagaccacaaaaaggaagatttagacaattctggcaatttggctgtgaattaattggagctaaatcaccgcaaggagaagctgaagttattgcaatgtgttcagaatccattgaaaaacttggaatccctggtgcagacgttaatataaatcatttaggaatcattcgcggattattcaaacatttcaacatagatacagccacccaaagagaagttatggttgttattgataaaggagataaagaccttctaaaagaatctttaaccggtgaaaaccctattattgacaatgaagaattaaaccatgttttatttaaattaattgatatggttggagacaaatccattatcaaagacattgaagaactagttgcaccatatcctgaatctcacgatgctttaaatgagcttgaagagcttattgatacactagctagttttaaaatggaaaattacactttaaacttaggtgtggcaagaggacttgactattatacaggaattgtatttgaagtttatatcccatctcttggagctcaaaagcaggtttgtggaggaggaacttacagtttaattaaaatctttggtggcgaagaagtagtttccaccggttttgcatttggttttgacagattaatgaatgcaattgaagaattggcaactccagaagaacttccatgccctattgacatctatgtagctccaatttctgatgatgtaagacttaaagcttatgaaataacccaaactttaagatctgcaggaatagcctgtgatgttgacttaaacggtaaaaaattcaagaaaataatgaatcatgcaaataaaatcaaagtaaaacaagtagccatcattggagctaaagatttagaaaacaaccagattaccattaaaaatatggaaagcggaaaccaggaattagtagaccttgataatgtagtggaatatattaaaggtgtataaacaatggaaattaattttagacatgaaataaatggtcaaaaagtcattactgctattgcccaagattggaaaaccgggcaaatacttatggtagctaatatgaacaaagatgcccttcaaaaaacaattgaaactggaaaagctcattattggagcacttcccgtaattcccaatggctaaaaggtgaaagttcaggccacacccaggaagttaaagaaatacttgttgactgtgatatggatgcagttgttttaaaagtcaaacaaaacggagctgcatgtcatgaaggctacttttcatgtttctttagaaaactaaacactaaaaacattgaaaactttaatgaagaggatcttgaaacaattttagaaaaagttttcaatcctgatgatgtgtattaaaatgaaaacaataataccagatacaagtgccgtaatagaaggagctataagtaaaataatagctgaagaagatttggattatcctgagattattgttcctgaagctgttgtttgtgaacttgaacatcaagcaaatgccaacagaaatgaaggaataaatggtttaaaagagcttcagaaattacaggaagcccaggacaatggtgaattggccattacatttaaaggaaaacgtccaaccaattacgacatcaaatatgcaaaaagcggagaaattgacagtttaattagagatttggccagaagcgaatttggaacattagttacaaatgataaagttcaggccgaaactgcaaaagcacagggaatatctgtttactactttaaacaggaatataaacacaaagaattatctattgaaaaattatttgacgacgacacaatgtcagttcatttaaaagaaaatgttgttccaatggctaaaaaaggaaaacctggacatgtggaatttgtaaaaattggagataaaccttacacatattcagatattttagatatctataatgaaatcctggaaaaaagcagaagcgaccctaaaagctatctggaatcagacaaagacggatcaactgttattcaatccagagaatacagaatttcaatggccaaaccaccattttcagaagcttttgaaataactgccgtcagaccagtagctaatgtcagtctagatgaatataatatttccgaaaagctaatggaaagaataagcaaaagtgctgaaggaatacttatttcaggttctccaggagctggaaaaagtacatttgttcaggcattagctaaatattatgctgaagatttaaataaaattgtaaaaacaatggaatccccaagagatttgcaacttccagcagaaattacgcagtatgctcctttagaaggaagtatggaaaatactgctgatgttttattacttgtcagaccagactacacaatttatgatgaacttagaaaaaacagcgattttaacatatttgcagatatgagaatggcgggagtcggaatgattggagtagttcatgctacaagaccaattgatgccatacaaagaatttcatcaagagtggaacttggaataattacttcagtagtagacaccagcatttacattgaagatggagatattaaagaagtatttgaaacaaaaatgactgttaaagttccatcaggtatgaaggaagcagatttagccagaccagttattgaaattcgtgattttgaaactggagaacttaaaaatgaaatctacacatacggtgagcaaacaattgtaatggaccttgatttagttaacaattcttcaagcaatccaactactgccaaatctgccgtagacaggctagccgaacagcaaatccttagaaaaattaaaagattaattcctaaatcaaaagtaggggtagaagtaatttctcctgaaagagccaatatttacatcaatgaaaaatatattccaaaaatcatcggtaaaaatggaaaaagaatagctgagattgaaaaggatattggaataagcctaggtgttgaaattcttgaaaacactccaggacatctggcccgcggtgaaaaatttgaagtggacattatccacacaaaaaaacagctaattttagatttgggaaaagttaacggtacacaaaactttgatatttttgttggaggagaatatttacttacagctacaacaagcagaaaaggagaaattaaaataaaaagaggcatcgaattatctgacatattgctcgatgccatagaaatgggtttagatataactgcagttaaaaaataggtgaaataaatgaaaataggtgcatcaacattatcaggatttaaagatgatataggaacaaatttagaatattttgaagaattaggattggattatgcagaaatattgcatcaatatccaaatcaggatttagataccagtatttttgagaattacagtttaaaatacagtgttcattcccctattatcaatttaaatattgcatcattgactgaaaacatcagacaagcttcaatagctgaaattaaaaaatctattgaccttgcaaatgaaattgatgcagaaattgttgttgttcatccaggatcaattccttttttaggcagagactttaaagataaaatttttgaattaaataaacagtccattgaagaaattggagaatatggaaaagaattaggtgtaaatgcagctattgaaaatatgcctacttttgagggatatatgtactcaaatccctatgaactaaacgaattagttacttctctagatatgtctatgacactggatatcggtcatgccaaccatgcaggatatgggccggaggacatgtactttgattccattaaacacatacatgcccacgataataatggtgatgatgactcacactatgcattaggtgatggctctattgatttaaaaagcatcatctctacttttgaagataaaaagtatgatggcacatatatcatagaagtaaatgagaaggattgggttaaaaaaagttataattatttaaaaaataacttttaaatcccttatttttacaccttccaattctaataatttaaccttattttccaaacctcccgcataaccagttaatttaccatcaaaaccaacaaccctatggcaaggaacgataattgaaataggattatggcctacagcaccaccaactgcctgagaagacatatcataacttatcttttttgcaatatctccgtaggtaaccacttcaccataggcaatcccttcaagtattttccaaacttttaatctaaaatccgttccctgaagatttaaatctaaattttcaattgaagggttttctccgttaaaatagctatctaaccatttttcagtttttctaaaaatagccaaatcatcatttttctttgttttatctttaaaatttccaaaaaagtgtttttgaccttcaatccacaaaccaatcagtttattgtttttaccagccagtgttaactttcccaaaggagaatcatagcaagtcgtataaatcataataaaagttttaaataataaaatatttaaaataataacttggtgatggggttcaccagaaacttattttcaaaccgcaattgctgataactcctatgttatataaaaaatacttaggaggataatttaatggctgatgtatttccattaattttagggataataatacttctagctagtgtaatttctattaaaactggaattagtgtaacagtagttgaaattgcaataggagtaataataggaaatctaggattcttccacagcgaatcttggatgatttatatagctagttttggaggaatattgcttacatttctagctggagtcgaaattgatgttgacttaatgaaagataattttaaagaaagttttacaataggatttttatcatttctaattcctttcgtaatcgtgtttttagtaacttattacattataggatgggaattaaatcctgcactattaacaagtacggcattatctgaaacaagtattgcagttgtttattccgttttaactcaaaaaggactatttaaatacaaaatcggaaaattaataatggttgcaacatttataacagacatatgtactgcaatagctttaagtgttttatttacaaaatttgacatttatacattattattttatgtagtgtctttagcagttcttgtaatggcttattataaatctgatttatttttcgaaaatccattatttaaaaataaaataggagaactggaaataaaatatgtttttgtcttacttttaggatttatattctttggaagtcttggaggcgggcaagccatattacctgcatttatactaggagtaatactttccgatcactttaaaaacacacaaaaaggagaagttaaagccagattcaaaaccgttgcatttgctattataactccaatatttttcataattggaggaatgaaagtttccatacctttaatatatagctgttttggaatctttttaacattatttgtattacgtcaactaagcaaatacattggagtttattatccaagtaaaatctttttaaaacaaaactataactatgttacaatgatgatgagtaccggtttaacatttgggcttgtcgctgcagtattcggactaaataatgcattaatcaatcagacagaatatagtgtaataactggaatacttgtattaagtgctattttacctacatttgtagctgaaaaatattatactccagtacatagtgaagatttgggagattgaaggttaaattaccttcaagtttcctacaataattttttttctttaatttcattttggaaatataaatacttggaatcaactaccttacgaatattggctgctgtttttttaccaataccttcaacttcctgaagctgactctcagacgcgttaataatattagctactgttccaaaatgctccaataagtttttagcattaacaggacctatatttggaagggattctattataaacagctgctgctcccacaagttaacaggttttttgtctgttcttatttgaattggtgttttttcaccactttgctccctaatagctattcttttaatcattgctgcagtgtcctgagcatttcttgttggtataatactaattccaaagtccagagctattgaagctatcgaacctctaattgcattcggattaatcataccattatacaagtcatctccttcaagaataattaacggacgtttaaattcctccattaaagatcttgcctgtttaaatagtcttttgtcaacaattgaatcaacaaagtccttagctgttttacgttctataacaacttcatcacttacctgataatcaccaacagccattgcctgaactttaacatcaatttccatttcagataaatgacgtataacctttgaattaccttcacgagtatctgcaaaaacaaccggaagttcttcttttttaggagtaggatctaaaacctttacccttttttcattttccattctttcaatagcattggaatttaactcttccaatacatcaggatcaattaactgatgtttcatcctgcgttccttattaactgaagcccaataataaccttcatctctggttccatttgtaataagaactttcacacgacctgaacgtttacggccagtccttccccttctttggatcattctaacttcagacggaacaggttcataaagaataaccaaatcaacagcaggaatatcaattccttcttcagctacacttgttgagagaagtacatcatattcaccaattttaaaggctttaatgatttctttttgttccttttgagttaatcctttttcaccatctcttgaagcctgaccaaagaacttggcggatttaattccttctttttcaagtttctgatgaatcatttcaagtgaatccctatactgagtaaaaaccattatttttgaggatttttggtcagcatctttaacatatctgtcagactgcaatttagtttgaccgttttgtcccaattcttttttaataatgtcagttacctttttaagtttaggatgttccaaaccatgtttttcagcctcccttgcaagataaatagccttaccaaaattaggatcctgaattaatgatttggcagcttttgttttcttcttacgcaatcttgccacatatttgttaaatgtaactactccttgtgtttcaataagttcctgagaatgctgtatattaataaccgcacttaaaatagaaatagcttggaaacattcctttttaggatttacagaccttgcaattgcactttgaactcttcctcttgcttttaatatatccaatttgttaacggaaactgttctaataactcccatatttttaaggcctttaagacgaatcttaagagctttatcaacatgtgttttaattttttccaactcagaactcattttaaccctaacccaatctattgcaaccggattaaaataaggtcttacatcattatcctcttcagttttaactacaatactttgaatatataaattatcacaaacttcttttattttttccttatcagaacctggagaagctgtcagtcctaaaattaagttaaatttggattctttaacatatcttgaagccaaatatacgtaagaataagagccaacaccgtgatgacattcatcaaaaacaactaaagacacatcttttagagaatatcttccttttaataagtcagattcaacagtttgcggagttgcacagattatttgagattcttcccaccttttaaccctttcatcagttttaacagcaccagtaattgatgaacaaggaacagtcaaaaattctttaaaagtagattcatgctgtatagctaatggtttacttggagccaataccaatattttagagtttttaactttttccaatctatctgccgctactaaagtagctactatagttttacctaatgctgtaggtgcaacaatcattgtatttcctttttttaaaacatcagcagctaaaacctgttgatataacctggcctcgatagcattagattttattaaagggtggtcaatataatgtgccatgatagaacatagtaattaaatgtttataaatgtttaataagagcacatgaaaactaattataaaaacagcacgatttaattttaaagtaaaaaaacttgttaaaaaaagaaaaagaagagattaattaaaatctcttaaattaagatattattatgttgtttcctgtttggaaatcgttccaagaagatgtaatgatgtattttccactcattaacctgatagttaatgaagcaaaaccattatcatcagttactttgtgatagaatacgccgtttacattaaatgatacgttttgattagctaatggattaccttgaccatctaatgtctgtgcagtaaagttactgccatctccataagtcatattaaggtcactagtaactaaagtaggtaaaacagttacagtattacctaagtctaatccttcgtacattgttgtaatgacatattctccaggtcttaaactgattcctaaacttattacaccattttcatcagtagttctggtgtaaaatactccattgatgttgaaggttacatttttatttactgctaaacttccgtttttatcatagatagttgcttggaacttagatgcattcatgtaatacttagttaagtcattttgtactattaatgattttacagttatgttaaatccttgttgttcaccagttacagggttgtaagctgttaaaatatatgttccaggtcttaacataatacctaaatccgctacaccatcattgttagtagttttagtgtagaaaacaccattaatgttaaatttaacctgagtattagctaatacttttccatcactgcccatgaatttagcatagaatcttgtagcattttgatacattttaactaaatcatcagctataatacttgaattaatagtaacagtaatatttttagagattttactatagaaagcagatccgttataagttacggttactggatatacattggaatctaaattaagacccatggaagcagtaccattagcatcagttgttttagcatatattacaccattaatactgaagtatatagtagcattgactattggtttaccttggaaatctgttaatttggcaattaaacgagttccatcatggtaaaacatttcaacatcactaacatccaagtttacatttatatttggaattacagttacgtttccttttttagtcatggaatcatatttagcatcaccagagtaaacagtagtgatattataatctccagcacttaaaccagaaacaattacatttgcagttccgtcaattacatttgcagtgtattttttaccgtcaatttcaacagtaactgttccggttgcatctttaggtaaatctacaccaatagtggaatttactccctctttaatttcaggaacagaaatatccatattgtaatcagatattttggatacactaaattcagcatcagcagttgcttcattataattgttatctccagcgtatttaacagttacagtataatcatctgctttaaggccagatattgttttaactgctttaccattttcaatagctgcagtgtaatcttcaccattaacagtaataactacttcaccagtagcatcactagctaatttaacactaataacagcatcttcgccaactttaatattattaacattaaccacaacagatgaatctattttattaactttgaaatcaccgttttcagtaacaatattgtaattatcatctcctgcccaaacagcagcaaatgcataagtaccagcagctaatttatcaccagtagcaatacctttaccgtcagtaactttaacagtgtattctttaccattaacagtaacaatcacattaccagataaaggagcactgttaacaccagttaaggtagcttcaataacaaatccgttaccataatccacatcagcaataacaacacctaaaacaggttgtgctttagcaacattaacacctttagcaatttcaacagcagtgtatttatcgtcaccagcatatttaacaacaaccacatgactgccagcagttaaatctttaacaacttgtgttgctttaccatcattaatacctgcagtgtaagaagttccatcaacagtaataattacttcaccagtagcatcatcaggtaaaaccgcatcaacagttaaatctccaccaaatacaatgtcattaacagttacatccatagtagaatcaactttagacacagtaaagctggaagtagcaactgcagcattataattgttatcaccagaatatttggcaactacatcataattgcctgctttaagatcagatacagatacagtagccctaccgttaacaacattcgcagtataatctttaccatttacagtaacagtcaattcaccagtagcatcactaaataatttaacagtaataacagcatcttcaccaacattgatatctttaacagttataccaatagcagaatctactttataaacattaaatttaccggaatcactaacttcattataattattgcttcctgcgaatctagcattgaagttataagatccagcagctaatttatcagcatggaaagtacctttaccattaacaatagctacaatgtagtttttaccattaactgttacaattatattagtatctaaaggagcattgttaacaccagttaaaacagcattaatagtaaatacattaccataatccacactgtcgataataacatttaaagctggatttgctttagcaacattaacacctttagtaacttcagcagcattataattatcatcaccagcatatttaaccgctacagtgtaatcaccagcttcaagaccggatacagttacagtagcttcaccattttcaatagctacatggtaatctacaccattaacagtaataactacttcaccagtagcatcaacaggtaaaaccgcattaacaattaaatcttcaccaaatacaatatcctcaacagttacatccatttcaggagttattttaagtacactaaattcagcactgccagttgcttcattataattattatctccagtatatttaaccgctacagtgtaatcaccagctttaagatcagatacagttacactagctacaccattttcaatagctgcagtgtaatcttcaccattaacagtaataactacttcaccagtagcatcactagctaatttaacactaataacagcatcttcaccaactttaatatcactaacagcaacatcaatagcagaatctattttattaactttgaaatcaccgttttcagtaacaatattgtaattatcatctcctgcccaaacagcagcaaatgcataagtaccagcagctaatttatcaccagtagcaatacctttaccatcagtaactttaacagtgtattctttaccagcaacagtaacaatcacattaccagataaaggagcaccattaacaccagttaaggtagcttcaataacaaatccgttaccataatccacatcagcaataacaacacctaaaacaggttgtgctttagcaacattaacattttcagcaacttcaacaccagtgtatttatcatcaccgacatatttaatagctacaatgtaatcaccagcagctaaaccactaatagttccagtagctttaccattttcaatagctacatgataatctacaccattaacagtaataactacttcaccagtagcatcaccaggtaaaaccacatcaacagttaaatctccaccaaatacaatgtcattaacagttacatccatagtagagtcaactttagatacagtaaagctggaagtagcaactgcagcattataattgttatcaccagaatatttaacagctacatcataagtacctgctttaagatcagccacttttacattagctacaccattaacaacagtttcagtataatctttaccatttacagtaacagttacgctaccagtagcatcactaagcaatttaacactaataacagcatcttcaccaacattgatatctttaacagcaacatcaataattgaatctactttagcaacactaaatttaccagaatcaccaacagcattgtaattatcatttcctgcccaagcagcagtaaagtcataagtaccagcagctaatttaacaccaacagcagtacctttaccattaacgatatttacagagtaatctttattattaacagtaacaatcacattaccatttaaaccaatagcatcaacaccagttaaagcaacattaatgttaaatactccatcataaccaacatctgaaataagcacatttaatgcagggtctgctttagatacagttaataaagcattgcttacaccaggcaagtatttatcattacctgcaaatgctgcagatatagtataatcacctgcatccaattcacgtaatggaagttttccaaatccgttttcaatatctacaggataaactttaccatttacattaacagtaactattgaaccgtcaatatcagaaggtaaagtgattatgacaagtccgttttcaccaaaagtaatatcttcaacatgtatatttaagttagctaaaactttatctactttaaagactgttgagttttcagcagcaacataatgattatcaccagaataacttgcagatacatcataagtaccataagctaaatcttggaagtagaatttagcttcaccattgtaaatcggcaatatataatcaataccatttaaagttaaagttataagaccagttgcatctttaggtccggttacagtaattatttcaagatctccaacagtaatattcaatgcaccaacagttaaatcaggagttgcttttgatacatttaagatacctgtgttaatatgaacttcaggtccatcataaacaatactaactgttttattaataacatcatttattttgtaagttgcaacataagaaccatttaacaagctatttgctttacaaacaacaacatcctcaccattataaactgaaaatgataagtcctgattagctacaagaacaccatcaactgtaataatagcatgtaaagttacaacatcaccgtaacaaacatttacagttttattatctaaaacagttataattactccaccatcacttgaaatagtttctataccagccaaattaataattggagctttattttcagtgtaattactataattattaccattaatactcaataagccatttatattgctgtaaataatatcagctttttgtgctttattattatcaaagtctgaatcactaattcttaaatcaccattactataaatagcaccaccatcaacaccagcagtgttgtttataaagttagtagcataaacagtagcagttattttagtatatgcaggttcaaatccaatagctcccgctttaacagtagctgtgttgtttataaagttagaattgctaatatcaacggttccttcattaatccaagctgctccaccatattgagctttgttattagtaaagttggaatttataatggtacctgaaataggtatattaccctgagttactacaagagctccaccattgttattattaggagtcatattacctttaccaaatgctaaattattatcaaatacagagttggaaatagagtaattagatccccatacaaacattgctccaccatataaagcagagttattaacaaatttagttccatctatgtcgatgaaatttgtagcactactagattctccacccattacagataaagctccaccccaacggccagagttattaacaaaataggaatcagaaatagtagcatcaccaatagtagctacagcaccaactaataaattaccgtttttataatttttaatgttgtttgtaaagttagattttgaaatatccaatttaccatttttccagttgtaaatagctgctccaccatgatcaacattatccatagcacggatgttacgaacaaggatatcgtttccatcaaatgcagagttagtaacttgtaaatcatcccagttaaagatagctccaccataataattagcagcattatcttcaaatgcagaattatcaactactaatttaccattattaattatagctccacctattgaagttgcagtattattaacaaaagtagaattacctacaacagagttatcaccctcattataaactgcaccagcatcttctgcagtgttattagcaaaagtagaattacctacaacaaaaccaataccataattataaatggcaccacctttacttgtagcagtgttattagcaaaagtagaattacctacaacaaaaccacggccaccattcaggattgcaccagcaccgtctgcagcactattattcacaaaagtagaattacctacaacaaaaccaataccataattaaagattactccaccattacttgtagcagtgttattagcaaaagtagaattacctacaacaaagcaatcagcagagttataaattgcaccaccaatcttagcagtgttattagtaaaagtagaatcatctaaaactaaaccataagcatcgttcatgattgctccaccatattttgcagtattattaacaaaattaacatgcactaaatctaaattaccaaagttataaatagctccaccattatcagctttaccattagttaaagtaacattagttaaagtaacagcaaatcctccatcaatctcgaaaattcttcctaaattcttagcatcaatagtatgacctttaccatcaattctaatatttttattaataattacaccatttacaaaattagcagcttcatcatcagtcattacaacattttgattaagagttaaagtaccagtaacaagaccaatagcattttgtaaatcagtaaaattctcaatacctaaatcaaggttgcctccaaatccaacataattaaatatggcatcaggagtattgttaacaaattcagtatttctaacagttaaatctttcacattaactatagcaccaccataggatgcactattgttaatgaatttagaaccggaaattgaaacttcaggattacccttaacagtactaatatcaatagctccaccttcaacatcagcagagttattaacaaattctgaatctgtaattttaatgttaccttcacaaatatcaatagctccaccatattgagctttattattagtaaagttagaaccagtaataattccagcaatagctttattagtatcagttactacaatagctgctccattgttattatttggagtcatattacctttaccaaatgcagtattcttatcaaatacacaatcagacacagtaaagtcagatccccatacaaaaatacctgcaccatataatccaccattctctttaaaagtagaaccagatacagttaaagtatttacatcatcaccagcaatcaaagcaccagaagtagtaatagctccaccccaacggccagcattattaacaaagtaagaatcggaaattgtagcatcaccaatagtagctacagcacctactaaacggtcaccattcttataattcttaatattattagtgaaattagaaccagatacagttaaaataccgtcataccagttataaatcgctgcaccaccataatcaacactagcagaaccacgattaacaatatcattagaatcaaatacagaatcagaaacaaccaattcaccattgttaaatacagcaccaccataaccatcagcagcattatcacttaatttaacatcacttaaagttaaagaaccatcattataaatagctccacccttatcagctttaccattaatcaaagtagcattagttaaagtaacagcaaatccttcaccaatactgaaaatcctacctaaattcttagcatcaatagtatggcctttaccatcaataacaatatccttattaatagcaacaccacctacaaatccagcagcttcatcatcagtcattgcaatatcagaatcaagagttaaaataccatcaacaagatcaatagcattttgcaaatcagtgaatgtttcaatacctaaatgtaattctttagagttatgaatagcttgtggagtattattaacaaatttagaatctttaacagtaactacaggattatttattgcagaatcaatatcaatagctccaccttcaacatcagcagagttattttcaaataatgaatcagaaattgcaatattaccctcacaaatatagatagctccaccatattgagctttattattagtaaagttagaaccagttatagctccagtaatatctttaccagtatcagttactacaatagctgctccattgttattatttggagtcatattacctttaccaaatgcagtattcttatcaaatacacaatcagacacagtaaagtcagagccagctacaaaaatacctgcaccatataatccaccattttctttaaaagtagaaccagatacagttaaagtatttacatcatcaccagcaatcaaataacctgaagctgagatagctccaccccaacggccagagttattaacaaagtaagaatcagaaattgtagcatcaccaatagtagctacagcaccaactaaacggtcaccattcttataattcttaatattattagtgaaattagaaccagatacagttaaaataccgtcataccagttataaatcgctgcaccaccataatcaacactagcagaaccacgattaacaatatcattagaatcaaatacagaattaccgacaactaaatgaccattgttgaatacagcaccaccataactatcagcagcattatcacttaatttaacatcacttaaagttaaagaaccatcattataaatagccccacccttatcagctttaccattaatcaaagtagcattagttaaagtaacagcaaatccttcaccaatactgaaaatcctacctaaattcttagcatcaatagtatggcctttaccatcaataacaatatccttattaatagcaacaccacctacaaatccagcagcttcatcatcagtcattgcaatatcagaatcaagagttaaaataccatcaacaagatcaatagcattttgcaaatcagtgaatgtttcaatacctaaatgtaattctttagagttatgaatagcttgtggagtattattaacaaatttagaattttcaacagttaaatcatttacattacatatagctccacctattttagcagcagagttattaatgaagtttgaatttgtaatctttgaatcaacatttgtaaaaatagctccagcaacaggtgctttattacctacaaatgaagaattatttatggatacaactaaatctttaacacttgcatgagaaaagccaacagctccaccttcagcagtagctatgttattttcaaatacagaatcagtaatagttacaaatcctttattgaagtaagcagcaccaccatattgagctttattattagtaaatttagaaccggaaatagtaccagtgattggttcattgaatctacttacttgagatacaacaagagcaccaccattattattatttggagtcatattacctttaccaaatgcagtattgttatcaaatacacaatcagctatattgtaattagatccccatatgtaaacagcacccgcatataaagcagaattatctttaaatatagtattagatactgttaaagtacttgaatttttccttaattcagcaccagtagctgaaatagctccaccccaacggccagagttattaacaaagttagaaccactaacagtagcattaccaatagtagtaatagcaccaactaaattatccccattcttataattcttaatattattagtaaaattagaattagttacttttaatgtgccctctttccaattataaatcgctgcaccaccataatcaacactagcagaaccacgattaacaatatcattagaatcaaatacagaatcagaaacaaccaattcaccattattgaatacagcaccaccataactatcagcagcattatcacttaatttaacatcacttaaagttaaagaaccatcattataaatagccccacccttatcagctttaccattaatcaaagtagcattagttaaagtaacagcaaatccttcaccaatactgaaaatcctacctaaattcttagcatcaatagtatggcctttaccatcaataacaatatccttattaatagcaacaccacctacaaatccagcagcttcatcatcagtcattgcaatatcagaatcaagagttaaaataccatcaacaagatcaatagcattttgcaaatcagtgaatgtttcaatacctaaatgtaattctttagagttatgaatagcttgtggagtattattaacaaatttagaattttcaacagttaaatcatttacattacatatagctccacctattttagcagcagagttattaatgaagtttgaatttgtaatctttgaatcaacatttgtaaaaatagctccagcaacaggtgctttattacctacaaatgaagaattatttatggatacaactaaatctttaacacttgcatgagaaaagccaacagctccaccttcagcagtagctatgttattttcaaatacagaatcagtaatagttacaaatcctttattgaagtaagcagcaccaccatattgagctttattattagtaaatttagaaccggaaatagtaccagtgattggttcattgaatctacttacttgagatacaacaagagcaccaccattattattatttggagtcatattacctttaccaaatgcagtattgttatcaaatacacaatcagctatattgtaattagatccccatatgtaaacagcacccgcatataaagcagaattatctttaaatatagtattagatactgttaaagtacttgaatttttccttaattcagcaccagtagctgaaatagctccaccccaacggccagagttattaacaaagttagaaccactaacagtagcattaccaatagtagtaatagcaccaactaaattatccccattcttataattcttaatattattagtaaaattagaattagttacttttaatgtgccctctttccaattataaatcgctgcaccaccataatcaacactagcagaaccacgattaacaatatcattagaatcaaatacagaatcagaaacaaccaattcaccattgttgaatacagcaccaccataactatcagcagcattatcacttaatttaacatcacttaaagttaaagaaccatcattataaatagccccacccttatcagctttaccattaatcaaagtagcattagttaaagtaacagcaaatccttcaccaatactgaaaatcctacctaaattcttagcatcaatagtatggcctttaccatcaataacaatatccttattaatagcaacaccacctacaaatccagcagcttcatcatcagtcattgcaatatcagaatcaagagttaaaataccatcaacaagatcaatagcattttgcaaatcagtgaatgtttcaatacctaaatgtaattctttagagttatgaatagcttgtggagtattattaacaaatttagaattttcaacagttaaatcatttacattacatatagctccacctattttagcagcagagttattaatgaagtttgaatttgtaatctttgaatcaacatttgtaaaaatagctccagcaacaggtgctttattacctacaaatgaagaattatttatggatacaactaaatctttaacacttgcatgagaaaagccaacagctccaccttcagcagtagctatgttattttcaaatacagaatcagtaatagttacaaatcctttattgaagtaagcagcaccaccatattgagctttattattagtaaatttagaaccggaaatagtaccagtgattggttcattgaatctacttacttgagatacaacaagagcaccaccattattattatttggagtcatattacctttaccaaatgcagtattgttatcaaatacacaatcagctatattgtaattagatccccatatgtaaacagcacccgcatataaagcagaattatctttaaatatagtattagatactgttaaagtacttgaatttttccttaattcagcaccagtagctgaaatagctccaccccaacggccagagttattaacaaagttagaaccactaacagtagcattaccaatagtagtaatagcaccaactaaattatccccattcttataattcttaatattattagtaaaattagaattagttacttttaatgtgccctctttccaattataaatcgctgcaccaccataatcaacactagcagaaccacgattaacaatatcattagaatcaaatacagaatcagaaacaaccaattcaccattattgaatacagcaccacccatagtagcagcagtattgtttataaaattagtgttatatgcatatacagaaccagtgttatatattgcaccacctatatctgcattaccattaattaaattagcattatatatatttaatttatcagctgttgaggtaacattaaatattctacctaaattattagcattaatagtaaaaccatcacatttaagattaacaagatggtctacaacaataccatttacaaacttatcagcttcactagccaacatagttacattagaacttaaatagatatcaccttcaaccatgtttatagctttttgcaaatcagtaaaggttttaatttcacccatatttaaagtacccctataatagctgtaaatcctattattagtaaatgttgaatcagcatcaatagttaatgtatattcattataaatagcactgccttcttttgcagagttattggtaaatatggaatttttaatatccaaaatagcattacctgttgttccaccttcatatacagcaccaccctgattggatgcagtattgtttataaaagtacagctgtcaacactggcactggaaacaccattattatcatctcctaattcataagcagcaccattatctgcagtattgtttataaaattacaatcagatattgtaccttcacagccataccatgtaagaagagcaccgacattaggatttccacttccataaccaacacctttattgttggtgaaattggttccggatattttgaaagtagaacctatgacatttacagctgccccttggaatgctctatttgaatcaaatactgaattttcaatgataatctgatttttaccagcattagtgtaacctaaagaagttacagctccaccataacatccactgttatttctaaagtaagattttgaaattttagtatatcctgttacgactactacaccagctacaagatctccaacattattgtcacgaataaccatatttttatggttattgattatttgtgaattagaaattaataatgaagcaccattatctgcatagatagctgcaccaccattgccaatattttgacttctgaattgcacatcatttccatcaaaaacagaactgtctacaatacaagttccagtagtgtaaattgcaccaccatatttatagacagtattgtttttgaaattcacattatttactattaaagtagaaccatcaaagtaaacagccccaccattacttacaattcctgaactatcagaaacaggatttgcattaatcaaagtcaaatcatttaatgttaatgtaacagaagaatcttttactacaaaaatacttccatgaccattagcatcaattgtatgaccatttccgttaattatagtattctttgtaatagaaataccataattatctatttcatcatctccatgtttgacatcataagtaagctcaaatacattttgagaattatcaatgtctgtttgtaaagatgtgaaatctttttgaatttcatttggcgtttggtaagtatcatcagcattaatagatacgtcttcagcagaaactgcagacatacttaaaagtactaataaaagaactaacacaccaatattcttttttagactcatgatattattctccttttttaaaattataatttaaagagtctgtaaaattttataggcttatttgattttaatgtgtttttcagtccaattttgcatttgatagtctaaaaatgtcaggattccatttttggttttgtatattttctttattttttcaggattggtttgtctgtagtaattttcgactttatttgatgttttttctatattttcatcatcaagatattctacgtatctgtggaagtgatttatgatatgttttcttatgaaatcttttaaaacaactggtatggccgtatatttttgtaaatattgtttaaattgttctattgcttctttttttgagttttgtctgaaacagttttttaattcttgtgcattttcgtaaatatggtctctttgttttccattaatcttgtttcttctacaatatacttttaatttatggtttattgtttgaaacagatgaaatatgcacaattgatgttttacttctatttcatctgctacattacgatacattgggaataaatcggttgttaggcaaatgaatggtttattttctgttgattctaagataaattttttcgtgttttttggtattctgcgacgtactattcgttctgtgactggaatattgagtattgcatcaaataaagttaatctgtagtgtctagttccattaagtcttaaaaattgctcatcatataaataatagccagaatattcaaatttttcattgctgatgctttcttcgtgatttttgtcagaccagttcttgattgtttgatgagatattctgattccaaggaatatttcaaagtatttacttattttacgaagtgattggtaccctattttcattattcctggaattttatccattatttcttgtaaaaattgtttattttcaccaattaatggattattgtatattccgaatttttttccacattttttgcattgatattgctgttctttgaattctgttgtttttccattagtattttgtttgtttttctttattgtgccttttttgattattttgtggcttccacaaactggacaaatgggattatcatatttaaaagtattattttcatctaaaaatagtttatgattagtattttcaaaattaggtgttttattcaatctttttgaaataattttttcttgatcaattttttcatcaaaaaaatcataaagtttaagttgtatgaagtctatattactattgagggcagatttgttttgtttggtcataaaatattatttgtcctcacttattaaagtattttactatttttaaatcatttatattaaaattaaagaaaaattagaatgaaatttcatcaaaatgaaagttcaactgtaaaaaattaaaaaacaaataagcctataaaattttacagactcaatttaaataaataattataattttaagtgaactaacaattagttagacagtatgtatatttttaacacatcttatataaacttacctatcccatattgaataaaataaaatataatactacaaaataaaaatacagtccatctaattaaattatcaattaaacaaaaaagatatattaaaaaataaaactgaacaaaattaaaataaatcaaaagataaaaataagcaaaaaaaagtattcaaatcaataaataaaaaggaaattgtgtataaaaaataataaaaataataataatacataaacaaaataaatatttagagtattaaatatagttaaaatttagaaagaataattaaacataaatatttaatttacaaattattgacacattttttaaattttgtagccgcttcgccaatagctactatcttattacaatctaaatttaatgcctgattaattccttcttgaacttcatcaaaggttgcgccaagtgtgccttttttgacaaagttatcaacaccatgattcaatataattttttccttaagttcaggacattcacttattttatcactagctattttttgagaagcactggatgccggaacaatgtatttagaaaactctaaaactttattaaatatttccaaatctccttcagcaccggattcagaggaaattgtaataactgtagtgatatcaccatataattttttaaattcacgtaaaaccgtttcaacacctgccggattatgtgcaaaatctacaacaacatctttttcgccaattgtggctactttctccatccttccagaaaccccaccaaaagtagctattgactccaatattttatcataaggtaattttagaaattcatgagctgcaacaattactccaacaacattatagacattatgaattccatcaagaagcattttaacttctaatttttcttccggagtatgtaattcaaaagttctgttttttaaattaatgttggttgcaatataatctagctgaggagttgtcagaccacattcacataaataatagccggaacctgaaataatctctttaacatcaatggttttaccgcaaacacattctttagaagctacacctacaggcatttcatctaccccaaaagtaattatttcacctgcaaagttcaattcccttaaaagccccatgattgttggatcctgaccgtttacaataagttgttttccagccaatccttttataaattctgctttaacatgcgcatactccataaatcctcccaaatcatttaaatgatcaggagttatgtttgttattaatccggaagttaattcagaatttccaactattctttcaatagtgcccggaactccaaatgtgcccacttccaatattccaacatccccatttaaacgagactgtaaaattggaatatattcagcattcccctgcattttttctaaattatgttcaacaggtgcaatattattatcataagctatttttttcagaagggttgtggtagttgtcttaccattagttccggttattccaaataccggtttatttactttaaaaatatcaataatatcactaacttccagaactggaatgtttttttcctgaataatatcaaatacttcagctgttttaggtaaacttattggaggaattatataatctgctttttcaaaaaactcttcaggatgagattcataaaatacttcaatgtcatatccttccaaagattttttaaacctgcaatcatcaccagaggacatatctgttccaataacatcaaatccacggtctttaagaattctagctaccagattacaattagctccacaaattccaattactccaaatgttgtatcttccggaaaatcagactcattcatattttttacttccctcttcaagtcctttcatgattttttcaacagtggtaattctatcataagctataagtggccccatatgcagaataatgtctccaggtttggaatatttgaatgtaagtgcggctgcttcagtaatatccctagtagctactttaattgcacttggattttcaatagcatctaaaacttcatatgcagcatccatctcaactgtttggttaacctcattaaatccactagctattataacatccacatactgtccaacaagctgaccgacttctgtcttatcccttttagataatgtatcaaaatgatctagaaacagtacaacattgtcgtctttaaagtactcaagagtgattttcattccatcatataaaaatgcagaatccaaaataacttttcttccattatactcaccaacatcttccatatgtgcaggaagtcctttaaattcagataatgcatcagtaatatcttccggagaaacaccataagttaaagcaacactgctggcccctacagagttttcaaagaaatagctgaccatgtggaacggtgttgtaaattcccctttagaatatttgagggttaatttttcatcaccggcagttccaataaaatcacaatcatcatctaaagcataataaagagcattgccccttaccggagctataatatccctgcaggaattatttgcaataaatgtttcactcattttttccaaaatcaatttacgttgctgatatttctcaagagaacctccaaattcagacagatggtcttcagcaatattggttaaaagaccaattttaatatccaattcatttagaagccctatagttccatgaggaagttcaaaaatagctatatcacaattttgagctttacctttaactataccatcaataatagcttcactaactaaattattaactaaagaagagcaggaccatactttataacctgcctgtttaaaaatgcttgttgtaataaatgtagtagttgttttacccatagttcccgtgattccaataatatcaacaggaattaaatcatttaccatttttgagaaatcttcattagtaataacctctaaattagcttcagcaactttttttgcaataggtgcactgtcaggcaaacttggagccttataaactttatcaataccatcaatagaaggattatcattacctaaatctaaaataactccctctttttccatttgttttaaaatactttgcacatcttgtttaaaatcagataactgttttggatcagttataataaccttatgattttgattattaagtaaccttgcaacaggcctaccagcatttcctgcaccaataactaaataattcataaatttattcacctataattattatatgattttattaaatttaaagttgaagacaacaccctaaaaagttgattacatttcgactaagtattaaaaacaacctaatgagtgtcttatagaataccctatcaaattatttacataaatagtttcttataaaatacacttttaagaaaaatagctaaaaacattctatagaaatactgaaatttaaaaaaaaagtagtagaaaaaattattcaaattgaatcaagttttctacatcattataaacaacatcaagtccacacatagacggaacataattagctgcttttgctgaatttacaccaattacttcaaagcccctatcttcaataggtgctacgaccatacaggtatcacagaccacattaccacctgcatcttcaataacttttgtataccccattctatcagctgttgcttttacactaactgatgtgcaaatccataatttgtttttaattgattttcctttgacaatatttgcaacttcttttatttcttccaaggaagcatgaggacagcccaaacagattaaatccggttcatcagttgtagtagatagtttgttacgggtgtctaaaatgtcgtcttcagagattgcaatatgatcatcagcttcacttttagcagccacatcatattccggagtaacattctccatatgataaagagctactgaacctgatgacgcaagtgctgctcctaatgtttttaaattattattatcaggaatatttttaagagtaaagtaaggcactccaccaccgacaattttcccaacaacatatccgagagctccgaaatcagcacctgcgagttcggtttcaacatccactactaaattagccgtcctattttcatctaaatggaatccataaagaggagttttaccaacaatagctgctgctaatgctgcaggaccgccttcacgattagttttagcaccaattacagaattaacatatgctactgctgaagattcagaccatgatacatggtctctaaatctaggaacatttccaacaagataaggagtacaagtacatgtttttgagattccaagtttaccgtaagcttctacaatttgattttgtttaattgaaaattcctttggaaatcctagagcttcccaattatccaaatcagttccaggaggatttagggaagaattaacactagctacccctttatcatcactggccaaatcttgaagataatccaaacctgcatcaccaatagttttataagaaactccggaaacctgtgctgaagtgatatccactaatttagaagcaccataaatatctcctaaagccactaatatatccatgctttttctaatagtttctccaaactccccatcacacatttgttcttctttttttgttaaaaacatattaatcattatttatttgatattcaaccatatcattaactaagtttaaaaagttatccttactatcaaatggaatcatagcccctgcagcaatatcatgacctccaccctgaccaccgaaattgttggagctatcctgtaaggcttttcccaaattaactcctttttcaacttgttgtctggttgttcttccagaaactttaatatccttatgaagtctagataatcctaaaacaggttttgaatcatccaacaagttaatagacaaacctatactagctattgtacccattacagatttcaacactttatcctcactgtataaatattgaatattagaaagattaactgaaccttcccttttaatccattccaatcctttaacaagttgatcacggtatttgcgttgcaaatcagtagctgtttttaaggctttttcacgttctccaagagctatgcttaaacctaatccaaacttcttatttttaccgcatgcatcaagaatatatgaatactcttccaaatcacgaagcaaaggtatttcttttggaactgtgtaacaatccccgaagatatccggattgattttaataagttcatctttaagaatatctttttcctcttcacctaaatcagtgaatttaattccataagacaaattcatcttttctaaaaactcagttgaaccttccaaatccccagttattcctggaagcggaggagaaaaagtgtaagctaaagatttaaaaagtggttcagatgatttagaaactattttcaaaccatcatgaatttccaaattaccactttgtttagcatcatcaacaataagtttattaactccagtaaatccatcttgaccttgcatatcaccaaaagcaccaattaaagcaaaataagctaaatgttttttatcaagatccctaactgccaaatagctggaaccagccccacttaaatccctgcttccatcaatgtcaaataaatgaggatttatgtgaaccacattgctttctgcttcaacatcactaacctgatgatgatcagctataataacatcacatttaaaagaattgagttcccctacaaaagaacttcccatatctgaaaaaatgaccaaatcatgtttttcatgccttaactgatttattaaatcttccttaagacgaggaacaatcgtagtatgaaactgaacattttcttcttttaaagcattagctaatacagctgccgctgaaattccatcagcatcattatgagaaataattcttataacgttattgttttctatatgcttcttaagcacattactagcttcactagctctatttaacaaggagtgctgcttcttttggattgtatctccatccttcaggtaatgcaccttcatttacataatatgaagctaatctcctgattctagattcaatgatagttaaacctcttttagagtgtaaatctttaggattttcagctaagtgatctcttatatttactgctcttttgattaagttcattaaatcttcagggtattttccagcttgatcatttctttttaagatttgagtgattctttcaccggttacttctttaacactaggaataccgtattggtctcttaaaataataccgatttcactggtactttttccttctttgttaaattttaaaatcatttcttcaatttcttcatcactgtaagttacccattctggtcttgccataataattacctcttaatattagttataaagtaagcccataataataaattagaaaattattgaatagaataccatttaataaatttttctaaagaattttttctatgtgaaaactggtttttttcttcagttgtaagttctccaaaagttttaccttcagctggaacatagaaaataggatcaaaagcaaaacctaaatctcctttttcttcaactgcgatttcacctatgaccttacctaaaaagatcttgggctcagaattgggggcgcagtacccaataactgacctgaattcggcataacggtcattgacaccatctaaaagctttaatattccctgatttccaagagtttcttgaacataagaagaatatgttccaggaaaaccttttaaagcttttatgaataaaccagcatcttcaacaatcacaggtttattaagtttacgactggcatattttgcacctgatatagctacttcctcaagagttccctgaggttcacagtaacctaaatcaatatgctctaagttaatgtcataatctttaaatatattctctgcttctataactttatgtttgttaccagttataaatgttatcataaaattaattatgaattaaattttttataaaattaactcataatcagttaaaagatttaaatgaacaattcattgtttaggaaagctcagctggtctaaagtaattatatattatcatcaatcttcaataatggtttccaatagttttatcatttcccaatatgtaaaaaaaacttgaacattattcttttatttgcttttcttacaaacttaatcctttagcgaatactcttatgaaaattgatactttttattttatgacttaaaaaattattagaatagcagttattatatgtaaatttcaaaattcttgagaaacataagaaacataagaaacataaattttttttatgttttttatgttttttaataaaacacatatcatcaaccttaatcatcaaccaacatgaatttttttatttttaattaaaatagcttaaatcataaaataagtaatttaaagaattttaaaaaattaatcgtcaactactgaatattctttaatcaaataatagataatttaagattctaatttttaaattttttcgggattgatttgtcagcagcagttatctaatttgttagatgttttttatggaatttatgttttctaatgagaatttttaaatattctgaaaaacataagaaacataagaaacataaattttttttatgttttttatgttttttatgaaatgtattatcagaggttataaacatgaaaaataatccttttagaaaacgaactggaattttgccttcgtatttcactggccgtgaaaatgaattaaatgaacttaaaaaaatatataactcaactaaaataggaattcccggccatttaatattatatggaccaaaaggtattggaaaaacatctttattattaaaatttcaagaggaaataactaatcttgatgatgtatattcagttagaattccattaatggaaggaaattttgaagacatttactcattaataatagaaaaatgttctgacacgttaaatattaatattggccatttttgggagaaaataagttcattaggtattaatataccatttatcggaggcatatctgtatcacgtgaaattccccaaaccagccctgcagttgcatttgaaaaaattttaaatgtgatttatgatgagctaggctctgacaatcctgttttaatcctattgtttgatgatcttcaaaggattatgggcaatgatgaaacaatgaagatattgagtatcttgcagaatgctcttgtagaattaaatctaaaaggaaaaaacataatgtttgtagctactggttcagaagacattttcaacaaaatacaagataaacttgactcagcagtacggatattcgaaccttacttaattggaccattatcctacggcgaagtatatgatgcaatcaatattcctactaaagaacaaaatgtggcctttgaagagaatgtcataaaagaaatatatgaattatcaaacggaattccatattacatgcaaatcctagcttacagctgttttgaagaaacaaatgaagatgataaagtgactatggatgagtttaaaaaggcatctgtgtattccttaaacattttggcccaacgtgaatttaaatcattattctctaaatccactacggaagagcgaaaaatactatgcttaatggctgaaagcaacgaaacaattttatcatattcctatatcaaagataatgctcacctaaactcagaaccctcagcattgctaaaaagtttaattaacaaaaacatgataatcaaaccagcaagaggcaaatacaaattaaaaagtaatctttttaaattatacctgcaaaatttacgtataaatcaggatactggattaattagatagtgataaacttacctaagttacactatccaatattatttaaaacaaacatattcaaaaaacaaaaaatgaaaatgaaccaaaatgatgaaacaatcgatatgacaagaaaacatacctatttttcgaaaaaaatattgcttttcaaaatgctctaaataaaataagtaacagatttttgtgttagaaaaattgtaaaataatatactgaaaaaatgtaaaataatatatggaaaaattgtaaaataatatatggaaaaattgtaaaataatatatggaaaaattgtaaaaataaggagtaatcactatggttgttaaatatttaccgagaatattggataaagatttggaaaaatatcttacaatgattggtgcgattctcattgttggaccgaaatggtgtggcaaaacaactactgccgaacagcatgctaaaagtgtattaaaactacaagacaaagataattataaaacaaatatgatgtgggcagacatagaaccttccagattattgaaaggagagaaaccacgattaattgatgaatggcaggtggctcctgtattgtgggattccgtcagaacaagcgtggatgaaagcgaaggatatggactatatattttaaccggttcaacagtggtcgatgaagacagcatcatgcactcaggaaccggaagaatccatagaatgctgatgaggcctatgagtttgtatgaaagcggtgaatcaaacgggcaaatttcaattatggacttatttgacaatcccgacattaacattaataactgcgaatccagtttaacaataaacgatttgatatttgctgcatgccgcggaggctggccagattcattgaatcaaaaaaccagagagggcaaacttttcgttgcatataattatttggaaaacatttgtaacacagatgtttctgctgttgatggggttaaaagagaccctgatagggtaagagtattattacgttcgcttgcaagaaataattccacactggctaaagaccaaaccattatagatgatattaatgctaattttatggatataagtagacccacatactattcatatgttgatgccttgaaaaaattatttgtaattgaagacaaccgaggatggtccccaaacatcaaatccaaatcagcaatcagatcaggaaataaaaaagtattcattgatccttcaattgccgtagcagcattgaatgcaaatcctaaatcaatggcgaatgatttggaaacattcggatttatttttgaaaatttatgcattcgtgacttaagtgtttatacaaattcccatggcggaaaagtttcatattaccatgacaagtcagatttagaaattgactgtgttgttcacttgagggacggaagatatgcattaatagaatgcaagcttggaagtgaaagaataaacgaaggtgcccaaaatctccttaaaatcaaggagttaattgaaaagaataaaaaattggataatcctacatttcttgcagtgcttactggtggaaaatatgcatacactcgtccggatggcgttaaagtaattccaatcggctgtttaaaatagcatttaatatttatttaaaattaaaacaattggagagttataataaatttacgaagtgaaaagcaatattcaaatatcaaactacatttattttttaattttcaacagttccaaaaaatttaattataactacaaaagaaattttgtatcataagttctggtgcttaaaatctataagcaccggaacttttttataagttttatgcaaacggatttagaaatttgtgtcaatcccacattcaatacactaaaaaaaagaggttctcacatatataaaaataaggtcggcacaacctgtacttttctaatgagtataacgccctctagattctatttcttttattttttcaattattttatctttattttttccatatgattctgcataaccctccaagacattatcaaagtatttgctagctgtagtgttgtctatactttgcaatgattttttcaacacaagcaaatcaactgccttatcttcaaataaatcagaatgtctcccaagaccaaaatctaaaaatactaattttccgcctctaagcatcatattggaagttgtaatatccccatgaataatatccaaactatgtattttagctatctcaactccaattttataagctaaattgtcatcaataacttctttaagcattttaccttcaatagcttccatcaatatagatttattttccaaatcaacatcatacaatacaggagtaattacacctgattttttaacatcagacagcaatttggcttcaagtttagttcttgactttcttattttggaatcaatctcagcaattctgtaagctttcggaattctacttttcaatactgcatttttacctaaatatgaacttttaataatatccgattcagcacctttagctattaaattatcaggtaattttaaatgagaatcattattattaacccatggtgcctccacttcatcagttctgaaacgctgaataattccagtatctttaatatccaaaggaccaaattgattatgcataattaatcccaaccatgcaatcattactccattatcaccgcacagtttcatctcaggcatgcaaaatttggctccgtgttcttcagccattaccttaagcatttccctgagtctggaatttgcagaaactcccccacataacatgacctcatctttttgtgtatgagacagtgccctttctgttacttcaacaagcattgaaaaagcggtttcctgcagtgaaaaacaaacatcttcaattggagtgccttttttaacttcccttaaagctgcagacaataatcctgaaaatgaaaaatccattccctttacaacatatggcaaatcaacataagacccttttttagccaatttttcaattaccggacctcccggatgacccaaaccagtttcacggccaaaatgatcaagacagtttcctgcagcaatgtctaatgtttcaccaaaaatcctatatcttccgctttcatgagagattacctgactatttccaccacttacataaagtgttaccggattaactgcaccagtatctaattttcccacttcaacatgcccaatacaatgattaacaccaattatcggtttatttaatgatagtgccagtgttcttgcagaagtagctacaattcttaaagcaggcccaagaccaggaccctgtgaaaaagagatcaaatccaaatcatcgtaagaaattcccgcttcatcaatagcttttggaattagctttggaatccaatatccatgatgttcggcagctattctaggatgaatacctcctttttcaggaaataattgttctcccgccatagccaatatatttccgtcactatcaactattcctacacctgttttttcagcagttccttcaattcctaaacatatcaaaacaatcaacttaaaaaataatttaatttaatattggtcatttgaaatataaataagatacagttcacgactattttaaaatttgcaaaaacacacattttataatatcacacttcctacaaatatttaaatttcaaaaataaattactaaccatgggattttatagcacaaaaacttctgaagaaaaaagagttaaacaattaacgggagacatacatcttagtgaggaatttaaagaagaaatcaaaaatagagacatcccaatttatcagggatataatatccaaaaaagattaagatttgaagttgaacagggacagcttaaaggtgatgaagtagattccagattaatggaactgttagaagaaaacagtaaaaataatgtttcaaatatctacacacaggaaattaaaaaagattccgacagtccgaacagaatccccccaagacctcaaacaaatgaatttaaaatacctccaagagccagagacggaaaaacattcagcacggatttgactcaaaaagagatgttggaaaaaattattaagcaaaatcaaaaaattataaatcaaaataaaattattattgaagaattaaaaaaggtgaataaatgattgacggaataacaacatacggttctgaggaattaataaaccagataaagtatgcagaacctgtatttatatgtatgataggtacaactgaaacttccaaaatacctggaatatccggagctggagcaacccccgaattaactgaatatacacctgcagcagatgctgaaataatggttcacggaagtgttcattgtatggacgaaatcccccaaacagtagttggagaaactgctgcaccaacaccatcaatgctaactaaagcatccctacaacttgctgatatcccatttgttatagtagatgcaggttccaaaattactcctgatttagaatgcaacagacttggaaaggaatacggaagagatatcagaactggaaaaggagttttaaatccattggaaatttatgaaaatgcaaaagaacttggatcaaagctttcaatgatgcatgactatctagtaatcggagaaagtatagctgcaggaacaactactgctcttggagtcttaagagctcttggatatgatgctaatgagaaagtcagtggaagtatgcctacaaatcctcatgatttaaaaacaaaagtagtggatgaaggattgaaaaatgcaggtcttaatcctgaaactgatgaaattgatgcaatgcaagctattggagcggttggagatccaacccttgcaggaatggctggacttgtaatttctacagacatcccaataattttaggcggtggaacacaaatggctgctgtttgtgcaattgtaaaatccataaaccccaattttgatttttcaaggataaacttagctactacagtttttgtagccaatgatgaaaccgctgatttatttgaccttataaaacagattgatgaagacatcacaatcaatattgtagaccctaattttgaagatgcagagtaccctggattaaaaaattaccttgacggttttgttaaagaaggtgttggggccggcggtgcaatgtttacagcattaattagaggaaactctgttgaaagattaagaaaaaaaatagaaaaggtttgcagtgaatagtatttagaataaatgggttattgaacccataaatactattattcctacaatccaacaataatatgcaaaaatatccaaacttcttttttgaattaattcaagtaaccatttaatagccaaataaccagatattaatgctgctaaaaatccgaataaaatagctaaagcattgaaatctgtgattgttccaatatctttaagttgaactacaaatgctcccaaaatagctggaatagataatataaaactgaatttagcagcaaattctttatctaatcctattacaagtcctgcagctattgtagtacctgaacgtgaaagccccggcaatatagcacatgcctgacctaatcccataaatattgattctttaagtgaaagatttgataaatcaacctcaccagaattcattctttgagataagtaaagaatagtacctgttacaaataagaaaaatgccggaacatataatgcacctgcaaacaatgactctacctgactttcaaataatacaccaactaaacctacaggaatagtagctataattacataccagaccaatcttttataaggatcagagtaaaatccttccttaaatctgtgctgaataatatctccaatacttaataagaatgcctgaatcattctgataatatctgcacggaagaaccataatacagctattaaacttcctaaatgaagaaaaacatcaaaagcaagagaggattctacccctaatgcattttgagcaaagattaaatgagctgaactacttacaggtaagaactcagttaatccctgaacaataccaataataattgcctgaattatatccatttctcacaccatttaaacgtaatccaaccagccaaatttatcttcttttttgccttcaacaatgtcaaagaaagttttttgtaattcttctgaaattggacctcttttacctgcaccaatgattttatgatcaattgaacggataggagtaacttcagcagcagttccgctgaaaaatacttcatcagcaaaatataatctttctcttgaaattctttcttcaactacttcatagcctaaatcattggccaattgtttaatagattcccttgtaattcctttaagattggaagaatccattgaaggagtgtataatactccatcttcaataatgaaaatgttttccccactaccttcagaaacatgcccttcataatcaagcatgatagcttcctcataaccatggtcaatagcttccagtttagctaattgagaattcatataattagcaccacatttagctaatgttgggaaagtatccggagctggttttctccaggatgaaactccaacatctacaccgttagccattccttcctcacctaaataagatccccattcccaagcagcaattacagtattaacaggacaggataacggattaactcctaactgaccatatcctctaaatacaataggacgtatgtaacaggaagctaactcattgattttaacagtatccctaattgcctgtgcaatttcttcttgagtataaggaatatcaattttataaacttttgctgaattaaataaacgttttacatgttcatttaaacgaaaaatacaagtgccttttttattgtcatatgctctaataccttcaaaaacacttgtaccataatggactacatgtgaaagagcatgaatttttgcatctttccaatcaaccatgtttccgtccatccatattttactagcagaatcgtcccatgccatttatatcactttcaattaataattcattagtgtatattatagtgttatttttatttataacttacttatcagacagatgcgaattttatacacaaagtaaacccatgattttataaagtataaaaaataaactaataatagaatatggtggtaaaatgagtaaagatgacagaagtggccttaacccttttactggaaaatctcattatgacaatatagatgatgacaaattcttaaatgaatgttataatgagtattacaataagatagatggccatgaaatattagaccagacacaagaaggccaattaatattaaaggttacttcaaatctaataactgctgttgaagattatttagctaaaattggaagatcagattatacagcagattattatgactgggaagtccatttaattgcagatgaggacgaaaatgcaatgtgcatccctggaggaaaaatcatcgtactttcaggaattctgccaatagccaatactgaagaaaaaatagcatttatcctaggtcatgaaatggcacatgctcttttagaccacagcagaacccagtccagtgttcgaaatacaaaaaatacaataacaaccctttccagaattggaagcctcggacttattcttttaggtgaagaagaattaggacttgctacaagtgcaattacaaatatagcagatatcggatctgaactttttttaatacaaccatttggaagatcccaagaaatagaagcagacaaacttggaatgatgataattcattgggcaggttataacataaggagaattccggcattctggcaatcaatgagtgaagaaaatgccaataattttgatttcttttctacccacccctctgatgataaaagaattgctgcaatgaatgaaatgatatttgaaatagaaaacagaacagacttttatagtcagccagttttatccaacagtacatcaacaagttcaaatatacttgaaaaagtacctacattcgaaacacccagtgcaggagtgtctggaatagctgcaactaaaaatagccattctgcaaatacctgcaaatattgtggaaatattgtaaaaatagatgatatattctgcaccaactgcggaaaaaaaataaaaacggaattaagatgcaataagtgcggacatccagtaaatgatgatgatatattctgcaccaactgcggaaacaaattaaatcatgaattaaaatgcagcaattgcggaagtacagtaaataaagatgatactttttgcttcaattgtggaaataaaatctaaattacttaaaaaaccaaaagctttatatatgataatatcaataaataatgatgtactatggttccgtggtctagtggtatgatacctcccttacaaggaggggatcacgagttcgaatctcgtcggaaccacttcttaactatttttaaaaatttaactattattatatgaatattttatcgttttctaactactttttctaaaatttttgaatagaattatggaaaatattcaatttattaaacagagctaaatcaaaagattaataaatatacaattctataaacaaaagtatagaaattaataggtgaaccaaaatggttgtaaaaataggaattataaaaagtggaaatattggaacttctccagtattagaccttcttttagatgaaagagcagacagaccaaatattgatgtaagagtattcggatctggagcaaaaatgaatcctgaacaagtagaagatgttgtaccaaaagttgatcaatttgacccagatttctgtatcttcattagcccaaacccaggagcacctggaccagctaaagcaagagaattgttatctgaaaaagacatcccggctattatcattggtgatgcaccaggtaaaggtaaaaaagatgaaatggatgaacaaggattaggatacattattgtaatgtctgaccctatgattggtgcaaaaagagaatggttagacccaactgaaatggctattttcaacgcagatattctcaaagtgcttgcagaaaccggagctttaagattagttcaaaacacaattgacggtgtaattgacggagctgcagcaggaaatatcgaattacctaaacttataattactgctgaaaaagctgttgaagcagctggatttgaaaacccatatgcaaaagcaaaagctattgcagcatatgaaatggctggagctgttgcaaacttagatatgaaaggatgtttcatgaccaaaggtttcgaaaacttcatcccattagtagcagcagcacatgaaatggcagcatctgcagcagcattagctgatgaagctagagaaattgaaaaaggaaacgattctgttttaagaacccctcacatgaaagagggtaacactggttgcaaaaccgacttaatcagtaaaccagaataaatataaaaattaaaagtagctttttagctacttacattatctttttttagacaacaaaattttttaaaaaaaattaattctttataaatcttttagctattttttttatcattgttgcaaaaagcacaataacataaacatacatacctgctaaaggattgaacaatgccaatactattgatatcaaagccaacactggtggaatacttaattcaataagcataatccttttatgaggttctataaacttataaatcctttctttaactaaattttctttaaataaataaatatataaaatcagataaagcaatccaaccaacaggataatcaaactaaaaataattacgctttgagagtaatgataaaaagacaatacaaaagaagttgaaaacggtattaaaaccaccaatgccaaaatagccaaatttattgtaagaatagtattatccacttttttatacatcggaatagcattagtagatgcccaaaaatttgaaagaataataaaactaattaaatacagggataactgcggcaacagattattaaccatgtaatcatttaattgagcagaagaatgtattgaattaactgacggaacaacaatctccaaagcaagcaaagtcaaagctacagcataaactccatcagttattgcacttaaacgatcatgagatgcccgttgagagaaatcttcacctgccacttataaaacaccttttgtactaggaatctcatcatgctctatctttattgcttcttttaatgatttggcaaaagctttaaagaccgcttcagcctgatgatgatcatttgctccttttgaaaccccgtaaatatttaatttagccgaagatacaaatgactcaaaaaagtgaacaacaatttcagaagtcatgtctccaattttttcattagtaaaatcaaattccatattgcaatagctgcgcccactaatatcaatagctactttagctactgattcatccataggtactgtagcatcagccattcttttaattccccttttatctccaatagcttgcctgaaagcttcacccaataatataccgacatcttcaatagtgtgatggtcatcaatttcaatgtctccttttgcatcaacaaccaaatcaatcattgaatgttttgaaaatgcctccagcatatgattaaaaaaattcacaccagttgaaatattatattttccctttccgtcaagattcatttctatttgtatatctgtttcagatgtagttcttgaaacatttgattttctatccatagctattcctcaaactattgttaaattaaaagaagagtaaattattcactcttccggagcattacgtataattttaatgcagtgttcagggcatgccatcgcacatatagtacaaacatgacaatatcttaaatccaatacatgtgcaacatcatttattttccatattttacctgcttttggacaaatatcataacaggacccacatcccgtacatctgctttcatcaacctcaatttttaaaataaaaattcccccagaattataactttaaagtggcaacagacattgctttaaatccaatatatacttctttaccaattgtaagatttaaatctttttctgcagataaagttatgtcagaatataaattaagtccaccaacatctatttttacacgaataacctctttttccagtttcatttcaatgattcttcctttaataatattacgaatactggaagtctgaggttccagcatgacaaaaatattatcatagctgattaatgccagtaatttgtctcccactttataatttctatttaacggagtgttaatctcaaattgtttcattttaacagtcatgattcctttagattcatcaatgtctaaaacttcagattcaatttcattaacatccttatgcaattccataatagcattaattttcttacattcttttaaaatagaataaccttcatcagtaagggtagttcccccacctccaccttttccacctttagttgtattaacaattttgacattaagtgctgattctattttatcaatataattcaatgctgttctataagaaaccttaattgatttagcggattcagtcattgactcagtatctaggatgctttccaataattgatattttttaccatccaataagaaggaattcccatcaacattgattttatattcaacacctgccttcacatcggtcatcaatattcctccaaaatataatgaagaatattatgatttttataattaaataatgtttcgatgaaaaaatattaaaaataacagattatttaaataaatacctgtaaaaagttattgaataataacatagacttattctaaaaagcaatgctgattaattatcgatatttttcttaatatctttaaacactacctaaataaattaaaaaaattaaaataaaaataaaataatcataataatcaaaataaaagttgttatattaatttttagttattttaagaaatataaataaataaaaaaaggatttgaaaaatataatcgtgcaaattttatctgaattcgattttttcaactaaatccaacattttacccataactttagacaaaggtccgaatttagaggataatgctcttaaacccacaatatcctcctgagtgaagaatcttacaagtattaatgcaaagaagtacacaatcatacagacaataattcctacaaacaaccaggatgttgtcttaggcataatatatgcaacaacacccattatcattgaagcagcaaatattttaattactgaaactttaggggctttaacctgagttaatttgaataccatataaagtataggcaccatcattgcaaaacaggctattgaagtagctgcagcaccgcctgcaatacctaaagttggaaccataacccaatttaaaacagctgtcaaaatagctccaaatactaatatgtacataggaattctcggattaccaataccctgaacaatacttgttgaaattgaaaatattgagtagaatgtcataccaatagacaaaatagctaatgcagatgcacctgcaacataagccggattagtgaaataaagcaatcttaaaataggagctgcaaaacaagccaatcctatacacattggaacaacgaacagtaaagaaaatttatatgcttcagaaacatatttttccagtgctaccttatttcccgccctgaatgcctcagaagaagccggcaaaattgttgtagctattgaaatagaaatcattaatggcaatctggatataggatcagcagctgcaaaaaatccgacagcttctaaagctaaaaatttacccataaccatagtacagatattgtaaataagcatttcagcaatagctgtaataattacaggaatggagaatttaactaaagtagtagccaaattcaattcatctctccaggtaaacttaaaatctacactggcaggaggaatatattttgccatatgatgtctgaatatatatactgcagaaaccgctgccgctgcaaaacctattacagtaccccacagtgcaccagtaacagaaaatccaattaaaacaaatgcagttgcaaataaaatcattcctaactgctctacagcacgagtatatacaatatactccattttatatactccctggaatgctcctctaaaagcaccgacaataacactaaacggagtaataagacctacaatctgcaggggaacaagtgtttccggttttcccaaataatcgtaagcaagccatggagcaacaatgaaaaccataattactccaaagaatattcccagaaataccatgatttttaaagctacataaatcgttttacgggccatgtcatgttcatttacaacttcatattctgcaacatacttagctattgccggagggagtccaccagcagacaatgtttggaatattccctgaaatggcaaagtagtagctaaaataccccaactagttgggcctaaaagagcagccattaaaaaacggtacagataccctccaatacggaagataatattacctataaaaataataaagctacctctaactaacttatttgccataacataacctaataaaaaaaatttgattaaaataaaaaaactatactaatataaattaattttactatataaatatactcattgcaataacttaatcaatgtatttttttaaaaatttttcaaattctgttaatgttctgtttaatgattcaaaaccataatcatctttttttatatcttcaatagaatctctagaccaaaaagaagctcccaaattagatccaaaaggtccaccacttaccgggattattccatgtatcatgaaataagttatattttttaaatgggcaaaatcctgacctcctgttctgtctccaccaacagcaatactcattccaatttttcctcttaaaatattataatcaacagcttccagagcacgtgttctgtccataatagctgacaagttactgcttatacctccgctttgaacaggagtagccagtattagtccgtcacattgctgaagtttttcatatacttccagcatatcatcatgactaatgcattttttgtgttccaagcaataatcacaatgcatacaaggaccaatatcttttccaaaacaactaaatagctctgtttcaaatccatgattatttaatttatccaatgcttccttcaaaacatggtatgttgtatcatttctaggactcccacagataccaaaaactttcatttaatcaacctcaattaaatgtttataattaaatactttaaatagtttaaacaaatttagaaatattaaattaaactggtgataattattacaaaagataaaacaacatggctcccacttatattggtggcattggcttcatttataataactttagattcgacttttatgaatgtaagtatttcacaactagttttagacttaaatacttcgttaagcacaatacaattaattatttgtttttatactttaattactgcctcattaatgcttgttggatctaaattacaggatattgtcggaaaaaagaaaatatttttaataggtgcactaatttacggaatgggtgcactaattgcttccataagtcagaatgcaactacattatttattggatggtccatacttgaaggattgggcggtgcattgatgacccccgctacaatttccataattagtggaacatataaagataacaaacgtacctttgcccttgcaatcagcagtgcaattgcaggaatagctgcagctatcggaccattatttggaggagttgtaactacatttttaagctggagattcggatttgtacttgaactgttaatagttgtattcatattcttattctcatataaaattaaaaactttaaacctcaccttaccataagtgattttgatataattggagctattttatgtgtaagcggattgataagtcttgttttgggaatattatgtttaaaacaccaccagttaacaacattgattttaatttcattatcagttattttacttgtaactttcggaatatttgaaaataaacaaaagaaaaaaggaaaaacacctttagtagatatcagcttacttaaaaatcataatttaaaaacaggaatgggaatacgtttgataactaatttatcacttgccggagcattatttgcagtgtctgtattcctgcaaagtgtattgcatttaagtgcatttaaaaccggattaactttacttccatccacagttggccttctaataacttcattacttgctccgaaattagctatgaaatttaatcataaaattataatgattataggattcatattggctatcggatcaacatttttacttaaataccaatttggattaaatacacacttcatagacatagccccaggattaaccgtctttggactgggattaggatttgtcatttcacttggtgtggacatttcacttaataccactcctgaagaaaaacaaagtacagcatcaggacttattacaacaagccaaactttaggatcatcaatgggaactgccataatcggatgtattctcataattggagcgtttagcggattgcatgatgcagtagatacttatgctcccaattatctagatgacaacaatattacccaccacagtggaaaatatcttgaaaaattaggtcatgtaaacacaacagaactgaaacatgaaaacagcctaactgaaaaaattgtaaataccatattaaaagacgcaatgaaacttgtgatggatgttacggcaatcctgctgacaattggattatgtctaaccttaacactacacgatgagaaaattagaaaaaaatataataactaagctacataattataatattaaatatagaggaataaaatatgaaaactggaaaaggtgttgtaaaaaaatattctagagaatacaatagaactcttaaaaatggtgaaaagaaaaaatacacaacaaaacagatacaaatcacaatacctaaacatgatgatatatacgaagataaagaagaagttttaattattcctcaaagtgaaattgaagagtttaagaacttggaagataaagttagtgcacttgaaatagccaattatatctacaccaatgaaatagaaaccaccccaaaagtaaatgtcgaagcatttgaaaatgagattaatcagcttaaacaagaaaaagatcaattattatctactcttgaaaatgaatcttcaaaattagaaactttaaaagacaagcattctaaattaattgaagaaaacgaaaacatcaaaaccaaattcgtgaatatcaaacaggaaactgaaaacatcaaaaccaaattcacaagcataaaagacgaaaacaaaaacctcaaggacaaatgttcatacataaaagatgaaaacaaaagcattaaagatagctacgaaagaataagcaataaatacactagcttaaaacaggacacacttaatactaaaaccagctatgcaaatatttttgaaagtaatcaaaacctagaaaaagaacttaaaagtatgtatgatgaatacaacgaattagttgataaatataatgaattagaagaagaaaattacttcctcaaatcaaataaaagtcatgatgaatatatagctaatagaattaaagaatttattttaaaaacagactaaaattcatcatcccagaactcttctggacaccatctttttaaacctggtataaatccaacagtaatacctgtagcttggttttcaggcaatctaggatttttttccatcatttcctttgtttttcttgtaatcatttcttcaagagttatatcaggttctgtaaattccccattttgaaaacaatctttacaatattcatcatttaaactaccatctgcgttagtaccataatctgcttttacaattggcctgccgcaagaattacaaaatcccatattataatctccttttttaaaaaaaaatagaataaattaaatcaaaagatttaatttacttgttcgtcttcatcaagtgcaagtctcatactatctggatcttgtgggaaatgtgctaagaagtcttcagcagctcttcttacatctctagaaccaataatgtatctacctgcaataataatatctgcaccttttgaagtagcttcctctactttattaggagtaattcctccagctactgcaactaaaccgtcaccaatgagttttttaatggatttaatattaccccattcagtcatttcactggtatcttcacctttttcagctttgtaagtttctaaatccacatttctgtgtaataaaactatatccggttttaagtcatctggaagagcagataatttttcttcaaagtcagccacattcatcatatcaaggattgaataaataccttgtttttgagtttcatgaatagctttcttaatagattcgatagttccaagaccagaaatagctactgcatctgctgtttcatctgcagccatttttatttctactctaccaacatctaaagtttttaggtcagctataatgaatgcacttggacgtaattccctaatttttccaacaacaccgacaccgaattttttaacaagtggagttcccgcttcaataagaactctttctttatcaggcaaatcgttgatgattctttccatagcgtctaagttgtctaaatcaagtgcaacttgtaaatatggtggggaccaaagtttttgtactctgaagcccataattgggtgagttccacgatctttttctgcaagtactttgtcaatagatgggtaaccttccatagcccttctaatagctaatttagttgctccatagttgtattgatatattttcctataattttttgcagcagggtcaataaatacacttacattaattacgatgtcctcaacgatgtcttttggaatgtatccttcttctactgcatcagctactgccctaccaacagcagtttgtgcaggtccaaatactttagcagcatcgtctaaatctccaacagtaactttaggaatgattaaagttgctggtttagtcattaaatttggtctaattacagtggttaatggagtgtggcccacagataaatttgataatccgtttgcaaaagcttgacctacaggtccttctttttcaccgattattaaatcaatatgagctaactcgtttccatcaccaataagagcttctcctatattgtacattaaatagttcctccgtatattatatacaatatataattatatttttttaattaaataaagctaactactaaaaaacaagttactgataatattgctctaaaagtgtaaattttgatttaaaatacaataatgccctaaaaacatgaaattaaagcttaaaaaaagataaaaaatatatataagtccttacaaagtataatctggaatatgtaactaaaacatatttcaaaattattgaaaggttagtcatgaatgtcttatcaaacctccatatattcaataaacacatcaccttgaataaatagatatgtggatttatccccccacatatctataattctcataaaaatatgtttgatttatccaacacttattttacactaaaagaagttaaattcatgagagaaaaaatagttataatttttttatccaataccgaagattatgaaaattaataatcagacacatccataactaaaaaaaagtttatttttcaaaaaaagaaagattggaaaccttcaaaaaagaaggtttattggaaattaattcttgttgagatatcttttggtaaaggtaatcctctgtaaggcattcctttggttttgtcaagaatctctttaattaattcatccacagtcatgtcaaccttttcaccagtttcacgaactgttacggagaacacaccagattctttttcattgtctccaacaacaaatatgtaaggaatccattcagtagcagcattccttatttttttaccaacactttcatccctgtcatctacatcaacacgaatattttcagcattgattttatcatataattcattagcaaagtctttgtgatcttcaccaacagttataatccttacttcaataggacttaaccaggtaggtaacattggagctttttcatctaattcaatagctgttttttcaagtaaactgcagataaccctttctatacttccagttggactgcagtgaagaatagttggataatgttcttttccatcttctccaagatatgtaatatcaaatcttttaccactttcaacatctatttgaacagtcggattttcaattggtcttcctaagtagtcaatagctgcaaagtctattttacaagaccagtaatgttttctttcaggtaaaatttcaagtaaaactggtttacctatttttttaccgatgctatacatccaatctttattttcatcatagaaatctttagtagctctgaaaattatttcataattaacatccaaatctacacctgtctgaatacacatatcagtttgttttgagaattcttctaaggtactgttcatatcagcacagaaactatggaaatccggcatagtaaatgctcttaatcttttaagacctacaacttctccttttttctcaaaacggaaactgtaagtggataattcatagagttttgcaggtaaatttttccaggtaataaatggatcagccattactctaaatgcaccaaaacagcatgcaaatctaagcattaagtttttcttggtgtctgttctgtattgtctttctccaaatttagctgcatgaacattaatagcttcgttgtccaaatcatagaaaattggagtttcaataggcattgctccttggtctacaactaaattataaacataatcagcaagtaaatcgcgaactaaacgtccttttgggaaccatttgaggtttcctacatcagatgcactttcatagtcacataactctttttccctcattaatttaacatgaggtggttctcctgcatcagatgcgccggtaccaagttcatagctaacaagtttttccaactgatcattttcaaatttgaaatcatcaatatcgataattttatctccatccagaatagaccatgaagaaggttttttctctacttcctcttcctcttcctcttcagcagtaatggttcttgaaagttcacttaatgggtgtcctttacaggaaatttcaaatgccttataccatccgaaaggtactcttttaacatttaatccttcagcatctaaagcttcttcagcatcttttaatacttgaacagctacttttggagagcttaaagaagaagataagtgagcatatggatataaaactatattttctgctttaacttggtcattagttttaataacttctttaactaaatttttaacaatcccttgtgggttattttcgtcgtctttttcaacagctgtaaatacaactaaagattcgtcaaatgctccttgttttttagcatcttcgatttcttcagctacaggtgttttattttttacattgtaatttaaataatcagaatgaataagtagtattctcatttaaccaccataaatatattaatttaaattatattgattatattatttaaaacatgttatgcgataaataattatacaacaacaatccataaaataatattatgagaattatattagcaggaactggtagtgcagttggaaaaacaacaatagctactggaattatgaaagcattaagcgaagaatataatgtccaaccatttaaagtagggccagactatattgatccaacttaccacacattagctaccggaaatacctcaagaaatcttgattcattttttatgaaagagggacaggtaagagatgcatttttaaaagccatggaaaaaaaagacattgcaattattgaaggcgtccgtggcctttatgagggtattgactctataaatgatattggaagtacagcatcaatagctaaatctttaaatgctcctgttattttaattattaattctagaagtttagtaaaaagtgctgctgctttagttttaggatttaaagcattagaccctgaaattaatattgctggagtcatactaaataaagtaaaaaacaatgcccattacttaaagactaaaaaatccattgaagaaattactgatgttgaagtaatcggaggaattatccgtgatgactcaatatccattgagcaaagacatttgggattagttcctgcagttgaaagagaaaattccctgtcttttattgaactttggtcaaatataataaaagaatctattgatttagacagattggttgaaatagctaaagaggctccaaaattaacttcaccaagagaagatatctggaataaactgaataaacagaaggttaaaattggagtggcatatgatgaagtatttaatttttattataaggaaaatattgaatctctggaagccaatagctgcaaagtggaatatttctcacctctaaaagatgaatcccttccagatgtagacggattatatattggcggaggatatcctgaattattttctaaagaattatcccaaaacacagtcctgctaaaacagataaaacaattccatatggaaaacagacctatttttgctgaatgtggaggtttaatgtatcttatgaattctattcatgaagacaaacaagttggagtttatccatataattcaattttaactgataaagttcaggccttaaaatatacaatagccgaagttaagaaagacaatataatctctaaaaaaggtgaaaaattcaatggacatgaattccattactcaaaagttctagtagacaattccaatataaaacatgatttagcttttaatattttaagaggaaaaggttcatataataatcaagacggatttatggaaaaaaacacacttgcaagctatgtacatacacatgtagcagctatgcctaatttcggagggaatttagctatttctgcaagagaagttggaggataatttttatgaactttaaaaactttgactttttttcaccatatattgtagcaattgcaataatggtttttttatcaatgggatatatcggatcatttaattacagattcgagtatcctttaagtgcagaaacaatcggaacagttttacttgcaacactggtatttttaattggagcaggaattataaaatctcaagttacaatatatgaaaatgaatcttctccaatatatataaaaataaacaacttttttaaccaaaaaatattaattacacttgttttaatagcgattatacttcaatcaataaatatgattcttattggaggaattccacttttcaacagcgtactgaaatcaaatgcaactacaaacatctggagaatagcttatccattatttttaattatgataaatcttttaatagccaaatattataaaaaaagatatctgattttggttttaattggagctttaatatttggattaaatggatatagaacatcagtacttggaattttagccagtatatttattacaatgtattatatcaataaaataaatagaaaaataggaattttatttgtgggattgatcataatcggtttactggctatcggatatattgcatcacagtccatttcaggccagcactggatgttgaatcctcttgagctaatattttacagagcaggatttacccttgaagtatttcaaagaatcttaaacttgggaggcactactcatggccatattttatctatgattttttcaagtggcagcccaagaacttttattggactgtatgtccttacagacaatgtttgtataacttccaccatgtttggaccggcatatcttgattttggattaactggtgttttaatacaaatgtttttcatggggatattcttaaaagtcctcaatatagttggaaaatataaaaaagaagttggaataggaatctattccataattttaacacataccttaatctggattgaaacaggacctacagatattatgatatggttcctgtatttattgggatttattgtgattgttttaaattataaaaatattaaatttaaacaaaaattaatataatcaatataattaatgaaacaaagaatataacggttcctctaataatgaaatacctgtttctttctgaaaagaaataagttaatccataagacattactaatgcaacaagcatttcaactaaaccgccaattccaccaccagcttttaaaacattgcctaaaagataggataatgcataagagacaattacaactaaaagtataactgctatagggttagctaaaagtctggataatgtttcactaatattaaaactcatttttggtttagaatcataataataagaatttacaggagccaaacttgctctttgttgagacctattatgaccttcaaatttagacagcaatccatgagaacgatgagagttatcataagcatgcaaagaatttgagctgttataaataaattctttttcatcctgttttctcattaaataatccatatcatcagaatcatatgaataatcataataatcttcattagctacttcctcttcttttccgacatccaaagttgattgagtttctgttttatcctgatattttttagccagttcaactaaatcatccctatcaacaagcttgatattttttctaagagcataattagtagcctgatttgtaaaactagatgatgcaataatagctactttagaagcttttaaactttcagctacacgttccatatctcttaatacatcaacgccaacttcaaaatttttatcatagtttttacatgctacaactactccaaaatccccgattgttgtaggcaaaattgcataaatatctataaccctttgtgaagttttaaaattcttataaactttaaaacctgaatcctccatcactttagctataaaattaatcaattgtggtttttccaattttccacccgtaagtgtttatttcaaaaaaaatctattaatataatttatacatgaaattgttattaaagtttatcatatcagcataaattattttaagtaccaaaatattattaaaatatatgaaagcattaataagtaacgatgacggagtaaatgcaacaggaatactagctgccaaaaatgcaattgaagatttatgtgaagtttgtgtagtggcccctgaaacccaacaaagtggaattggacatgcaataactctttatgaccctttaagaataaatccaacaactttaagagataaaagccaagcttatggagtaactggaacaccaactgatgcagttaccttcggattatttgaaattatgggagaaaaaccggatataatgatttctggaataaacaccggtttcaatattggaaaagctgaattaacaacttccggaacaataggtgctgcacttgaagctgcaagttttggaattccttcaatagctatttctcaggaagttacaagagattatattaaatttgaaaatggaaccgtagatattgattttagttttgcaggtaaaatgcttagaaaacttgtaaaaatagtatttaaaaaaggattgcctgatggcattgacttattaaatgtaaatatacctgaaaatccagtagatgaagaatttgaagttgcaaaacttggaaacagaatgtacactccaataattcaaagaagattggatccacgtggaaaaccttattattggattggaggagacccttacaattcagactgtgaaggtacagatggccattgccttaaaaaactaaataaagcaaccataaccccacttacaattgatttaaccggagaaatggatttaataaaagaatggttaaaatagcttaaagttttaaatctttaagtattttatctctttcttcacgaagttcatttaaaattttctcgtcattacacccttctttttgcaatctagctaaagtttgtgtaattgcttctaaattttgttctaataaattaattgccataatctattttatgtaaacattaagtatatgaactttattaacaaacaactgcataagttatataaagctaaaaaattaatattataatataaaaatcaaggtttgatttaatgaacaacaatgatgaaattaataaattatttttacaatttaaaggtaaaaatgttagtgtagatcttagagacgataatcgcagtgaaggcaaagtaatagctgttgataattacttaaatctagtccttgaaactgaaaacggattagaaactataaaaggtggaaatgtagttttagttagtttaaaagactagctaataatctactaaaatccccaaaatctcctttttaccattataaacatctctagctatttgtgctgcgccaatagctccggattctttagaaataatttttaaagaatacttgtttttaaagtacttgttaatctcattttcaaaattaaaaggtttggttgcactgcctacagaacctgttaaaacaataccttcaatttcattttcacaaacaacatccaaacctgcaatttccatagctacagtcattattaaagtatcaatagccaatttagctttttcatccccggattcataattatccaataattgatctttcatattagctactttaccgtcaatatcagctatttttatagcacctgcatgtgaaaaacgattatttgctgaaaaatcttcctcatcaatttgtcttatcatttccagatcaattggtccatggacaatacccatagcacctaaacaagcatccatagctcctttaattttaccgttttcaattaaaatatccacactattggagctaatatctgctacaatcatatttttccagccagtttctaaaaatgcattataacatatgctaactttttcaggactggcctgatgagagtaagctgctctgaataatttatccaatgaatcagaatccttatgaagaccaggtatcataacagccggaatatttgagtcctctatttcactaaaaacaaatgttcctccgccggtgacctttccggctccattaatagatagaattcccctattttttacctgagtaatgttttgaatcttatttatcccatcacccattgcataagtaactgccatcaaatcaatagagtttaaatcaactcttttagataattcctcaatagccgatactttgccctgtttactttcttctcttccaattttaaaaacatctataacttcaccatcatcagacataatacaaaaagagattccagtagttccatgatccattcctataaaaaccataataattgcatccaaaaaaataattataaaaaaaagagaaaaaagagaaataatgattaaattatttaatcatctttttgtaatccacaagcttttctgagtctttctccaacaacttcaatagtttcttggtcttcagcagccctcatttcttttaagtttgctgcatcagttgcattttcatcagcaaattgttttttgaaagtaccatcttgaatttcagataaaacttttttcataccttttttagtttcttcagttatgacatagtcccttctggttaatccaccatattctgcagtattacttacatctttccacattccgccgaaaccatgttcataaatatcatcaacaataagttttacttcgtgacaggtttcaaagtaagcaatttcaggttggtaaccagcttctactaaagtttggaaaccagcattaattaatgcagtaagtccaccacataaaacagcttgttcaccaaataaatcagtttcagtttcttctttaaaagtagtttcaattacaccagctttagtgaaaccacaagcttttgccatacctaatgcaagttgtaatgcatctccagtagcgtcttgttcaatagctactaatccaggaattccaaaaccgtctaagtaagtagttcttactctagaacctggtcctttaggagcaaacattacaatattaacatcttcatcaggtttgattaatccaaagtgaatgttatatccgtgagagaaggaaatggtatttccagcttcaacataaggtgcaatttgttcattgtaaactttttcttggatttcatcaggaagtaaaatatggatgatatctgcttctttagctgcatcagagaaggtttttacagtcataccatcttctttagctaaattccaagaattaccattttctctaagtccaacaataacattgacaccactgtcagccatgtttctagattgtgctctaccttggcttccataacccattacagctacggttttaccttcaagagcatcagtatttacatctgattcgtaatacattttcattttaacttctcctatataattgataaatgtgagatatttaaagtacttcaaatatcaagtagtatatattattttttctacttataaaagtaactaatgttaagaaaaattattattttatacaaaacttattgatttaacatcaatatttctcaatcaggttaattttaaattataagaacaatatctcaattaaaagtaattttaactggttaaaatacgtttaaatttatataagttaaaatacaactatattttaaaaatatagactgaactccatctagatgaggacaattaaatatgaataataaaattatatcatatacctcctactaaataagaaggaggaatccatcttgaattatgagtatttttctataattccaataattatatgttttttcataattatgattcttgaaaaaatattataataactattatagaataagagaattatttttggctttttatctttgctgaaacccttatttagcacagtctaatcattttttccaagttaattctcaaaataaatcaaattcaaaaacattaccattacgatttataaaaaaataataaattattaaaataagattaaaattataaaaatgttgttagattataagttcatacctataatccccttaataacaacattgtctagataagactattttctcatacttgaattataagaaagtataagcaaacccctttggctttgcttattaattagtagccaataatatatataatttctgtttaaacaaaagaaaaattgataataccttaaaaaattgctttagatgtgaaatatttaattaaaatacctaaaaatagaaaaaagtagacgataattatctatcatctactacaacatctaatttacctgtaacaatgtccatcataagaccatgaattggtacatctggaataagaggatgatttctaattttttcaactgtgtctataacattttcctcttcatcttcaaatccgccaatccaagattttaaatcaactttgtcaatttcttcttgagggattcccctctcaatcatagcatttcttaatttatcagggtcagaacctgccattccacattcggtgtggccaataaccaaaacttcttcagcaccaagtgagaaaattgcagcagctattgaacgaatagcatcttcacctacaattgtatttcctgcatttttgattatcttagcatcaccccttccaataccaagcgctggttctaaaaatccagttaatctacaatccatacaagttaagatagctaactttttttggggatggtgggataattcctcacctacaaattcatctacaaatttcttattattctccaaaatttcattaaggatcatcatgaacgaaatccacgggacattgcagtaagaccagtacgtgaaatctttttaataccatatccttttaaaagggataggaatgcatctatcttttcaatgtcacctgtaatttcaataattaaagcttcttcacaaacatctacaattttagctctaaagatgtttacatactgcattatttctgctctagctttttcatttggaatattaactttaactagacataactctcttttaacagcattttcagtgatatcttttattttaataacatctacaagcttattcagttgttttgtaacttgctccaataatttttgatctgctttaacagtgataatcatacgggccaatccttcaacttcagattctccaactgtaatactatcaatgttaaaacctcttcttgtaaataggccagcaactttttgcaatactcccggcttatcttcaactaatgcatttataacatgatattctaaagccatttaactcacctatacatctttttcaagtttatattcaccaatcatttcatcaatagctgcacctggcggcaccatcggtaaagtttcatctttatcaattataacatcaagcaaaataggttcattatccttaatagctgattttaatgcctctttagtttctccaggttttgtaattctggttgcattaactccaaaactttcagctaatttaacaaaatcaggacttgttcctaatttagtttcagaatatcttccattatataataagttttgccattgataaaccattccaagagttctattttctaaaacaactgcaataacaggaatatcataatctttaatagtagctaactcctgacaaaccattaaaaatcctccgtcaccattaatggatacaacaggatcttcaggacatgctactttagctccaatagctgcaggcaatccgaatcccatagttcccaaacccccggaagatatgaatttacgtggcttttgagtatcatagaaatgagccgcccacatttgattttgacctacatcagttgttaaaatagaatcaggagttaaaacttcactgatttctcggataacactttgtggttttaatggaatatcatcataagtaactctagggaaacattcttttttacgttctataagaagtttaacccatttttttgcatcttcgttactttcataatcttttaaaacattatttaatgaagataaaacatttttagcatcccctacaataggcaaatcaacatctacatttttacctatttcagcaggatcaatgtctatatggataattttagaattaggtgcaaaactgtctaatcttcctgttgccctgtctgaaaatcttatacctacagctataatcaagtcactttcatttattgaatcattagctacttttcttccatgcattccaagcatgcccaatgccatatcatctgtttcatcaatagctcctttaccaagtaatgatgtcatgaccggagcattaattaagtaagataattctttcaactcctgtgaagcattagctaatataactcctgcacctgcaaggataatcggttttttagattcccttattaaatcacgggcttttctaacttgtttaatgtttccttttaaagttggattataacctggtgttgaaattaatgaatcatcaaaagaatccaattctccttcctgaatttcttttggaacatcaattaaaaccggacccggccttccactttcagctatttcaaagcttgttttaacaatggaaggtattaaattaggatcttttggctggaaactgtgtttagtaataggcatagtaattcctataatatcagcttcttgaaaagcgtcattacctattaaatgtgttggtacttgaccagtaatagctatgattggagaagaatccatataagcagtagcaataccggttacaagattagttgcaccagggccagaagtagccaaacacacacccactttaccagaagctcttgcaaatccatctgctgcatgagctgcacactgttcatgtctaaccaatatatgatccatgtctgcatcatataacatgtcataaaacggtatggtttgtcctccaggataaccaaagattgtatttacccccattctttttagggattcaattattgcttctccgcctctcattataaaaaccttaattttttttatttaatgattaaagtttattaatgaaaatatataaaagtatcttagttttttaagaaaaaataatgaaaattaaaatttgaaaaaaagttattttaaaaagtgataaagaactgctttttgtgcatgaagtctgttttcagcttcatcaaagaccactgattgaggaccatcaataacttcaccactaacttcctgaccacgaatagccggtaagcaatgcataaaaatagccccatcattagctaaactcattaaattagaattaacttgataaggtgcaaaatctttttgtctttgttctgcttctttttcatcacccatacttacccaaacatcagtatagactacatccacattatcaagagcgacttttaaatcagaactaatagtaatttccttgttatgttcttctgctaattttttagccatattaacaatgtcttcgttaggttcataaccttcagggcatgctacagacatgtccattccaacaagaggtgccattaaaagcaaagaattacatacattgtttccatcaccaacaaaacaaagttttttgccttccaatttacccaaatgttcctgaatagttaacatatcagctaaagcttggcaagggtgttccaagttagttaaaccactgataaccggaacatcagaatatttagctaattccacaacatcatcatgttcaatagcacgtatcattattccatctacaaaacgacttaaaacttttgcagtatccggaataggttctcctctacccatttgtaattctgaagaggataaaaacaatgcctgaccacctaactgatacatacctacatcaaaagataccctagtccttgtagatgatttttgaaatatcatagctaatgatttacctgctaaaggtttttcttccatttttccttctttgaaatttttagctaattctaaaatatccagtacttcatctttgatgtcacaaacagacaataaattgctcatagtttaacccttctttaatcttaacaaaataaaatatatataattattatatattaaagttttctataccatttaatataacaaacagaaataaaagcatattataaagctaaaatgatttttaaggtttaatcctgaaaaataaagctaaagttttaaaaaaaggattaaaaaagaatttaaaaatcttttttacctattttttaaaaataataatcctaaaatttaatttaagatttctttcatgtgttctactcttttattaacaaggtcagtagttcccacatcacttctgtgatatacattaccttttatacaagcacatgctttttcagctattttttcagcttcttcaatactgtctccactagctacaatacctaatgctctagaacctgaaaggtgaatttcgtcatcttcaagacctactgctgcatagaatactttagctcctaaatcttcaatagttttttcatccacttcaatagtttcgcctgcatgagaagtttcaggatatccgtcaggaactatatatttacatacgctagctttgtcattgaattccactttatctaaattaccgtcaacaatagcctgacatacatcagctaatggagttttaagtaatggtaaaacattcatagcttcaggatctccaaatcttgcattatattctattaatttaggcccatctgcagttaacataaattgaccataaagaatacctttatatggttctgcttcttttgcaatagctttcaatgtagcttccattatttttactgcttcatcataatcatcctgagataaaaatggtaataatcctcctttatcagagtaagaacccattccaccagtaattgcacctacatctccttcaaaagcatgaggatgatcctgtgctgcaggcattggtgcaaggtgagttccatcacaaaaagcctgaatagtaaattcttcaccaattaacctttcttcaataataacctgagtaaaaccacccattgcattatcaattacttctttggaatattctttagcttcctgattatcttttaagtggtcgcctacgattttaactccttttccaccagttaaacctacaggttttactacaacatccctgtcaaagtcatctaaaaatgcactaacatcatcataattgtcaaatactttgtaaacaagagatccctcaatatcataatcttcaaataattttctcatgaaagatttgtcagtttctattctggctgcactttgagacggtccgacacagctaattccatttttttcaagttcatcaacaattcctttacctaaaggagcttcaggaccaataaatgctatgtcaatattgttatcaacagcaaacttggctactttttctatttccccttcatcaccctgtgcaaattcagctatttttgaaataccaggatttactttgctcatataacaatataactcaacatcatctttaagtgcatctgctattgcatgttcacgagcaccagttccaactactaagaccttcataataattcaccaatttcttaatatattatagatttatataaattgacattaaaatatattacctatattttaaggggaaatcgaatggaactaaacaataatatgaaagatattactggcgaccctaaaaaagctgttaaaaaactggcttatcccattataataagtatgcttcttataatgagcaataatcttatagatagtatttgggttgctggattaggtcccagaccactagctgcaatcggttttgtaactccattatttcttattttagcaggaattggaacaggtattggtgcaggtgtaaattcattaatttcccgatatgtcggaagcaaaaatcagttaaaagcaaacgaagcagctatccagtcaatagttttaggtattattgtttccataatagttacagttatttttgtagtaattctagaaccgacactttatatcatgggtgcgaaggaagtatttaactatgcaattgattacggaagaccattatttatattttcaatagttacaatacttccggtagcttatgcaggaatattcagagctgaaggagatattaaaagagcaacccttccaatgtgtatttcagctattctaaacatgattttagaccctatttttatttatactttaaatttaggaataactggtgcggcgatagctacattaattagtatttttattgaactgctgataattctttattggatgtttattaaaaaagacacatacttcaaatatacatttaaaaactttaaaatcaattgggggatgtataaagaaattttaaatgtaggaattcccgcagggcttgaagaacttctaatggcagttgttgcaattgcagttaatttaatctttgaaatagttggaggaacatcggctgtagctacctatacaattgtaatgagattaataagcattgcaataatgcctactataggaattgcaacttcaaccattacagttgttggaatagcttacggagcacgtaattttaaaaatatcaaaatagctacaagatattcaattaaattaggacttatattttcaattgtaacttcactgatatttattgtattttccaaccaaattgcatttctcttttcatattcggcaaacagcagttcacttgctccaacaatcagctacatcttaaattttgtatggctatttataattccagtagctttcggtgcaacagcgagttatgcattccagggaatgggtaagggaataacaagttttcttttaacaatgcaaagagaagctattttagtgattatatttacattcatacttggaatcagcttatcattaggagttcgtggtgtttattacggattaattatcggtaatgctatcgggtctgctgtagggcttttatgtattgaaatatttattaaacggctctttcaaaaatttgtatgatttttttaattttttaaattaattaatccaccaatgctctttttatcaagtttatttttatcaaaatagtttttaaatcgtttatttattctttgtttaacatgaaatttacaaaaaaatggggtttaacttataatttttatcatattttagaatacccagtaagtattaccagctaccacaacatttaaatactaacaattgcatatgcaagagtaatacttgcacatgcaagaattgaggtggaaaatgtcaggaaattcaaatgtagaaatattaagaggagaccctaaaaaggcaataaacaaattagcttacccaattattggaagtctacttctagtaatgttaaataatattatagacagtgtatgggtcgcaggtttgggttcagaccctctagctgcaataggttatattaccccattatttatgattttagtaggggtgggaaacggtataggggccggagcaaactcccttatttcaaggtttataggagctaaagataaaaaaggagcagacagtgcaacagcacattcattaatattaagtataattatttcaataggttttatggtgcttttcattgcaatattagaccctatattaaaaattatgggagcaagtgaagtattaaattattgtaaagaatatggagtagtactgtttatctggactttttcattagtaatacctgcaatcatcggaggaatatttagagcagaaggagatgtaaacagagcaacacttccccttgcagttactgctattgcaaacatgatattggatccaatatttatttacggattaaatcaaggtctagcaggagccgctatggcaacaggaatagccggacttattggacttttaatgcaaatttactggatttatgttaaaaagaacacttatctttcatacagccttaaaaactttaaaaataacatgaaaatgtatgcagatattttagcagtaggaattccagccagtttagaacagttaatcatggctatacttgcaattatagttaatttcttattgacagtagtcgcaggaaccacagctgttgcagtatatacagcaggttggagaatcatctctgtaggaatcattcctgcagtaggagtaggaaccgcagcagttacagtagcaggagtatcttatggtgcccgtaattacgataaaattaaaacaactgtcagatatgcagtgaaactaggatttatagtttcattaataacatgtattttaatccatgtctttgcgggacaaattgcatatatattttcatattcatcaaacagtagccaattagccccactaataacaaaattcctacagttaatgtgtttatttgtattgtttgtaccatttggagcaacagcggcaaatgtatttcagggacttggaaaaggaactgtttcacttggtctaacaattatgagagagtttattttagttttactctttgcatgtttgtttgcattcccattaggtcttggagaaataggagtatatattggaatgcttgcaggaggctttattggttctataatcgcatatataatcattgaaatctatgttaaacgtctaattggaggtcaaaaacatggggcttgaagacgaagaaaatgttccaacaatcccatttatttcaacaatacacagaaagtatggaatttttttaaatcataatatgaaagattataatttaagttttggacagtacccaattttaataagattatatgatgaggggccgtcaacacagcaaaatctagctaaaatattccaacttaatgaaagtaccataacacgagcactaaacaaactagaagaaaaagaatatattgaaaaacaccccgactatgaaaacaaaagaaaaaattatgtcaaagttactcccaaaggtgccaaaatagctaaagaagttatggactacgatgaacagtgggataaaatttgtagtgaaaatttaagtgaaaaagagtttgaagaatttaaaaccacacttaaaaaaatatattcaactatagtaaaaagagaagaaaaatgagtttttacaactcatttacattttttgaggagctggaactcctaaaatatctaaagcattttttaaagtagttttagccctatcaactaaaacaagtcttgtatcttctacatctgaaccaataacttgttcagctttatagaatttattaaatgcaccagccaaatcctgacagtattgtgtaatattgtgaatcctttttttgttagcacagtcttcaataacctgtgggaacttagctattgtcctaattaaatctttttcattttcattaggaacccagtcatcagatacagctaaagaagatacatccttaccggattttttaagtaatttgcatgctcttgcatgagcatattgaatagaagcacatcctcgctcaaagcttaatgcttcatcccatttaaaggttaagtgtttttcaggagataatttagctataaagaacctgatagctccaacaccaatatcttcagccatcggtttaatttcttcatcagttaaatcagggtttctggatttaatttcatcagctgctctttttacagcttcatcaaccaattcatcaactgaaacaaatactccttttcttgtagacatggatcctgaaggaagtgtaataaattcatagaatataacttcaggaggaatttctcttaaaatctctttaaagattacattaatctgttgagctgctaatttatggtctgaacctaaaatatctaaaaccacatccccctgagtagctttgtatctgtgataagctaaatctcttgttgagtaaagtgaagtgccgtcagaccttctaagtacaaattctttttcaatttggaagcaggttaaatcaatataagttacatcaccatatgagacaaatccttcatggtcaaagtatttaatcatgtcatccacttcaccacttcttacaaactgaccttcccatacaaaatcatcgtggtttatattgattctatgaagtgtttccttaattcctaaaagacaactttcaactacttcttcgaatattttatttaattcaggttctgctccaccttcatatctttcaatcaaattatctacatgtgaaactaaactttcatcttcgtttaatttttgattagctttgaaatataatcttccaatcttatggtcgattttatctccttcctgatcttcaattttcaaaccaagttcggtaattccaaatacaataatagctatctgtcttcccatatcatttacataatactgagtttcaacttccctaccagctacttttaaaagacgatttaaggaatcaccaaaaatagaattccttacatgcccaatgtgcaatggaccgttaggattagctgaagtgtgttccaatattattttttcatctgcctttggaagatgaccataatcttttccgacatactctaaaagctttttagaaaaatttgagtaatcaataaagaaattgacatatgggccaatagcttccactttttcaaatatttcaggaatttcaagtttttctacaatttcagaagctataagattaggagctttccttaattttttagcaagtgaaaatgcaatagtactagctaaatctcccatgtccggatttggtggaaattctaatctaaaattcttttcatcttcaacctgaaaattttctaaagtattatctacttcaaacttgtctaaagcatcacttatagcatcaattgcttgtttttctatctcaaaatacattaactcacctttaaattacaaacctcttaaccaaagagaaatatttccaatatatggaataacaataggatggccatcccaagtcaataccctttcatttatttgatctgctgttgcataatatgggtcaggatgactgttatggtctcctttaatcatataatacgttgttccatttatttgtgtaatattaattaccctatgaattacaggttcattataccatgttgcatcgtaaacaacaatgtctcctacccgaacatcactaggatcaaattcatgaattcctaaaaaatcagctttttcaacagctacaatatctcccctatagaaaacaggttccatacttcctgagacaactacatttaagtgttgggcagctattaaaactactgcaagaataacgatgtaagatatgatttctttataatctgtcacgctaacaccttaataattaaatatatattaataattataaataatttagctaaatcttataaaatatttttaaacatatggattgatggttaaattgttgataaaataaattaaaaaataatgtcaaatagatgacactatccttttttcttaaaagccacttccaaagctacttcaatagcttctgcagtttgtgttaagtcctccatactgtgagcacttgaaataaagttacattcaaattgacttggaggaatgaaaaccccttcttttaataatgctctaaagtatctcaagaatctttttgcatcagaattatgggcatcgtcattattataaactggagcagggttgaaatatatctggaacattgatccgcagcccacaggagtaatattatacccctgttcatcaataattgactgaatattgcttcttaaaaagtttccttttctttccaaatctttgtagaactgattatccaactgttttaatgtagatattcctgcctgaacagatattggattaccgctgaaagtaccagcctgataaactggtccattaggtgctattaattccattatttcttttttacctgcaaaggcacccataggcaaacctccacctacaattttacccattgtagttaaatcaggagttacaccataatattcctgagctccacctctagctaatctgaaaccagttataacttcatcaaatattaataaaatattattttcttcagtaatttttcttacaaattccaaaaatccttttttaggttcaatacaaccaatgttacccataactacctccataataagacaagctatgttatcaccatctttttggatcaaatcacttaaagcttcttcatcattgaaaggtacagaataggtatttttagctgtatcaagaggaattcctttagtatctggaacacaagatttaccaggttctcctttaactaatgtataatcatgagcaccatgatacgcaccgtcaaatttaataattttatctttacctgtaaaaccacgggctaatcttatagcactcatagtagcttctccaccactatttacaaatcttaccatttcagcactaggtattctgtcaacaacttcttttgctaaaatgatttcattttcagttggagtaccataagcagacccgattgttaactgattggacacttccctaactactttaggatcagcatgaccaagtattaaaggaccataagccaaacagtggtcaatatacttatttccatcaacatcatatatttttgaaccgctagcttttttaacaaaaaatggatatggttcaaatgcacgaactggagagctaactcccccaggaatgaattttttggattcttggaataaatctttggaaaacatattatcacattataaattttgaattaaagagtttacacaagccacagctattggtgttccacctttagggccttcaacaataatatttggaatatttgaatttcttaaagcttcttttgaatctgcagcacctacaaaaccaacaggaactccaacaatagccttaaggttcatttcacctttttcatataaatccatagcttcaaaaacagctgttggagcattaccagaaacaacaattccttcaaaatcatttcttgcagcatacctcatagcagcagccgctcttgtaatttgattttctttagctatttttttaacttcctcatttttaataaaacattcaacttctccctcatattgagttataccatatttaaccatattaatatcagttaaaattgtttctttatttcttaaagaagtcatagctgcttcaacaaaatcagcactcatatgtacaagtttagcatattctggatcagctgtagagtgaacaatacgttcaacaatatctctctcagcaggagccaaatctttaatgtcatcaccaataaggccgcgaataatttccctacttttagtagctatatcataaccttgtttagttgatgcacccataaacatctgatttttcatagtactaatatataatgttaatatatttataattttaaaaatcagattattaaaaaaaagtttattctttagatgcagacaaacctgccaaatatcctgtagaaaatgcaattttaagattataaccgccagtaggaccaacaggttctaaaacctcaccagcaaaatataaatcatcagttattgttgattccatagttttaggattaatattttcaatatttattccacctaaagtaacatggcttaaatctttattaaaaccggagatttcaaatttgaaattttttaaagcttcaattaacttatttttttgttttttattaattctgcttaactgagtttccccgtcaatctcaagatgttccaaaaagaatttaatgaaattattagttaaaaagtattttaaatagtttttaataaatgtttttcccttatcctgaaaatcattggtaaatttaactcttaattcttcctgattaacatcaggacacaaatcaacagacaacacttcatctaattcaatatccccattatccaaaatattataatcagtatttctggaaatttcactacttatatttaaaattcccggccctgttaaacctacatgacttattaaaacattgcctttaattttaaaggttttatattttataacaacatcatataatgtaattcctgcaatgtctgacaggtcttttttagttattaatggaactagtccatatttaatatctgtaaccggattatccgtcagataatatccgtctccagttgaacctgtttttggaaatgtagctccaccagtagctattatgactttttcagcaattatatcattatttattataaaattatcttcttttttaatatctgaaacttcataattgtattttatagttatatcttttaagtaatattttaaaatagccaatatatcctgagatttctctgtttcaggaaataccctattattatcttcaactataaaatccagacctctgtttctaaataagtccagtagcatttcatttgtaaaagtgtaaaaagagtgttttaaaaagtttttatcatgaaaagaatttaatagctttttaattggcttttcattagttatattgcatctgccccctccagtaataagaagtttgctgcccaaagatgagtttttttcaagcaatacaacattcaaatctgcagaagcagcaattgcagccattattcctgcaggacctccgccaattatagctatatcaaattcttccatattaatcaaaatttaaggagttaatctgtgtctgtctcttgggaagagaactgtttcacgaatattttcaacacctgtaagtaccatagctaatctgtcagcacctacaccccaaccagcatgaggaggcataccatattcgaaagcttttaagtagctgccaaatgaagctacatttaatcctttttcttcaatttgttttactaaaacatcatattggtgtacacgagtagcaccagaggataattccaagttattatacatcaaatcaaatgcatgtgctttagtagggtctttggaattaggcattacgtaaaatggtttaatttcagaaggccattcagttaagaagtagaatcctcccattacatcacctaatgctttttcacctgcacgggataaatcttcaccccagctcatttcaacatctctggagtttacaatatcaactgcttcatcataagttacaacagggaaaggaccgtcaggaacaggcatttcatgttctaatatatttaattcttctttacagtcttcattaatgtcaatgataacttgttcaagcatattattaagtattttcattacatcaatatcgtccataaaagaagcttccgcatcaatagaaacagcttcatttaagtgtcttaaagtatcatgttcttcagctctgaaaatttgaccgatttcaaatactttatccattccactagacatcatcatctgtttgtataattgtggagactgacctaagaatgcttctttttcgaaatatgtaattgggaaaagttcagttcctccttcagtagcagaagctacaagttttggagtgttaatttccataaatccattttcatagaagaaatcccttatagtatggaacattctatttttaattttaaaaatagcactgacattatcccttcttaaatcaatgaatctggagtctaacctggtatcaatttcagctttaactttatcagtaggatccataggaagtggctgattagctaagtttaaaagattaatttctttaggaataatttcaacaccagtaggtgcttggttagcttcctgaactgtacctttaatagctacaacggattcttttctaagtttcctaatatcttcaagtatttctgcatctacttttttacttggtgcggtaatttgtaccttaccttctctatctctaataataacaaagatgattccacctaaatcacggatttcatgtacccaacccatgacgatgacatcttgtccagttaaatcaggagtgacatttttagtataatttgttcttctccattcatttaataaaccttgcattggttcacctctaggttttttaaaaaaataattataataaaattaatttttcattatattaagaaatttaatttttatatttaataaagtatttgattaacaagcaaaaatctattttttataagacaatgaaaataaaagctctgaaaagattacttattaaaagttatcatttaaaattatttaataactgataaaaaagaatattaaaaaaatatatgcttaattaacctagtgaactttattaaatcataagcaactaaacagattaaatattttctttttaaaataatcaacatagcttttatttattattaaatattatatattaaaatattaaagactaaattgtgtgattagatgaaaagtgacaatattaaaaaaggaattcaaagagcaccacataggtctttacttagggcatgcggtcttggagataatgattttgataaaccttttattggaatagctaacagtttcacagaaattgttcccggacatattcatcttagagaacttgttgaatttgtaaaagaaggaataatagctgctggtggtattccatttgaatttaacactatggctatttgtgatggaatcagtatgaatcatgaaggaatgaaatactcacttccttccagagaaatcatagctgccactgttgaaagtatggctaaaggacatagctttgacggattagtgcttatgcccagctgtgataaagtagttccaggtatgcttatgggagctgccagagtggatgttcctacaatcgtagttaccggaggaccaatggcagcaggacaatacaaaggtaaaaatgcagatttaattacagtatttgaagctgtcggtcaggaatctgctggtaaaatatctgaagaagaagtctacgaaattgaaaaatgcgcctgccccggtgcaggcagctgctcaggattatttactgcaaataccatggcatgcgtaacagaaactctcggattgtccctgccgttttgtgctacaacacatgcagcagataaggcaaatgaaaaaatggcttacaattcaggaaaacaaattataaaattagtagaagctgacttaaaaccttctgatattttaacacaggaagcatttaacaacgcaattacagtagacatggctcttggaggatcaagcaatacagcacttcatattccagcaatagctaatgaagttgaagatgttgaagttactcttgatttatttgacaaaatcagcagagtagttccccatatttgtctaatttcaccagcaggtacagacacaatgatggatttacataaagctggaggaattccaggagtattaaaaacacttggagataaaatcgacacatctgctattactgttacaacaaaaacattaggggaaaacataaaagatgttgaagttacaaatactgatgtcattcatccattagataaccctatacataaagatgggggaatagctatattaaaaggaaatattgcgcctaatggatcagttgttaaaaaaggtgcagtttcaccagatttaatgcatctcaaaggacctgctaaagtattcaacagtgaagaagaagttactcaagctatatttgaccacgaagtggaagaaggagacattttagtaatcagatatgaaggtcctaaaggcggtcctggaatgagggaaatgttaaatcctacctctgcacttgcaggtatgcaaatcaaaaatgtaggactcattacagatggaagattctcaggaggaactagaggcccatgtatcggacatgtatcacctgaagcaatgtctgacggtccaattggagccattgaagatggagatataatagaaattgatattgaaaacagattcataaatgtagaactatctgatgaagaaatatcaaatagattagctaatagaaaaaatccaaaaagagatgttgatggatggttatcaatatacagtaaagttgttcaatcagcagataccggagctatattgaggtaatttagatggaacttttaagatatgaggatattgatttatcacaaactgttaaaagatcagaagaagatgtaaacaatgttttagacaccgtatctgatattttaaaaaatgttagacaaaataaagatcaatccttaaaagattatacacaaaaattcgacaaagtcataatagataatttaaaagttacagatgaagaaataaaagaagcttatgatacattagatgacaatttattggaagctctgaaaaaagcggctgcaaatattgaaaaatttcataaaaaagaaattcctgaagaatggaatattgaagttagagaaggcataactgccggacaaattgtaagaccaataaacagtgttggctgttatattccagggggaagagcagcttacccctctacaattctaatgactgtgattcctgcaaaaatagcgggagttaaaaaaattatctgctgttcacctccacaaaaagacggtaaaataggtgatgcaattttagtagctgctcatttagccggagccgatgaaatatataaagtaggtggggctcaggctattggagctatggcttatagtaccgaaagcattcctaaagttgaaaaaattgtaggtcctggaaacattttcgtaaccgctgctaaaaaattagtgtatggagaagtggacatcgagtttccggcaggaccgtctgaagtgctaatacttgcagataaaacagctaatgcagaatatattgctacagacatattatcacaagcagaacatgaccctaaagcatcctgcttttttgtaacagatgatgaaaacttagctgaagatgttttagaatttgtagataaaaaaactgaagatgctccaagagctgaaatcataaaagaagctctgtctaatagcggaaaaattatccttactaaaaactttgaagatgcagtatatgttacaaatgaatatgctccggaacacttagttattatgacaaaagatgacgaaagcacattaagtcagataaataatgcaggatctatatttttaggaaaatattctccagttgcatgtggagattatggatccggaactaaccatgtacttccaacaggtggaggagctaaaatgtattccggattgtctacagaatcatttattaaaaaaccgacagttcaaaaaatcacacaggaaggtttggaaaaaatatcaacaacatgcatcccaatagctgaatatgaaggattatttgcacatgttgactcaatcaaaaccagattaaataaatagtctggtttattttttatttttcatatgcttgccaaaagcattaattataactaatatataataattaaccatgtccactttacataagatgaaagttttaactgactctgctcagtacgatttatgcgactatgtaaatcatcaaaaatcatcacaagtaaatctgcctggaatataccatgctacaggccataatggatgccaaataccattatttaaaacactgcttacaaataaatgcaaaaatgactgtaaatactgcattaatcaatccaaaagaactttcaccagattagaattaaaacctgaagaactagctaaagcttttatgacctactacaataaaggtcttgtaaacggtttgtttttaagttcaggtattgcagacaatgaagattctacaatggaaaaaacaatagaaacctgcagatgtcttagaaaagattacggttacgatgattatatacatctaaaaatagttccgggagcatcaaaagattccattaaaagagctatggcgcttgccaacagagtcagtattaatattgaagccgctacaccaagcggtttggctgaactgtcatctacaaaggattataaaaaagatatactgaaaagattacattggatagattcacttgaaaacagttctacaacatatccaaattctactcacactacacagttaattatcggtgcaaataacgaaacagataaggaaattctacatagaatagataaaatatacaagaattccaaattgcacagtgcatattacagtggatttacaccgattgaaggtactgaatttgaaaaaaaagacagctgcaatagccaaagagtaggcagactttacaatgccgacagtttattaaatgattataattataaacttaaagaattggtatttgaagatgatgacagattatccctaaatattgatcctaaaattttagctgcaagtaatatgaatatatttcctgtagaaattaataatgcaccatttattgacctgataagagttccaggtattggtgtaaaatcagctaaaaaaataatttctattagaaaaagatataagtttacaaaaaaagaagagttaaaaagattgggaatagctgtaaatagggctgaaaaatacattaaattagatggagaatatcagcctagtttagatatcttcgaataattcccaaatctcaggatattttttagaaaccgcttcatcaattaaaactgaagcttctttactaatactgaattcaggttctgtttttcttaaatacctgaatactgctgcagattgtgaagaccataaagttattcttggatttttatcaacaatctctttaacttcagccacattctctaaaattttttcctgttctttttgatcttgtatgctttcttcatcactttcactgccaggtaagtcttcggatgatgtttcaatattttcagcttcctcttggttgatatcctcatcagtatcatcttccacagtatctatttgttggttttcactagattcatcttcttctacaatattttcttgaatattttcatcatctacaatatcttcactagattcctcttcttcacaagtatcatcatcaaaagattttgtatcttctacaattttatcactggactcttcattttcagaaattttctccacaattttctcgctagattcatcattttcagaagtttcttctacaatttcttcattagaataattatcttcatcaacattttctacaacatcctcgttagattcttcctgtttttcatcttcacctaacatgtcttctaaagatactgcagaattactgtcaaaatcctcatcataaaaatcaggaattaaagaatctaatcctttacctaaacctgttgattttttagccatctaattacctccatcacgttctataatttctttagctaaacttagataagcttttgtacctgtactttcagaatcataaattaaacaaggtttaccataacttggagcttcagctaacctgatatttcttggaatcacagtattaaataacagattagtgcttccaaaatgatttttaagttccttgtagacatccttactgagccttgttcttttatcatataatgtcagaagaatacctttgattggaacaggtgttctaagcctctttttaactaagttaatagtattaatcaaatcagccacaccttccaatgcataatactctgcttggataggtataagaacactgtcagctgcaactaatgcattaacagttataacacctaaagaaggaggtaaatcaataaagatatagtcaaataaaggaggtaaatccttaagtgtttcctttaaaacaatgtgataattttcctttttacttaattcaacccctgctccacttaatgaaatattacttgggacaatgaataaattcttgataaatgtagggattgttacttttttaacacttacatccccaataattgcatcataaatagtattttctaattttgttttatcaataccgaagctagtagttgcattaccctgaggatccatatcaattaccaaaacacttttacccattacagctagtgaagttgctgtattaactacagttgtagtctttccacagcctcctttttgattcattacagctattatttcactcattaattaattctccttataaatgataagttctaagttattagaaataagttttaagttatatcttacaagagataacttctaagttataacttaaaagaaataacttttaacttttaagaaataagttaaaagagataacttataggatataacttaaaagaaataatttttaacttttaagagataacttaaaagaaataacttttaacttttaagaaataagttaaaagagataacttataggatataacttaaaagaaataacttttaacttttaagagataacttaaaagaaataacttttaacttttaagagataacttaaaagaaataagttttaacttttaattaataacttatacctcataacttaaaagagataagttttaagttaaaaggtttaatgtataagttatattttataacttctatcttataaattctatgttttaagaaataagttataaattataaagaataagaaataagttaatagttattagttataacttatcagttataagttataagttataaattataaaaatattaaaattaatcaaatataaattattaatattgtataagtcaaaagcaattgctttgaatttttctataaaactaagtaggtattacttaaatccattatcgaatattatgacaaataataattttacatctaaaaaacaggtcatatctaaatacagaagcaattcttaaattaaaatattcaaaaaaataaagaaagagtagagaattaatctcactctatttactgtttggcatttcaccagagaaataatttgcataaccttttaaatccagcataccatgtcctgagaagttaataacaatggttttttcttctccagtttgtctgcatttaatagcttcatcaatacctgccttaattgcatgagtagtttccggtgccggaacaattccttcacatttagcaaattgaattcctgcattaaatacgtctctttgatgagctgttacaggattgatatatccttcatgtgcaagtaatgagatttgtggacacattccatggtatcttaaacctcctgcatgtacagatggtgctacaaagtcatggcctaaggtatacattttaagaagtggagtaaatccatttgaatctccaaagtcgtattcatatttaccttcagttaatgttggacatgcactcggttctactgcaataaatttagtatcactgtttccatcaagtttatctttaataaatggatataaagcacctgcaaagttacttccaccaccaacacatgcaatcatagtgtctggttcttcattagctatttccaattgtgttttaagttcctgaccgatgacagtttgatgtaacattacatggtttaacacactgcctaaagtgtattttacattgtcattgtttagagcttcttccattgcttctgaaatagctattccaagtgatcctacatggtcagggttttcagccaatactttacgtccaaattctgtattttcacttggggaggcaaagacttctccgccataaatattcatgatgtttttcctgtctggcttttgattaaatgatactttaaccatatatacagtacagtccaaatcaagtaatgaacaagcaagtgacaaagcagttccccattgtcctgcaccagtttcggttgttaatctttcaacaccttcttttttagcaaagtatgcctgtggaattgcactgtttaatttatgtgatcccgtaggagaagtatcttcccttttgtaataaattttagctggagtgttgagcttttcttcaagacgtttagctctaaataacggagttggccttcccatctgcatgtataactcccttactttttgtggaatcttaatgtatctttcagttgcaaactcctggtccagtgccgcttttgtaaatgctttttgcaaatcttcaatttgatttcttccttcactattttttggcattggaagttcacaaggtaaatcagcgttaatattgtaccatttttttggcacttcttcagaggataattctattttataattcatattaatagattgtataatgtactatttaaaactttactgtacacttttgtacaattaatattttaatagaataaaaacctatttagaaatatgaaaattttagctattgatgttggaacaggaactcaggacatactaatttataatgacgaaaaagagctggaaaactcaattaaattagttctgccttctccacacttatacatttcccaacaaattaaagaaattgaaaatgacatctattttgacggtgaaataatgggtgggggaaaattaaaaaaaagtattcttgaacatatggaaaaaggttacgatgtagtgatggaagcaaattgtgctaaaacaataagagatgaccttgaacaggttaaatcatatggaattaaaatagctgatgaaaataaaagctatgaaggatacactaaaatccatttaggagatataaacattagaaagttatctgaatttgtattaggatatgatttagactttgatattgataaaatagctattgcagttcaagaccacggatacaatgagaatatgggagacagggacttcagatttgaaaaaatcagagaaaaattaaatgaacctgtcgaacctgaaagctttggattccgtgaaaatgttccagagtactactccagaatgaaagcagtagaaaaaacccttaaaaaagaaggtattgaagaaacacctcttttaatggatacaaaatttgcttcaatagctggaatgtgctatgatgaagaagcttccaaattaaacagttttatagctattgatattggaaacggacatactactgcagcatcaatagaaaatggtaaaattcagggattatttgagcaccatacttctaatttaactgctgaatcacttgaaaattacattaacagactagctagtggagaaattacaaatgaagagatttacaatgaccatggtcatggagcacatgttctaaatccaatatctaaactagaaaaagtcattgtcagtggccctaaaagagaattgattgaaaaaaccaaccttgactggcaccatgcatgtcccggaggagatgttatgatgaccggaactattggactaatcaaaactattgaatggaacgaataaaatgtataggctagattctcatatacactgccagtattctccagactcttctacaaaaatagatgatatcataaaaaaatctattgaagataaaattgatatcatagctatcagcgatcataatacagtagaaggttctaaagttgcagtcgaaaaaacaaaagatactgagaatctgcttgtaattccttcaattgagatttcatcttctaaaggacatattcttggatttggctgtgaagaagtagttccaagagatttggaacctgaagaaacaattgacatgattcatgaccagggaggattggctattattccacatcctttttgtttttacagacacggactattatgtaaaagcaaccctgatgaattaaattttgatgctatagaaacaagaaatgcccgttttatcgttggatggtgtaactttaaagctaaaaaattagctgataaaaaaaacataccaccattaggagcaagcgactcccattatattgactttttaggtgactgttacagtctaattgactgtgaattagatattgatagtgttttaaaatctattaaaaaaggtcaggtagaggctcacggaaagggaacttcaaatataaaattatcaaaatatctatttgacaagcatgtccgtaaattatattaaaaaaaataagggataataagagttattcactcttttttacaatttttatctcaatagttgaaacatttgttttttcaccattgtaagtgtctatttgttctgtagcaatactaatatcctcaacatcagcgtttgggataaacccatttctaacaatttctgcagtgtctacggcacgactaatagctttacctcttgctttaagagatacatggtctgcaccaccgttaaattgtgtcactactgctagaacatagttcattactggtttactaccaataaagataacattttcttccatagtatcatgactccatatagactgttatacagttaagtgtataatttttttaacatataaatattgctttagctaatttttttccattaataaaatcttattaatagaatctaaaacagccaatatactagccattattacatcatcgttagttgctctaccagttgatttattaccttcaccatcagaagaaataacaaatacttcagctaatgcatcagtacctccagtaatagcttctaaattgtattcttcaagttcaatgtccattgtatcctgaatcaattcccttatagcattaatagctgcatcaactggacctacaccagtacaggaggtttcttttaattttccattaatgttcagtttaacggtagctgttggagatacaacagctccagataatattcctaaaccttcaagtttaatcggagtttctttagcactgcttatttcagttatagcaatagctcttaaatcatcatcagtaactgttttacctttatctccaagagctttaatttgattaaatactgtttggaattgtttttctgttaagtcaatgttataatgttctaatttagcttttactgcattagctccagtgtgttttcctaaaactattcttcttgaatgtcctacaagttccggagaaatcggttcataagttaaagcattgtttaacactccgtgaacatgtatacctgattcatgtgcaaatgcattagctccaacaataggtttgttaacaggcattttaatacctgtaatgcgacctacaaattcagacaagctatataactgtgttgtatcaatatccaagtcaatgttgtaagcggcatgcagtgcaacaataagttcttcaagagaagcattacctgttctttctcccataccgttaattgttacatgagcctgatttgctccgcattcgatagcagttaatgtatttgcagtagctaaaccaaaatcattatgaaaatgaacactaattggagtagtgtagcgttctttaagattagtgattaattctctagttatgacaggaatcaatactccaacagtgtctggaacatttaaaaagtcagcgcctgcatctacaacagcatcataaacatcaaataaataatcatgttctgttcttgttgcatcttctgcagaaaattcaacagtcaatccatgatcttttgcatattcaacagattcaacagctgtttcaatgactttttctttagacattttaagtttatagtctctgtgcaatggagaagtaccgataaaagtatgtatgtagtccaatccggaatcaagaacagcatcgatgtctttttgcacactacgagctaaacctaaaactgtagcattcaaacctaatgaattaagttcttttgcagcttttctttcaccatttgaggatacaggaaaacctgcttctattttatctacaccaagtttatcaagcttttgagcaatttgaattttttcatcaacagttagagcaactccaggagcttgttcaccgtccctgagagttgtatcaaaaatataaatcttatcagcaagattcatattttccttttttagtgtctcgatatttttaccatacataattaaaacttcccattttaatgtaatagtaattacttctttttagatatttaaagtttatcttctattatgtttttttatagttttaactacaacaacaaccacaactaagattacaaccaaaacagctaatgtataatataaatattcacaagcaggtacttcacttttatcaatgtttaatgaatatacatgtccgctatgatctgcaaagaataaactatttccattaattacaggagaagaagttatttctgaattaaataatatggttcctggattgtaagtaaattcctcttcaccagtgtatttatttaaaacataacctgttccatcattagaaccaaatgcaattaactcttcttttattgctggagttgattgaaccggagctccagtagcatgactccatttaaaagttccgtctcttaaatcaagacaggttaaattaccttcatcagaacctatgtatacattgttattatactcatcaatacatggagaagatttaactttattgtttaaatcataatcccagcataaatctccatttgtttcatttaaagcataaagtgaatcatcatcagacccaattatgattttaccatctgcatatgctggagaagagtaaactgcatctcctgtagcatattgccaggttatatttgtgttatttaaatttatgcaataaacattaccgttagttgaaccaacataaagtgatccgttaacaacaattggagaagacactatttcatcattacctaaatctgcttcaaaagttttattaccgtcagctatgtcaaatccataaatatgcccattatcacaacctacatagacagtatcattatctacataagctgccccctgaatagattcatcagaagtattatatttccataaaatatcttgtgattcaatatctatagctttaaaactttgattatttcctacaaatactgtattgttacttactacaggtgttgcattactgtctccttttaaattaaatgaccagtcttcagttccgttttccatgtcaattacttttaaaataccttcctgtgaaacaacatataaaaagtccccatagattgcaggtgagcctataaccggtgattccatgttaaatgaccataaatttgtaacaaagtcagaattatcatcaacatatcctgtatgatttaaattactttgaaatgtgttccaatcaatatttgcaccagctatcgggctgatacataatatacagattataaatccgattaataatttattatatttagacatcttttagcctccttaaatatctctattaaatcttttgactccaatgataaagaacagtgcagtgaatcctaaaagtatagctaaatctaaccatacatcgcctaaactttgacctttaatcattactcccctcattgcatcgttaagataagttaatgggaatatataagctattttttgtaaaatccaaggcatagtttcaataggatagaatacaccagaaacaaacatcataggcattgaaaatggcatgactatttgagtataatcttcctgagtgttggttcttgcagacaacatgataccaaaaccaacaaaacatagtgctccaaagaaaagaacaatgaatgtttgtaagattcctcctttaatacttacattaaacaatacaatagccatgaatattaatataagagccctaactaactcaacaataagtttagatgcaattttacctccaactacagttgaaattgatgtcggagtcataaataatctagctaattcaccagtttcacgttctccagctattgatgcacccatacccatcatacaggacatcattacagtcattcctaaaactgcaggaactaaaaagtcaatatacttaatatttccatatattttgttaatatggagtgcaatatcatccttaaaattatcaaatgtatgtccaattgaatttgtaacatttgcactttgagtattagtagctaattcagattgatttagaggactggtactattttctaattcctgtgatgaaggattagaaactatggcattagatgcttccatatttgataatttagcaaatattccctgagttacactttccaatgttgaagaagccatttgatcagatgaatccaaatacagtgtaaccgccttttgagacacattactgtcataattttccggcagtataattgcagcttttacttctccactatcaactctctcttttgcatcatcaacatcatccataacctctactacattatactgatccgttgttttaatagtatccaatgttacatcagttaagtcaccgtggctttgagaaacaacaactacaggcaaatcagtcatgtctccacccataccataaccaaataacaaaatcatgataataggaaaaattaaaattgaaattaaccttggaggatgtctttttaaacttaaaagttctttcttaatcatccagctaaattttctaagctctatcatcttcattcacctcagctgttgctttaataaatacatcttccagagatggttcctgtgtaaatattgatttgacaactccgcctgcttcaataatgtcttttaaaacatcattaacagcatcatcatcaaaattatcaattctcaagttaaaacgtccgtttttagccatctcaacaccatgtactttcggattagattgaatagctgaaataatagaatcattattttctttaagtaaaaaggacattttctttaagtttaatgtttcaatatcttctttagtagatttatttacttcattttcatttgaaatatctcttaaagtatttttcattttaatttcatgctcttctttttcttcttttaaaagagaatccttaagaccttgtggagtatcataagctaccaaattaccagtatttataattcccacattatcacaaagcatatctacttcatgcatatcatgagaacataaaataattgtatttccctcgtcatttaactcacgaattaaatcccataatgttcttttagtagttggatcaagcccgattgttggttcatctaaaaataatatctccggcctatgtactaaactagctacaagagatgccttttgtttttgtccaccggacaactgtccaactcttttatttctagcatatttaatgtctactaattccattaaatcttcaatacggtcatgtttttcatcaacaggaacaccgtagtaatcagcacacaattctgaattttcctgaactgttaaatctttatataaactaacttgctgaggaaccattcctaacaaatttcttacttcattcggattttcctgaacatcataccctccaacactagcatgacctgaagtaggttgaattaaacaggtaagcattttaattgttgtggtttttcctgccccatttggaccaagtaatccaaaaatacttttttcaggaacttttaaatttaaagaattaacagcagtgaaatttttataaacctttgtaagattcttagtttcaattgcatttctcatcgttttccaccttatgcatttcattatctgacatatcttcaataaaacttaaccaaagagggctattaatcaggtgcgcaaactcacttttaaaacttttaagtaagatttcaccttcctctgtaagagagtaatacttaacacttttattattgctaactccccattctccttttataatcccagttttttctaatttccttagaatcggataaattttacttgaatttgttttattatactcagtaggattacacgaactaaaaaattcatctaactttttcataatcccataaccatggattttttctttactaataatccataatataataatatgagttaaaccattagaacaatgcctcataattttttttgaaagttgatcaacattttttttacgtctgaacatggccaactcaaacctcctaattgttatttaaaaaaattatatatgttaaattttgatatataacaaaataacatatatataattataatatataaagttaatcttaaatcatgaaattaggttttacaacattagcaatgtttaccagaccaaataatgacataatagaaactgctaaaaaatatgaatttgaaatgatagaaatacttggagaaggccctttttttaaaaatgacaatctcgaatttgcaaatactgacttggaaatttacatgcatgctccaacagttgatttgaatatatctagtttaaacaccggaatcagaaaagaaagtgttaaacagatgaaagatgctctggattatggaaaaaaaataaatgcaactgctttaaccatccatcctgggcaaatcggaagaaatgaagacagaataaggaaatatgcactggaactggctattgaaagtattggagaacttgttgactattcagacattgttgtttcagttgaaaatatgcctgaacgcttctcatttttaggaaataaagttgaagagcttgaaagaatacaaaatgaaactggctgtggcttaacaattgatgtaggtcatggaaacacttgcggaaattgtgaagaatttctggatttaaaaaacattagctactgtcacttaaatgacaataatggtgttaaagatcagcatattacattaggtgaaggaactcttgatttgaatcttcttaaaaaagtagataaaggaattattgagttaaataactttgataatgttttaaaaagtaaagaagttattaaaaatctattgaaataacttctgaaattttttgaataacataatctgttttattaatcagttttggagaaacttcttcttcctgttcaacagttagaacagatacatcagcattattaaaagctaaaacatcattgagaccatctccaaccatcattactttatatcctctgtcttttaaacatcttacaaccttacatttgccttttggagaaactgttccaaaggcatgttttttattgacatttaaaatttcagctaatttgttaatggctccctttctgtctccagatgcaatataaatttcaatgcctctggattgtaaaatcttaattgtgtctatgacttcagaaaagagtttgcctgcagaagtaatagtataaactattttatttttattaatatcgataattactgcaggtccgttacaaagttccattttagggattttttcttttaaaatagtaaacccatcagtaatatcactaatagttgcctgattttcattttctaaaatatcagtaacttcttctttagtagtttcacagcttgtaaagctaacatcaaagtcaatattatgctgtttaatcacatctgaaattaaagtgttactatccaaattcaaaagacaatttgtattgaactgaagaactacaagtgctaaggaatccatagaatcaattaagtgcaatgaattaacatcagtgaataattctccagttgaaacatctttaataaccctgtagcgttcaagtaaagttccagaattatcaaacacaatagcttttttcattttgacccctctttaattttatttaattacttgtacactatttataattttgtaaaaaaatattcatttaggcaaatattattttaatttctatggtatgtttaggtattatgagaatttcataaactgaaaactctgtaaacccagcacacagtttagctcctgcattagttatgagcgaacaagctttaagccaagttttgatatttattatagaacaacaatcagtacaatcatcactggattaatctataacttcttatactccatcaaagaagcttcacttaactaaaatttgtctttaaatgactcataaattaaatatgaactccgtttactttttttaaaaaaaatatcaataacttatataaaccttaaaaaataaaatatcacttattatatattattatgattattaggtgttttaatgaatgttattgaaaaattaaattccattcaaaataaagaaatgactgctaaggagaatgtagaaaacttcattaaagttattgatgaaaaaaatgaagaattaaatattttcctagaagttaacaaagaatctgctctaaaacaagcagaagctattgatgaaaaaatagctaacggagaaaaagttggatttttatctggtttagtttttggtattaaggcaaatatcaatgttgaggattatattatctctgcagcttcaaaaaccttggataattacttcggaagttataatgcaactgtaattgataaaatattagctcaagacggaattattctcggtattactaatatggacgagtttgcagctggaagttcaactgaaacttcctgttttggacctactcaaaacccagcagctcctggaagaatccctggaggatccagtggaggaagtgctgctgcagtagctgcagaaatgtgtgatattgctcttggttcagatactggaggttcaatcaggaaccctgcatcccattgtggagttgtcggatttaaaccaacttacggtgcagtatcaagacaaggtttacttgatttgtcaatgagtttagatcaaatcggacctttatctaatgataccagcggaattgcacttgccctaaatgcaatatccgattatgatgaaacagaatgtaccaccctacacgggaaaagacctgactttaccagtgcacttgaagaaaaatctcttgaaggtatgaaaatagctgtttgtaaagagtttattgatgttacagacgctgaaattaatgttgctgtaaacaaagctattcacaaattagttgaagctggtgcagaacttgtagaagtaagttttgacaatattgacttatgtcttccaacttattacttaatcaactatgtagaattcttctcagctaccagaaaatatgacggaagggattacggttatagaatagaagatgtttgtggagaagaagtattaagaagaattgaaatcggttcctacatttcacaaaaagaatacagcggaaaattctataaaaaagctcttcaagcaagatcccttattagagatgaaatcaatgctatgttagaaaatgttgatttaattgtaggtcctactgttcctaaacttcctcacaaaattggtgatgaattaactcctatggaaatgtatgcttacgatgtgttaactgtaatagctaatcttgcaggaattccggctggaagtattaaagctggtgaagtagacggcattcctgttggtttacaaattcaggctaaaccattagatgatttaaaaatcattaaggcaatgagtgtatttgaaaatgaaaattaatcctaataaattatcattttattagaattattttttcttttttacaaaacctttattttacttatttttagatatttcaccggcaaatataataaatactgatttttaggaaaaatcgacttcattaatgagatttttatttttagtgcaacttttaaattttacacttgaaatatatgtccccattatggttacagcaatattaaaaattgaatataatgcatattcatatatcaaattttaaaaaattatcaatgaataacattcattataataaaataactgaattaatttcatctaaaattttaataatacttatctgtacaacttcagccattggagaatcttcaataatccatcattaatacaaattgtgaaagtattataaatcttaaaataaaatagttacacgaggtttacttatgaaaaaaataggactcgtctatataaaaggagcagttcctggatttgaaaactttggagaactacctacccatcttgttaaatcaaatggattagttgatggtaaaaaagccagcaatgaacttgatgcattaattatacctggaggtacacttcttgaatcaggtgatatcagcgatgacttatctaaagaaataaaacaaatagctaaagatggaaaaccaattattggtgtttgtgcaggtttacaattattagcaaatcagacagacatcggacgaaagtcagaagttccaataataaaagaaggtcttggattaatagatgttaatctttcaccactcataagcagcgaccgtgttaatgctaaagtttatgacaattcatttattacaaaaggccagaatgaagatgttaccggattccatacacacacctacggtaaaattgaaggtgatgccaaaccgttattctactctaaaattcaaagaatgaattatggagatgtaaataaaaaatccgaatacaacattttttcaggagcatgtaatgatgacggaaatgttataggaacaatgattcataatattttagatgaaaatcctattattagaaacaacctattaaactacattgatgcttccagtgaggatatcgaatatatattcgctaaaaataaagaagtcaaatccaaaataaacatggaagttggaatcgactcaggacataaaatagaaaaattatctggagaattcttaaaatataaaaataatggaaaaggccctaaattccttatgattggaagtaacggatctgattccggaaaaacatttattttaacaggactggctggagcattaagaaaaagaggtctaaaagtggctcttatgaaagtaggtcccgatgcaagagatattgttcctggtctatacctgacaaacgggaaaatggaagattacggatctataaaaatcggacatttaggctggatggatattaaactggctattgataaattaaacaaatcagattatgatattgtattgattgaaggtgttatgagtgtgtttaccggattactgaatgaaaaagttccatactctgcaagtgaaatagctatgtcatcagatattccaatgctgcttatgtctggtgtcaataagggaggtattgaatcagcggcagttgatttggtagcacatgcaaacatgctaaaaaaacttggagttacagttgaagcaatcctcctaaacaaggtttacaatcagaatatatttgaaaatgtggttccgtacatcaaaaataacacccaggtcaaaaatgtcttaaatgtatcaaaactgaaaatagacggacgcggatttactcctgaagttgaaatcagatatgatctgttttcaaaatatgcacttgaatgtgttgaagaaaatattgatataaatacaatagctagtatggcgaaaaatgtaaatttcaatagaatagttccttttgaagaaataaaaaacaaggtgatataaatggcacttaatttaagtccggaacagggagttaagctaacaaaaaaagacagagttcatgttgcaaaaaaaattaaacagggctggaaggcaacatgtctgattcccgattatggctttgataaaaatggagatattcaagtaatgtctgacagaaaccgcagagctgttaaaatcgtgaaaatcaaagatgacggaatatatattgaaaaagcattgaaatctaaaaaccttagaattccatggggtaaaataagtttagttagtccaactaaagaaattaaagacggactgaaaatagatatgtatgatggtaaatatgttgtatttagtatttataactcatataaaatccaacaaattacccaatacatctttaattatataaatgataaaagaacgaataatgaagctatgtatagctgattattctttcaaatattcttttataatgtcttcccctttaagtaagaccaaaccattttcttcagcatattttttagcatcagctactgatgttgcctgaccggttttgctgtccatcatttcacaaacaacacagaccggagttacgccagccatttcacacatagccaatccaatttcagtatggcctcttctgtttttaactaaaccgtcagcccctcttaaaagacatacatgacctggagacctgaatgtttttccaaaatcaccatatctttcttcttttaacatgatagccatttcactaatagtcatggctctatcatggtctgtaactccagtaaatgaatccctatgatttacccatattgaaaatgaagatctttcatcatatggaatgtcatttggagcaagttcagctaaatctggatattttgagctagcagcttccataatatctgtcataaatggtaaattaatagcatcacagtactgtggagctaaacaattgcagattaatccacctgcattatctctcatagtagcaactgattttggtgtaacaaattcagaagcgataatcatgtctacctctccttctctgtcatcatcatcataaactaaaataaattcaccatttcttaatgcctcaaaacccatttctaaatcgtttttactcatagtaacatctccttaatagtgtagaaacagggctaaaaataaaaaataactttcttattctcttccatccggactatcaccgtcggttttggattttaaccaaatcagcacatttttgtgctcgtggacttatctatttcagaaacaccaccggtggagaatttcactccgccctgagaattgtacaatgaaataatatataaattatattataaaaagtttcttaaaacatttttaaaattcaacacttaccgtatctccgtcttcaagatttagcttatccctaagtttatctttagctataaactccaaataattttcttcatgtgtagttttagccggaaatacaatagccccagtaacttcatcatttaatcttgcttttatatatttaacagcaccaaaaccttcatcaggttttataatatttttacattcatttttcactttgttgatttgaggaaggtactcttctggaactataacatttaaagttcctggatacgggcgaaatccacaattttttttaaaattattaacataaaaatcctgtgataaaaaataagcggctttgcctaaaccagttgtaactgttccatcaattttcattaaaaaacctccaaatatatacaatgaattataatttgattaaaaattattgactatataattaatttaattaaaagtagctatttcagaataaattttaaattacactagctacatcaaatactaatttatttttatttactaatatttattacgatatattccacctttaaaaacaaatttattttaacaatcaaatataaatttaaaaataatataaattttacaggtaatgactatggaaactaaaacaatttcaaccgatgttttaattattggttcaggaggagctggttcaagagcagctattgaagtagataaagctggtcttaaaggacttattgtttcaaaaggactaacttttagatctggatgtactggaatggctgaaggaggatataatgctgtttttaaagctgtcgatgctgatgattcaatagaagcacatattgaagataccttaaagggaggcagctatctcaatgataaaaaacttgtagatgtacttgttcacgaatcccctgacagactaattgatttagaaaattatggggcaatctttgaccgtcaagaatctggtaaaataaatcaaagaccatttggtggacagcaatacagaagaacctgttttcagggagacaggacaggtcatgagctaatgactgctcttaaagaagaaataattaaaagagatattcaaactattgaagaggtaatggttacatctcttgttttggatgaaagtttaagacaggttataggagctgttggactagatttggcaaactcccaaataatctattttaaagcaaaagcagttatactggctagtggaggagcaggcaatttatatcctattacatccaacaccattcagaaaaatggtgacggattcatgcttgcctggaatgcaggagctaatctgatagatatggaacagattcaattccacccaacaggaatggtaactccagattccaaaaaaggagttcttgtaactgaagctgtaagagctgaaggtggaaaattattaaataaagacggccaacgcttcatgaaaaaatatgctcctgaaaaaatggaactggctacccgtgatgttgttgcaaggtctatttatcaggaaatcattgaaggaagaggcagtgaacatggcggagtttatttagacataacacatcttcctgatgagttaattgatgaaaaattagaaactatggttctgcagtttaaaaatgtaggcattgacattaaaaatgaaaaaattgaagtggctccaactgcacatcactttatgggtggtgtaaaaattaattcagactgctctacaaacgtacataatctgtttgctgctggagaggtgtcaggaggagttcatggagctaaccgtttaggtggaaatgcactggctgatactcaagtatttggaaaaagagctggtgaaagtgcagcaaaagttgcaagcaaaactgattttaaagaaaatcctgaaatggtccatgaagaaaaaacaagaattgaaagcctaattaaagacggttccattaatcctatagagtttaaaaataaccttaaaaaattaatgtgggaaaaagtcggaatcgttagagatgaaaaaaatttaaatgaagctttaagacagctgcaagagatggaaaaagagttaaatgatttaaaagttgaaaataaagcccaatataatacagaacttgtaactgctcttgaagtaataaatatggttgaaatagctattttagttgtaaaatcagcaatattacgtagagaaagtagaggagctcacttcaggtctgatttccctgaaagcaatgatgcctggaaaagaagtattgttctaaacaaaaataaaataaaatttgaagctagataaaattatttactagcttctttaagctcttcaatagcttttctggcttttttataaatttcttcttcatctaatgtagttaattttctattttccattaaaattttaccgtcacaaatagtagtatctacattataaccatttgcggagtaaatgatattggaacttgtagctgaactatccggcaccatattagcattattggtatcaattaaaattaaatctgcttttttaccaacttcaattgatcctatttcctgttcaagtcctaaaacttctgcacctttgatagttcccatagctaatgcttcattagaagttaaagctttaggatttaataaattaactttttgaagtaaggaagctgttcttaactcctcaatcaaatccaaattattatttgatgatgctccatctgttccaattccaacacaaatatcattagtgattaaatcctgaattggagctatacctgaagctaatttcatattactgcatggattatgtgaaattttaacattgttccttttaataatttcaatttcattatgagataaccatacactatgtgcagctacaacatcaggacctaaaaatcctattgaatccaaatattcaaagggtcttaaatcatgtgcttcaagtgaatcatttatctctttttgagtttcactaacatgaatatgaattccagtattatactcattagctaaccatcttacatcttccaataaatcctttgaagctgtatacggggaatgaggtccaaaaaatactttaattcttccatcagccatcccattacatttttcaaataaggctatgttttctttaatttcatgttctcttttttcatcatcaccaaaatcaatcataccataagataaaactgccctaattcctgattcttcaacagcttttgcaacatcttccatgtaaaagtacatgtcactaaaagtggttgttccggatttaattaattcaatggctcctaaaagagcaccaatataacagtattcagatgtaagatttgcttccatcggccaaatattatcatttaaccatgaatctaagctcaaatcatcagccaatcctctaaacaaagtcattgacaaatgtgtatgagtatttacaaatccaggaagtaatattttacctttagcatcaataaccttatctacattactttcatcaatatcagtacctatttctgcgattttatcattttttattaaaagagaaccttttatttctttaaaatctaaagggtttaaaattaatgcatctttaattaaaatagtattatcagtcataataacacctaaaaaaaataaaaaaaagtcaattaaaataactattctaaatttttaatagctaatttaatatcttctggtttgatagttttacgtttagcgattttagcaacattgtttgcttcaattgcaacgtcacgagctacttcttcaagatattcagctaattcagctttagcatcttcactaactctttcagcaccagtatctttaataatccttgcgataggagcttttggtatttcagacatgtatttcacctcaaacagttgatttataacttatgataattttaaattaatcttaagcttaatatcaatataatttctattatatttaaagattttgtattatttgatagtaaaagctgaaaatattaaaaaatatccagaatttcaacactttaaaaaagtattaataaaaaaaatgatatatcatatcacataaataaaatgagaagatttaaaatgaaattaaaaattgctgtaccttctaaaggaagaattagtgacccttcaatatccatcttagaaaaagcagggttaggattaaaagataatgctaatagaaaattaatttccgctacttttaataaagatattgatgtaatgtttgctcgtgcatcagacattccaaaatttgttgaagatgaaattgtagatatgggaataactggtgtagacttgattaatgaaagtgaagctaatgttaaggaattagttgatttgtctttcggacagacaaaattagttttagcatcaccggaagattccactataaattccattgatgatttaacatcagatatggtagtagctactgaatttccaacattaacaaaaaaatacttagaagaacatggtttaacatcaaaaataataacattaagtggttctacagaaattgcaccattaattggaatagctgatttaattactgatttaaccagtacaggaaccacattaaaaatgaatcatttgaaaattgttgatgtaattttagaaagtactattaaacttatcactaatgacaacagctttgaaaataaaaaagaattagttgaagcagtaagtacaagtataaaaggagtaattgaagctgaaaggaaaaagcttgtaatgatgaatgttaaaaaagaaaatttagataaagttaaaaaagtcatgcctgcaatgactggcccaacaatttcagaagtattatctaaagaagaaactgtagctgtacaagcagttatagatgaagacgtggttttcgaacttgttaacgatttaagaaatgcaggtgcaaaagatattcttgtcgtaccaattgaaaggattatatgaaaatagcaataatttactcaacatccagcggaataacaaaaaaagctgcaaaaattttatcaaacaaaataaaagctaaaattcaattaattccaattgaaaaagctaaaacagcctgtttgttaaaatatgattttattatattggccggatcattatatcatggaaaagtccagggaaccttaaaaagatacatatccagaaatatgggaacattaatggaaaaaccggttgctctgtttatgaactgtgatgaaaaatcaaatactaaaagtcatctgaacaaaacattttcagaacaacttgttaaatcatcatttatttcttcaaattttggttatgaaataaatcctgatgaaggaaactttatagataaaataaaagctaaaaaaacactttccagtgaaaatattcctgtattggatatggatgaaattgataaatttgctagttatattaacaatttaattgataaaagaattgaataaaatgggttgattaaaatttttgaattaaaaagtataatttcaataaaagattttgaaagaaaggatattgattatattctagatgaagcatcaaaactagaagatatagctaaatcaaaagaatgctgtgatgaattaaaaggtaaaatccttggattgatgttttttgaaccgtcaacaagaacaagattatcttttgaaacatctatgaaacgtttaggtggaaactgcataggtattgaaaatacaagatcatgttctgtttccaaaggggaaagcatagctgacactgcaaaaatgtttgagggttacagtgatgctttagttattagacatgaattagaaggcgtatccaaattcatatcagatattgttgatgttcctgtgataaatgctggagacggtgctggtcagcatcctacccagacattacttgatttatacactatcaaaaaagaattagggcaaattgataacttaaaaatagctttagtcggtgatttaaaatttggtcgtacagtacattccctgtccaatgcattgggattatatgataatgtggaactttattttgtagctcctaaagaattaagaatgcctcaagaggttttacacgatttaaacaaaaaaaatattccatatactgaagttgatagtatagaagaaattattgataaagtagatgttttatatgtaaccagaatccaaaaagaacgttttggagatttagatgaatacttaaaaataaaaggagcttatattgttaataaaaaaatgttagaaggtaaggatgttattgttatgcacccattaccaagaattgatgaaatagctactgatttagataacaccaaacataacaaatatttcaatcaagcatttaatgctgttccagttagaatggccattttaaaaactttaataaaaaacaatcctaaatggaatcatattgaataaagtgttttttcaagtaaatcagtatcgcattgaagtgttataatattagttcttccttttccacgtccacgtgatatagtattggttgaaataatacctaacatttcaagttcatttataaaatcaaaaattcttctgtatgttacagaatctccttttgatacttctttgtaggtatcgtataatttacctgatgttatttcttcattattctgagtaagtcttaaaatagcgtctaaaactctttgctgttgagttggtagagttaaaataacatcagtaattttattatgctcaattctatcttttgcccttcttacataatcgccaatgattttatcagattcttcttcatcagctatttccccagcagttctaagtaaatccagagcatatcttgcatctccttcttctttagctgccatagctgaacataatggtataacatcactttcaattgtatcttctttaaatgacaaactagccctttcacttaaaatatcagccaattgatcagcaccataaggcggaaaaacaatttccttatcccttaaactactcattactctaggtgtgataaactgtttaaattcaacataattactaatggacaatatggatacattatcagttcttgttaatgtatataaaattccatcaccatctttgctgagcaatatgtcgatttcatctaaaataacaattaaaattagtttttttccataagcatttcttctgaaaatgtccctgaaagtattaataacttctccttttgtccatcctctgtgaggaacatttcttccaagcttttgacacagttgtgcaataacctgatattctgttgtgtagtcagtacatcgaatatattcaacttttatgaaaacatttttattagatgctgcttcatttaactgttcacgagcaaattttgctgctgctgtttttccagttcctgtttttccgtaaatagtaatatcagatggagtaacattatttaatgcttcaatccaatatttagctatttgtgttatctgttctttcctgtgaggtaaattttcaggtaaaaacctatgatctaaaggttgtttatctttaaaaactgattttcctacctccaagtcatcaaaaatatttgccatatgttcaccattttaaaaagtaataaaaaaataatcttaaaaacatgaaaaaatcataagtattatttccagtgataatatatgaaaacagtgttaaataaaggtttgtattacaaaattgtattgaaataataaattttattataaaataaaaaataaaaacatttaaataaattaaaattaactaaaaaatgtttaaaataatttaatctataaaaaacaaataattaatagattaaataaaaattaaagtgaatatgattagttaaaattaaaacatgaaaaataactatttcaaatataaagacatatatttcaagtgaaaaaagagtaataaaaatagaattaatataatcataaaataaatttacaatttttaaattataaaataaaaacagcaaattaaatatttttaaaaaataagaagtttaaaacaattttttataaaataaattattttaaaaattttttaaaaaaataaaaacaataaaaataaagctaaaacaatttttatttcaaaattaaagaagataaatttcaattgtaataatttcagttaaatataatatttatctgagcatttgaaaaataaaacatatatttcaagtgaaaaaaaatctgaaaaaggatttaataaaaaaatttataatgatttatcataaaaagtgagagataaatttcaagtgtaatgcaatttttagcgggaagcaaaaatcaagacattgatttcaagtgaaaaaaaattttaaaatgaattaaaaaagttatttcagtaaaaaaagaatggaaaatgttttattttaaatttaaaccaagaaaaattaagataaatttcaagtgtttttacagatgaaatacatgtcttcattcctacagaaccttcgcagagctttcacttgaaattcatgtctgtctgtctgtctaaaatttataaaaaaattatacaaacatactgttttcattgtgtggttttgaattattattgtttaaattgccaaaatcgtaatttaataacattatacaatgtaatttagctttaaacacacgtttaatagttttaaataatgcatctttagttaaaccatcttcataaatattatcagtaacaacatattgctgtaaaatatcttgatctacttttaattcatagtcaactaaaaataagtttaaattagtacttacatcaaataaaaatttatttttttcctgaggagatgcattttgcattagactaatatgttctggtgctacttgtgttgcacaaccaataacaattacatctttttcttttggttttacaacatccattacattatctttaggaaattcaataacaaaatggaaatctgcattttcatcagcagctttttctctaaagacaccttcgtcagctaaccagtttttaacatcttgttcaattgtcatcttttcaccttgtttaaaattataataaaatatttatttattttaaaattatatattaaataatgttttataattttgatttaataaataatttcaatatattattatctattaatagtattaattctacatataatatattaatatttatattattatcattattttcagctatttttcttgatataatttatggagagcttcccactaaaattcatcctgttgtatttataggatcaataatatcattttttaaaaacatatttattaaaataaaaaacagatggtctggtttatttttaacattgtctacatgtattgtttcaagtgtattattaattatattattttatttattttcatttaatataattattttttatatattatttactttaatattatcttctactttttctattagaatgttattagacactgctagtgatgttgaaacagatttaaaagaagatattgataaagcaagacaggcagtttcctatttagtaagcagaaatactgatgagttaaccaaagaacatattgtttcagctactattgaaagcttaactgaaaatatcactgattcatatatttcacctgtattttattttatgataatcagcattattggaatttttactgattcatatgctgtttttgttattttaattttaattccatttaattacaggatattcaacacacttgatgcaatggtcggttatgaaactgatgaattgattgatattggttttgttcctgctaaaatagatgatattttaaattatattccgtcaagaatagctggtttgtttgttgttttatctgcattctgtctgaattttgattataaaaacagctataaaatattaaaaagagatgccagaaactgtccaagtccaaattcaggttttacaatggcttcagctgcaggagctttaaatatacaattgattaaattggatacatacattttaggagataataacaaaaatattgaaacaagcgacataggccgtgctgttaaattatcaaaattagcaatatttttatttactgttacaataattttatttataattatattatatgtgatattatgaaaatagctattatatctgtttcaaaaaaaggttatgaactatctttattattaaaggaacatctggataaagattcaactatcatcaacactgatatttattataaggatgttaaaaacactttcaaattattattttatgaatatgatgcaattatagctattatggcttctggaattttaattagaagtattgcaccattaatcaaatcaaaggtttgtggtcctgctattttaaacattgatgaaaatgctaattttgtaatcagtacattatccggtcatctgggaggtgctaataaacttacatcaaaagtagctaacatgttaaatgcaacagaagtcattacaactgcaactgatgtcaacaaaaagttaggtgttgatgtaatagctaaagatttatatttgacagttaaaaatccaaaagaaatcgtatactttaataaagctattttaaacaatgaagaaataatattcagagtcaacagtaaagaaaactatgattttttatttgattatttaaatgaaaatacacttgaaattgatgtttcaattgaatttaccagttccataaatacagatgaaatacatgtcttatataaaaatcataaactgataatgaaaattgaagatattgttgtcggtattggctgcagacgcggaaaatccaaagaagacattttaacaggtcttgataaagcacttgatgatttaaatatttctaaaaaaagattatctaaactagcttcaggtgaaattaagaaagaagaaacaggtattttggatttaagtaaaatgttaaatattccagttaattttgttgaaatggacaaactgactttattcaaatcagaggatatacatgaatccgaatttgtaaaatctaaatttggtgttggcagtgtgtctgaagcttctgctttaattacagcaggctttgattcaaaattaatttataaaaaaacagcttttgatggtgttacaatagctttagctgtttctaaaaaagattaaaaaaaattagatggattctaatttagaaaggacttcccagattaaagttcttgcatgaactggtatgttaggatcattactaatttcatctaatttagttaaaacagtacttacttttacagactgatcttgggattcatcttttaataaattgttagattcctgtgctgcttctcttatgttacgtggaactgtattgttctccataatatattccaatatttctgatacttcatcgattgtttgattagacataaaatttcccctccaaaataatatatatttaaaaaattagtatattaaaattatattattatattaatctttaaatattttttggtaaatttcagtatagaaaaaaatatataaaatatgataaacaattatataattatgtctgatataagtaaaacaactataaatatgcctgtagatttgaaaaaagaattaaaaaaaatagctattgataaagatacttctttatctggtttaattttagatattataactgattatgttgattctggaaaagaaaatgaatcttcacaggaagattcatattaaatcttcagttgaattcaacatataagttataaactgtgttttagctgtttcttcaacgaaagttgcaagtaaagtagcttcttttaaactgtcaccaacacataaaacaccatgctgttttaagattaaaacatcttcatcaccaatagcttttgatgcacttttagctagtttcatacttcctggagcttcatattcaatatcttctaaaaatggagtgttaatagctccgaaaccttcatgtcttttaattctttttgaagaaaatgcaaatcctgttgcatacggtgaatgagtatggacaataccatttacgtcgcttctttttttataaatttctaaatgaagatcaacttcagaagaaggtttaccttttgttaataaattgccttctaaatccactaaaacaatatcttcttcatttaattcatataatgattttaaagtaggtgtaatagcaattacatcatcatcttcacctttaaatctagcactaacatttccggcttttccagcaacaagtttatttttataaagataatctgaaacattaataatttcttcaatatttttttccattttttcacctaaacttaatattattttaacttgttcttatttataaaaatttttaaatgaactttaaacatttatatttccctttgtaaagtacagggacttcagcaggggttggttcaatattataaattttctggaactctgtctgagtctgaaatgttccagaattaattaaatgaataccattgtattttttatgggtgttaatgtgaacatgccctgtatggaagacatctggaacttcatcaattactaaataatcttcaagttctgaagcaagcggagttctttctccgtaaattggagctaaatgtctttttttaagtaattcttccattaacaaatcgtttttctcatgggtaaactctttaactgccattaccaaatcgtcaaaactacgtccgtggtaaattaaaacattaataccgtctaaagagacaacaccagggttacttataaattctacattatcaagttcatataaagcttttgcatactcttcaggtactgcaggttgaggttctgccactctagatgcatcgtggtttccaggagcaataataattttaatatcacttctaatgtttcctaaaaatctggctgcttcattgtattgctgagtaatgtctttaatagccagttctttttcctgatttggatatacaccaataccatctacaatatctccaccaataacaagatatttaacactttcagctatttttacttgttcttcatttccaaattcacaattaatccagtctataaatctagtaaatgcatcttccaaaaaggttaaacttcctatgtgaacatcagataagaatacaatactgaaatccatttcttttttaggtattctcataactccaggatttataatttcatttccgatagccaaatcaccatttttatcagcaagaacaccgataacttcatctttaactagtttttcagcttctttaaagacttcttcatttttatttgaaaatagtattggaatagttcctgtatcatcttcaaattcaataagtttatggccatttttagtggatctgatttccctaaccattaaaataaggcttaaattactttgaccttcttcaatatcagctacttttgtgtaatttttaagttccggtcttttaaccagaatattagctaatttttcatatctgctttggaaataagcaattaagttttcaagttctccacttgtgtatgattttttacttgtgtcctgtatgattttaaagtcatattctacatttgtttttgttaaattccttttaaatttgacttttttattttctacagtttctaaagcttctgcattttccttgttaacgtatttttctttaacatcagattcttttttaaaatcactaatgctggatggttttttagtttcttctttaggtttaggttctacagtaggttttttagtttcttctttaggtttaggttctacagtaggttttttagtttcttctttaggtttaggttctacagtaggttttttagtttctttttgtgttaattgaggtcttgttgttgatttttcaattgtgctatttctcattatttcatcaacagtttgaccgctaactgaaactaaatctttagatttaaaatcacctccttttaatttaacaattaatgaagaggtaaaatctagaggattttcagcttcaagaacttttttataagcctctggtgataggttaattcccttttttgcaaattttaataaaattttattagtcatattaattaaaatttttattttctatattaataaactttgagaatttggattttgaatttttatttgcattaaaaattttttttgtattgattaaatattagtagttacttttattatacattagaaatataattaaatcattaatatttctgttttatacagagataaaaagtaatgtgataaaatggcaaaagcacttagaataatactagttgttgtactatttgtagtattttttgaaataggactctttagttcatatactattgttgctgcagaagctcctgacattgagggattaatagatatgcagatttcaaaaatcacaggtatttttaattctgacaatgttaataatgttttagttaaagatccaactgttgtaaacatcactaataaaagggatgtggctcaatcactggaggatttatcaaaggtagatggagttaatgtagattcaatgaatgtcacaacttatgatgacaaagataatgaagagttaaatgtaactattgaagctttaggttatgcatcaccgtcttccaattcttcacagattgtaattagtcaggacccatcatataaaattgtagctgagggtaatgcaacatttaagggtggaagtttagttgttgatgttgattctatcactatacaatctattttaaaattatactgagatggttatatgattaatgtaattggaattggtcaaaatagagagaacatgactttaggagcagttagagctattaaagaatctgatgttattgtagggtataaaaagtatgtagctcaaatctccgatttggtttctgataaagaaattataaaaaaaggaatgggtgatgaaatagctagagctcaactagctattgataaaagtttatctggccaaacagtttcattaataagttccggggatcctggtgtctttggaatggcaaatgttttatatcagataatcagcaggtatgatgaagatattgatgttaaagtttatcctggagtatctgcagctaattatgcggcagataaacttggagctcctttaaacgattatgcaaacattagtttaagtaatattttaactcctttatctgaaatagaaaaaaaattagagtttgctctgaaagctaatttagttatagcaatttacaatcctattagtaaaacacgtaaagaaccttttagaaggtttataaaaactgttttaaaaattaaaggtgaaaatgcattaattggaattgtagatagtacttatgaacctgcaaaagagactattgtcaaaattaaggatttgactgaagacatggtcaatatgtcttgtactttaattgttggaaatgatttaacttacatgcaagaggataagttaattactccaagaggatatgtgattaaatctaaaatacatcctctttccagtgaccattatgagaaatttttaaatggggaaatttctcacggaccaaatagggaatgtgagttttatccatgtcattatgaaggtcagtactgtgatttttgttactgtccgttttatccatgtggagacagttctactggagggcaatggataaaaggcaaaggtgtctggaattgtaaggaatgcatgtgggttcatgaaaaagaagctgtagattgtttaagaaaacctttggaagaacttttagaggaagtagatgatttaaaagctaagaaaaaaacgttattaaaacttagaagagcttgtttattaaaaaataatccatatgatctttagaggtagtgggaatgtcaattaaaaatattttaattgaaatgaaaaatatgtcggaattgatggttgatttagcttattcagctgttttatttaatagtaaagatgcagctgaagaagttttgaaacttgaaaataaagtaaattcaatgaattatgaaattaagaaagaatcgctagttgcagcgcgttcttatgaagacgctgagaaattaactgcattgcttgaggtggctgaagctgctgaaagtatagctaatgctgctaaagatttagctgatttagtaattacaggattcaaaccacatcctgtatttaaaatggtaatgtctgaatctgataagatgattgtcagagtttctgtagaattggattcagatttagctaataaaactttaggggaattacttttagtaaatcgtactggaatgagagttatagctattagacgtggagattcatggatatatggtccggataagaatacattaatacttccagatgatactttacttttaaaaggtactgaagcgggtgctgatcttttagaaaaacttgcatcagcaacatgttctctagaagatattcctgatgaattggaagaagacgaagattaatttatttttattaaataaacaagtggttaaaatgatgagaggtagtgatatttatgaaacagaagatgattcgacatccttattctaccttttcatcatttctaaaagaacataataatattttaaaagaaagtcttatagctttgttaatctgtgcctgtggagatttagttgcaggtatagttcttggaagaatggatatttttcttgaaacttttcctggactattggttattattcctggagctataggaatgaggggaaacatttttggttcttttgcatccagattatccacagcattacatattggtataatagatcctaaatttaaccgttctgaagagttaattaataatattttctcttcatttgtgttgactttatttttatccttatttttagctatcattgctaaagttatctgtgtaatattcggttttccgtcaatggatattgtagattttattttaattagcttaatagctggagtaatttctatagttataatgcttccagttacaatgtttatttcatttagaagttttgaacgtggttgggatccggataatgttacaactccattagttgctgctgttggagatttatttacattgcctgctattgtagtggctctttttataatctctgctctaaaatcagttgtatatttagagttgatagtctttataatagtaattccacttgtattattcagttttgtatactgttacaactattcagaagaaaataaggtgattataaaacagtctacaccagttttattagtatgttctgttttaggagtatctgcaggaggaattcttaacagttcacttgaaacattacttacaaatccaacattacttacattagtgcctttattttcaggagaaagcggtggtttagtaagtattttatcagcaagactatcttcaggtatacattcaggtcttatagaacctcttaaaagacctgaaggtgaatctgtacataattttgcaattatattattgttggctcttataatgtatccatttataggaattcttgcagaatcatcatctgttttcttaaatatagttggtattggctttgataaaataatattgataagttcaattgcaggatttattttaatccctattatgttgattttggtctattatatttcaattgtttcatatgataatggatatgatccggataatattttaattccaatttcaacaagtattacagatgcaatatccagtttaatacttatttctgtgtcattaattattactgcagttatttttatttaataccaccctttcaggataaattcacagttatttgttctaaaataatcataatccagttttgatttatcaaaatcttttggaacagaaactaaaagggctttgacatcttttttattaaaatggataaacattattgaactaaaatcgactattggaaattctaggtttattctattatttaaatatattttattgcttgtaacactttctacaacaggtagttttattctggtattgtccatacaccattttaagttatctgctgaatctttgtcaattaataaataataatcattgcttcttaagtaatttctatatatcttgaaataattgcagctatagccatccttgtggttatgattgcattttccttttgtttgaaaatcttttacaacgtattttttataaaaatcacatttaaccattctgtttacactgtaaacgttttttccgtcatctggtgaaccaatttttacacttgaaatactgctctctttagggatgacttccattgaagttttaatttttgaatcaaaaagattcttgtcaactagttttctataatttttacctaaaattaaaaatttatcataagaaatactatttggaataatagcttcattttcatttgaaatagctaatcctggggtacctgctaaatatttttcccaatttggagttcccggattattaattaagttatctgcactttgagaaagcaataattcaatattttcattttctgttgatgtagctagtttatctaatgtaatttcactaaatttagctgttataccaattattaataaaataacaaccaacacaaccaatatttcagttgaaatacttcccttttcattcattatactaatactccatatttagttctgtgagcaacatctaaaaatagttcagttggatcttcgggatttattttatggcctggatatctgtcatgaaatacgacatggtccgatccggaaacagaatattcaacacctacgcagtgcggaacaataaagacttcaaatccatagtggggacatattccttttccctcaagtctacataaataacagctgccgtcagcactttcatgaaaataaccattttttaagcagttttgcagggtatctccgtcaccatggtgaatataagggtcatatgggcatttttttattattaaaggactagttgcacctaaataaccttctggcttatcgatgccatgtgcagttaaataggtggttaaagtagttccataatggatttttttatcgtcatgccaaattccgctatatggagttaaaatggcataaggtagggggtcttttaagccttcaacagaggttatgctttttaaattacctgaaaatctgtccttattttttgaaatctttaaatgagttgtaacttctagattaatggggtcatctgtgtttttgatggataggacattagaagatattgaaacaccgtattttttttcatattccttgtttttatcatctaattttttatttaagacttttttaatttctctttcagaactgaaaatatatttcccgtggtaaacttcttctgtaacttcagctattgaatcacgggataaaacctctaaatttctattataatcattaacaatatattttagattatcattagctattgaatcagtattttcattttctaaagtatacatacttgttaaaacaaaaattagaattaatattagagaagctattaaaatcacagttgttccagttattatatttcctttagagtctatttttaaatatttcatcacttgaaatttaacttccaatttataaattattttttcaagtgcaccaatgtgaaaaagtgaaaatatgttttttaattggaattataaaacatatctaaccgattttattttgaaaaataacttaatttcagaaacaattagatataataatttttctttttttacaaaacataaattttaattttttataattttatgttttataaaacataaatttaaatattacaataatgttaaatattaaataactgaaggtggtctaattgattaaacgtaaattttatttagaaaagattgttaaattaatagacacagaagatattaaagttataactggagttcgtcgttgtggtaaaacagttttattaaaacaaatcatcgatgaattagaaaacagaggaatagctagtgaaaatattatttatatgtcatttgaatcttcaaaatataaaaatattagaaatgatgatgatttagatgaatttattttttcaaagacaaataatttaaatgggaaaatttatttattatttgatgaaattcagaaagtaaaaaactgggaagtttctctaaattcttatagagttgatttggaatgtgatatttatattactggatctaattcacaattattatccggagaactagctactttaatttctggaagatatatttcaataaatatgcttccattttcatttaaagagttaattcaatattatgatgaaatgcatgaaaaaattgatgaaattaaattatttgaacagtatttaagttatggtggatttccaggtttattaaattatgaaaatgaagaaaaagagaaatatttatatgatttatattctactattgttttaaatgatattttatataaaaataaagtaaaagatttagatttgcttgaaagattaatggaattcatgatttctaatattggtaaattattttcagctaattctatttctaaatatattaaaaatgaaaatcgtaaaacaactccccatacaataattaattatatggattatgcaagaaatgcttttattttttatcaaattaaacgtgaaaatattaaacaaaaaaggaagctattaatatctgataaatattatcttgttgattccggattttattttatttttaatgggtccactcaaaggaattggagtcagttattagaaaatattgtgtttttagaattaataagacaaggatattccataacaataggaaaaatccaagatttggaagtagattttgtttgcaggaaagctaatcagataaaatacattcaggtatctcaatctattttagatgaaaatactagaaaaagagagtttaaatcattagaaaaaatatctgacagctatcctaagtatgttatatcaatggattcatttgacttttcagctaatgggataattcatcttaatataattgattttttaaaatcagagaatttttaattagtattacattatctctaaatttttagttttaagtattaaaaaaaatacttttttatattattgtgtagatagtatactgtaataaaaaatttttttaaaattatggaggatttgtatgtcagatactgttagaacatggcgtcatatacaacaaagatataatcttataggttccaaatgtaacacttgtggagaattattcttcccatctcgtgtagtttgtcctaattgtaggaggaaaggagatcttgaaccttttcaattcagtggtaaaggaaaaatattcacttactctgtaattaggtcagctccagatgactttaaaaaagtagcaccttatgctgttgctgtaattgagttagaagaaggagctaaattaactgcacaacttgttgactgtgatgttgacaatcttgaaattggagaccctgttgaaatggtctttagaaaaattagagaagatggcgaggatggagtaatctcctatggtttcaaatttagagttacaaaataagattgcaattctattagtaagccatggaagtagtctcccttttgcagaagttacctttaacgagattaaagataaatttaacaaggctactggatttgctacagaagtaggttacatgaaagtagccgaaccttctattgctggagctgttgaaaatttaaaagaagaagttccagaacttgaaaaaataatagctattcctgtatttttagctcctggaattcatactaatattgatattccaactcttttagggttaagtccgctggaaactgatcctagatgtcctgacggtaattatcctgatgaccattatttatctattgctgaggatgttgattttgatggagatattgagttattgccggctattggaccagatgataatcttttagaagttattgataaaaggattaatgaatcattagctgattctaagttaaatggtgatgctaaaacaggaattttattagtttctcatggaagtagattaaaatataataaagagtttataagtgaagtttataggaagtttagtgaaactactgattatccatctaattttggattcatggaacttgtagaacctaacattccgacttctattaacaagcttattaatgagaatgaaattgacagattagttgttgtacctgtgtttatagctccgggagttcatacaacttctgatattccaactattttgggtttaaaagaggctgattcccattcacactcacattcacacagtcatgaacatggtcatgagcatcatcatcatcaccatcatcatgatttggaagcgattgattttgaaggggaaattttatatccagaacctattggttcagatgatattttaattgatatcttagtaaaaaatatggaaaaagctttatagattttccgtattttttaattaattttttttatgtgattataatgactagtgatttatctaaaaccggaattttacttttaagtcatggtagtagattagaccaaggtaaaaaagtaattgaagcatatacacaaatgtataaagaagaattccctgaagctattgttgaatatggatttatggaaatgagggaacctaatattcctcaaagtattaataaattaactaatggaaatgatttggaaaaaattattgttgttcctgtatttgtagctcatggacttcatacaagaagggatattccaaaattattaggaattgaaaatgattttgatgaatctgaaatatccggcggacatcatgagcatcatcatgaccacggacatcatcatcaccataaccaccatcatgaccatgatcatgatgatgaagaaacatttgattttgatggcgaaatagttttagctgaccctttaggcattgatactcgtttatatgagattataaaagatagagtatctcaaaatttataattccttaatcatcaccacttgtggtggtgcttaactacttttgatattaacatttatatataataagatgtataatttatattacattattgaaagaaataatgatatttttttgtgatattatgaagtttaataaaatatttttatttactttaatattattagcggcattatctttttcagctgtaagtgctgaatcttttgatggtaatgatgctgttgctgtaaatgatgctaataatgttattgtatccgaacaaagttttacagatgtaattagtggatctgaacctacaatttcagatgatgctaatcaaaattcaagtactggaggggatgtacctgctccttccactaatgcttctactggtgataatggaactaattccacaccggaagataaaaatagtactataatttctgaagatatttcattattctataaaaatggtaccagattttctgctattttcttagatgaaaacggaaaagcattagctaatcaaaatatcgtatttgttattaacggtgtatcttatactaaaaccactgatgaaaacggtatggcaagtattggtattaatcttgcaccgggcagctatgttatggaatctaaaaatttagctactaatgaaactgttaaaaataatgtaactgttatttcaacaattaatccatccaatgttgttaaattatataaaaacggcactcattattatgctacttttatagacggtcaaggtaatgctttagctaataaaactgttaaattcaatattaatggtgttttctatactagaactactgatgaaaacggtactgctagattaaacatttggttatatcctggcaactacatattaactgcttataatccaattaataatgaagcaagagcaagcaatgtcactgttttatccactattaatggaaaagatgttacaaaatactacagaaatggtactcactattctgcagttgttttagatagtaatggaactcctttagttaatcagactgttaaattaaatgtaaatggtgtattctataacaaaaccactgatgaaaacggtactgtcagattaaacatttggttacttccaggcagttatattataactgtttacaatccaagtaatggtgaagaaaactcaaacaaaatagaagttttatctaaacttgttgcaaaagacatgactgtagagtatcaagctggtaaaaattacacagttaaagtattggacggtcaaggtaaagctttagctaatcagactgttaaaattaatattaatggtgtgatttacactaaaattactgatgaaaacggtactgcttatttaggtataagattaaatccaggtaattatatatgtacttcttactggaacgattcttttgtttcaactaaaattgttgtaaataaattaacagcttcaatatctgttttaactcctacagttaaaaaaggagattactacaaagttaaaattacagataaaaaatccagcaaacctattgtaaatcagttagttttatttatctacaatggagttgcatatggatcatattctgataatgctggaatagctaagattaaaataggtttacctgtagggtcctaccagttaatcacaggtatccaaagcagttattggtatcagaatattgctgtgtacaacacccttaaggttacagcttaattaagtgggatttttcccacaatttttactttttttaattcttcagataattttaagcacttttttttaaaaacttatttaatctataaaacttatagtattattcatgactttaaaggtctcagatattggtgaaaaggaattaattaagtatattctggctaattgtaaaactataactccagatgatactgcagttactccaatagctaatactaacttaatttccacctgtgacatgcttattcaatcaaagcattttcctgaaaacatgtcttattttcaaatgggttttaaaagcgtaactgttaatgtcagtgatttggcggctatgggtgctactcctttaggatttctattgtcaatagctcttccgaaagattttgaagttgatgattttaaacaaattattaaaggagttctaaaagcctgtgagtattatggtatttgtttaattggtggagatactaatgaagccagtgaaattataatatctggaactgcattaggtctttgtgataatccgttaatgaaaaacacttctgaaaaaggggatttggtagttttaactggtaaaatcggattagcagcattaggttttaatttagaaaatgacaatatctacactaaaaaggctttggaaccaatagctaagattaaagaaggaatcaatattaaaaattctggcggaacttcagctactgatattactgatggtttagctagtgaactttatgaaatgaaaagggaagatattggattcatgatttatgaagataagttagatatttctggtgaatttaagtcattagctgctgagctgaatcttaattatcttgatttgcttttgcatgttggtgaagattttgaacttgttttcacgataaataaaaaaaatttacataagttaaatttcaaatatctggttattggtgaagtaacggattccaaaaaggttgaaatcaggttaagtgattctacagttagacaaattagttccagaggatatgatcattatgttagttagcagcaatctttttaagaaaagttccaagtcacgaaaggtaaggtgtgagatttgtgccaattattgtaaaatagcagatggagcttatgggatttgtaaacagcataaaaatattaatggagagttatttgatgaaagttttggcatagtctcttctttaaatgctgatcctattgaaaaaaagccattgtatcattttttaccgggaactttaacatattctgtaggcggttttgggtgtaatatgggctgtctgcactgtcagaactatatgatttcaaaggaatttgataaaatttctgataggttaaatatacttccagaaacgattgtggaaaatgcaattagtcaaggttgtaagtcaattgcatggacatataatgaacctactatacatttaccatttaacaaaaaaacttctttacttggcaggaggaaaaatcttaaaattatctatgtaagtaacgggtatatgtctagtcaggcactgagtgaaattttagagtttgttgatgcgttcaatatagacttgaaatccatgtctcaaaatttttataaaaaaatatgcggagcagatttaaacatcgttttggacaatttaaaacgaatttatgaggcagataaacatttagaaattacaaatttaattataaatgattacaatgattcagcagaagaaattacaaaattagctaatttcattgttgataatttgggttgtaatgttccactgcatttttcaagagcattcccatactataaattaaatgatattgcaccgacatctgaagacaaattatttgaagctaaaaaaatagctaatgaatgtggacttgagtatgtttatattggaaatttggagtgcgatacaaatacttactgttcaaattgtggtgaaactcttttaaaaagaaatagctattctacagaagttttaaataaaaataaaaaatgtatgaaatgtggaaaaaaattaaatatcatgttttgattcttttttctataatttgtttaataaatataagaatagctaacatatttccataataaaaaaatatgtacattctctccattgacggggttgacggagtaaaaccaaacattattgtggaagcaaatccaacaaacattatgctgtatatcggccataaaacacttttttgatttttatatattgaatataggctgtatagaaatgctataatgaaaattgcataaattgttaagcttaaaatcattcttttaatgcttattggaacatagccatagcgaacaatatttgcattcattatctgaataagtgttagattatctgttaaggtaagaatccaaaatccactagctattataaatgggattaaactgattatggtttgttttttatttttagtaagtaaataaacacatattgcaataattccaagtaaaattaaagtagtaagatcacaccaggtaacacatctatttataatgtgtgaaaatccgatattaagtttatttaatatattcagctgcaaataatccggaaaccatcttagttctagaatatatcgtttatgaattcccggacaaataacagtattaataattcctataactgatgtaattcctattagataacattttttattgatttttgttttgtagttaagcagataatacagcacaaacaatccgagtaaaataacagctagctgctcgttatttactgcaaacataagacaaagtactgaaattatataagccaatattctttttgttttgcaggtatcctttgcagcatgattttttaaaatatatatggccaacaagccactgaacaatggccaagtataattaatggttgttgtaataaatccggctgagcctaaagcataatgacttgaaaatatgaaggataaacataatatgcaagataatgtagaataaaaaagcttattttcaccgttaatgagtttataagtcagtacagcaataaatgtgaaaattaagctatctaaataccaccaaagtataagaggggattgtaaaatatggcataaaatatattcaatcagtattctggagctccaaatatcatatctttctataacaaagctcataatatttgtttcttggggaatggtgtaaaaaaataagtcatctatcgataatccaatcgaatggtgccaattcaataaaattaaaaataaaaatataaaaggtaataagaataaataattcttatattttttaatattcataattactctccgaaactaactctttcaaatttatctagggtttttaaggatttggtggcatccaaacctatttttgttgttgtaccgtcactttcagctaccgggtcaagggaagatccacgtacattaggaacaatcattaaatctctgtctccttttacacgggtagctattgcatattcaatatcctgtgggtcaaatacatctacatcagtgtctacaacaacagcgtgtttaagtgaaggatgtgcagacagtgcagccataattgcattttttccatctccttctgtttgtttgttaatggaaatagctgcatgtaaccagcaacaccctccttctgttaaaacaacattttcaacagttggaactgcatttttaacagatttgaaaattctaggttcttgaggaaggccctgtaataatttatgttcaaatccggcaggaaggattccgtgataatggggattgtcctttttaatatgcattttgcttaagttgataattggctggtcacgaataatgtcataagtatcggttaagtctacaaacggaccttcagctgaagtttcacttacagatattttaccttccaaaataatgtctgcttgaggaacttccaggtctccgcatttaatcagggtcaattctccgtttttaaatgcattggccacatccatttcattgtagtcaattgggattgaagtagtacttgcaagtaaaattgcaggatccattccaatagctattgcaatttccaaatctttgcctaatttttgagctttttggaaatatgtgtagagatttcttggaacaatcctaataaccagtcttttatcatctaaaacaagcattctgtgaattgatgcattttgaatacctgtttcagggtcacgtgcaaatactacacctgcagtaatatactttccaccgtctcttttataatgtgttaaaataggtattttatctaaattagcttctgtagtgttataatctgaaaaatcagtaaatttatctactttaattggattatcactggcttctatgattttttgagtaatttcacttacttcacaattaatagatttagctattttttctcttgtattgcagattccggaaataatcggcaaatcatatccttttacattttttataataacagtgtctttaggatatttccttagctctttagctacttcaaactcgcttgaaagctcagttgttatttcaataatgttttcatctttgatatccataattatcccttatatgttgatttttttattttttaatttttctaaaagctctaaaagaacaggattgttaatagaaagtatttcaccacttaaaacagcagcattacgaccattattaacaccaacagtagctacaggtactcctggtggcatatttacagttgaaagcaggtaattatttccaagttcattttcacatggaactccaataacaggcttttcagtaagacctacaagacctccacttacctgggaagagttggaattaattccaataaatattttagcatttttcatagtgtttacatatgctctgaatttttttcctgatctaatcgggcaaattacttgcatatcatgaggtattttaagtctgtctagtgtaacacttactttttttccagtaattaaatcagtatgtcttccaacaataatgactacctcagcatttttattaatgtagcttccattaaattcttctgtagtttcatttaattcgaggtttttaatccttaaaaagtcattggtaatatgtggattgtctattttttgaacaatttcttcattatttttaatgactttctgtttatattcttcttttaattccaatacttttttgcgtatttcctcgtcataaagccctaggatttgtgcagctaaaatagctccattatctcccctatcaattccaacagtagctacaggagagggataaggcatttgaactgaagaatatagtgcatccagtccgctaactttaacatctacaggaactccaataaccggtttgtgagtatatgcagctattgctcctggaagatgagcagctaatcctgcaattccaataaatacttttatacctgcattggttccctgtacaacaagttctcttacaagatcaggtgttctatgtgctgaagctattttcaaactatatggtatttcaagtttttccaaaatcttcatacttttttcagcgatagcaatatctgacccacttcccagaattatcattacttttggtgtcattttaaaataccttctaaaaaaatattaataattgatatttgtttaattttatattaaaagttatttaatttcaacttcataagcagtgtatttatctaagtctattggaagctttttaagattatatgtatcatgatttagagttatttcattatcataatgtttataatttatgaaaaagactttacttccatgagatatttcattttgaatacctgggtcagctaaaacatcactaatctgattagcagtagtattaaaatctttatcctctgttactgtcagcataaaattatggtcatctgtcagataataggaattcatctcaaagtacggaacaaaagcatcataaataataagatttccactaccaaaggtttcttctagtgactgtattttattgctgtcattaatttggtcgttaatttgagtttgtgtaaaattaacacagccaactgaagctacaagtaagataatcacgaaaattggaataaatatctttttattgctgaagtttttgccaagtaaaatacttactcccaaccataaacatcctaaaacaggtattaaataacgtggatgaaaaacaggtttgataattaaagataagattattccgataatcggaacacaaacagcaattaaaatcccgtaggtgtcttttttatcacttttaattagtagaacaataactccaattagaagtaataatcctaaaacagaaaatgcagctatctgatttgcattaataacctgattatccggtgataaaacaaaccagaaatatcctaaaatcttatttagtgtaattggagctatccagtaactgctgcttacacttgcagcctgttgttttagaataatcagccatggtgtaaaacttaaaatagctataattgctgatgtgaagtattttttaagctcatttttattatttctaattaaatcagcaagtaaaaataaataaatgacaaatgaagctactgctgagaaataatgtgtgtaagcagaagctattgttagtaaagttaaaattccccagcttttccatgttgagtttttatttaaaatatcataagcataaataaaacttgctgttacaaagaacagtccccagctgtacattcttaattcaacagcaaaattcattagctgaggcatgctaactatacaaaaagcaaataaacctgcagttaagtatccccagtttttcctaactttcgttgctgctagtacaagtattaaataaaatggaagcagtgaggtgaatttacctactataatcggatttattcctaaaaagactccgattttgtaaaatactttaaaaatcagataataaagtggagggtggacatcaagaaaagcaaaattaataaaatcattaaatggagatttaaccattcccaaagagtatatttcatcataccacattcctaattttgtaaatccaatataggaaacataaagcaatgtaattatgcttattataaaaagtatttttcctaatttgtcttctttatttaaatttttcataataatttccaacttaaagttttttcccataaaacataactctacgtgctgtgaaattccagaacattactataatggatgctataattttagaccagatgtagtttatatttccatagtctacaaatgcgtataataatatttcagtaaaaataagcccgataaagctgattaaaataaataaattgaaatccagaaccttattatttctgtctgtctgattaaatacccatgaagtagacatgtaataattagccagcactgatataaaaaaagcaatagctgctgaaattaaataattttgtcctaaaaagttaattaatgataaataaataatgaaatctattaaaaaagatgcagttcctacaaataggtatctaaacatttgtaagaaaatgttgtcagtactttttctaaataacttattaattaatttatccatagttataatcttaattttaattatttaataagttttagttttaattttgtttacagtgtctgtgttgttgtagctgcttgttgtgatgtagtcaccaggatttaacaaataaaaattataatcataaataattaatactattagtcataaaatctttattataatgaaaactgcagttttaatcccctgttataatgaggaacttacaataaaaaaagttatcctggattttaaaaaagccttacctaaggcagatatttatgtctatgataataattcaacagataattcttatgaaatagctaaagacacaggagctattgtaaaaagagaatatagacaaggtaagggaaatgttgtaagatccatgtttagagatattgatgcggactgttatattttagttgatggtgatgatacctatcctgctgaggcatcaaaagaaatagaagagttaattctatctaaaaaagcggatatggtaattggagacaggctgtccagtacttattttgaagaaaacaaaagaagatttcataattcaggaaataaactggttagaaaacttataaacactatttttaacagtgatatttcagatatcatgaccggtatgagaggatttagctatgaatttgttaaatcatttcctatttcatctaaagaatttgaaattgaaactgaaatgactatttttgcactaaatcataattttttaattaaggaactgccaatagaatatagggacagaatggatggcagtgaatctaaattaaatactttcagtgatggttataaggttattagcttgcttttcggacttttcagagatataagacctttgtttttcttttctttagtaacgttagttcttttaataatagctggtctgtactttttcccgattttaattgatttttatagaaccggatttgtggaaaaggttcctacacttattactgtaggagtagtagctattgtagctgttattatatttttcacaggtgttgttttgcatgttattagaaaacagcatgatgaaaactttgaacatcatttaaatttaatagctcaaaataaaaaaaggtaaaatgttaatatttaacagctgttgtcagcattaacattccggaaataaaactgatagctacagtcagcactaaaaagcttaaagtttgcttatctatttttttattgcctattccaaatacaaacggtaaaaatattagcaacggcatgaagtaacgactgaatacaccacttgttacattttcccctccaactggagaccatgttaagtattggatagccattacaccactataaattaaaataattattaaaaatcctttaatacgtgtttttaaatttaaatctttgaaattacaataaaatacactaaataaacagaagaatacaaagtaaagtcctgcaagaagagttgatgaatattctcttacactatttgagaaataaaagaatctgtcaataacagttggcagtgcagtactgtagatctcaccaaatctttgaagtgcaattaatggattggccagtaagtaatcaatttgaccacttgcacttacatttctttggataaaatattctcctctccaggaattagctagttgtgttgttgcatagctgctccaagcaattccaatacctaaagcaactaaaatacaaagtttagatatgatattttgctttttatcactaaaatttgtatttggaaccagaaaaatcaataaacttaaagccaagtaaggggttttaagcagtccgcatagaattacagctatataaaatatccctaaatccgtccaggtaattttaggtgttttatagaaatatagaaaataactgaatgcaagaatggccagtgcgctgaataatccatcacagcttgttgatgcggcttgataaatagctattggaagtattgacactataagtaatggaaacttaaagactggtgcttttttaatagctactgcaattattccggcatataataataaattaaagaatcttccaagccataacatccagattgcatttaaatccagacattttgctaaaaacactccaattccctgtgctaaataaccataaaatggattttgagcaaaagcggagttgaaatatgatggagtatgatctattttatcatcatctgcatgtgtattaaatacatttgctccagcattatcaaaaaatgtggttacacttgcaattgttttataaccgtttgcagttgtatttggaattggcacataattggttgacaattctccggttgaaactatttctgagcggacaaaatgttcagtttcatcagacacatcataaatcggtgtcaaaaacaggcttattataccaaatattattattagtaccaatgcaactttatgtaacttctcattgttttttgtatagtatacaatagataatattcctgctatcagcaatatacaaaacataagcacttcaaattcaggatttgaaaagtttgccctatatgtgaaatacaggctgaataagcttaatattaaagcatatattccaatgaaatatttcttattttctaatttaaacattttaataacctttatttatattaacattgataattgtattctatttctagctaaatcaacatctaaaaccttaacatcaacaatatctccgacacttacaatatccagagggtgctttacaaatttgtcagccagctgtgaaatatggactaatccgtcctgatgaactccaatatctacaaaagctccaaaatcaacaatatttctaacagttccctgcataatcatgccttcttctagatcatctattgataaaacattttttcttaaaacaggttttggcatgtcttcacgaggatctcttccaggttttttaagttctttaacaatatcctgcagggtaataacaccaacgtctaactgcttagataattcatcataattcaggttatctaattttaagttatctgaaccgatatctgccaaactgtatcccaatttatctaaaagtttgactgcagcatcgtaagattcgggatgtattgtagtgttgtctaaaggatgttcgggattgtctatttttacaaatcctgcacattgctcaaaagtctttttaccaagttttttaacatttaaaagttcttttcggttgttgaatttaccgttttcttctctatagctaatgatatttttagcagttgatttggtaattccggaaacataattaagtaagctagatgaagcagtatttaaatcaacaccaacttcattaactactctttcaacaactcctcctaaagactcattcaattgtttctgattcatgtcatgctggtactgaccaactccaatagatttgggatcaattttaacaagttcagccaacggatcctgcagtcttctggctattgaaacagcactgcgttcaccttcattaaaatcaggaaactcttcatcagccagtttacttgcagaataaacagatgcgccagcttcattaacaatgatgtattcaacagaagtgtttttaataatattagccactatttcttcagattcccttgaagcagttccatttccgatagctattacatcgacatcgtactttttaattaaatcaagtaccactttttcagattccttaaccttattttgaggttcagttggatagattagggatgtttctaaaactttacctgttgaatcaataacagctaatttacatcctgttctaaaagcaggatcccatcctaaaatagtttttccacttaaggggctttccataagaagttggcttaaatttttagcaaaaacttcaatagatttctcttcagcctttttagttaaataacttctaatttcccgctcaatagccggtgaaatcaaacgtttatatgaatcttcaatagattctgtaataattggggtggtatgagggttatattcaatcatttcaggaactttggagcagtttttaagtgtgtgtcttttaaggtattggataatgtcgtcttcttcaatatccacttttactttaataatgtcttcattttccgctctgttaatggctaatatcctatgtggtggaattttagatagtttttctgaataattaaaataaatttcatatcctgaagcagattcatctttatttttagctttagtttcaattactccattataaaaagtattctgtctgattttttttctaaaagtggaattgtcagaaataatctcagcaattatgtcttgcgctccttcaatagcttctttgggtgttttaacttcgtctgtaacataattttcagctattttggaaacaggttctttaacttcctgagccaaaataagactggccagcggttccaaacctttttgttttgctattgttgcacgtgtcctttttttgcttttatagggcctatataaatcatcaagttccactaatgtttctgcattaagaatttgattttttaagttgtcgtctaactttcctaagttgtcaatgcgctctatgattttggtttttttatcttccaagtttctaagatatttaagcctttcatcgaattttcttaaaagttcatcatttaaagagccggtaacatcctttctgtatcttgcaataaatggaatagtgttgccctcatcaattaatctgattactttgtttacttgccattgttccaggtttaattctttttcgagtgttttagctatcattaaaattacattcctaatatattacaagaaattatcttttttttaattaatataatttcatcttttttaaaattgaaattataaattattgctaagagtatagctattataaatttgagcttattttaaaactttattatatgctgaaaagttgttgatgtaataatgattaaacaagaaactcaagaaagagaatttagacatcttaagttattaatgataattttgaaaagattgttataagtatggatgattttgatttttcacatgatggaattaaacatttaaatatgattaagtttttaaaagaatttatctaggatgtgatattatggcagattttgaagaagttgtaaatacaagacgaagtattcgtgaatatgactcaaaagaagttgaggatgaaaaaatagaaaaaattcttaaagcagctatgcaggctccaggaagcagacttaaggccgaaccatgggaatttattgtaattaaaaacagaaaaacccttaaagaaataggtgaaataaaacctagagtcagggatgctccagtagctattgtacttgtagccaatattgaaagggcattttataaaacaatgtggcagcaggatatgagtgcagcagctgagaatatgctgcttgaagcttgtaatttaggtttaggtgggctttggaatggagtgactccagaagaagaacgtatggataaaatagctaaattagtaggcattgatgatgaaaatctaaaggtattctgtttaattacattaggttatccaaaagaaggtttaaaaaacgaattcatggacaaatttgatgagtcaagaatccactatgaaaaatactaaacatttatactataaataacatatgtatataaagtattaaattattataggtgaattttattgtcttggcttgttgtgcttcttgtatttttattggctgcatttaaaacagaaaaacctaagaaatatatgaaggtttctgttattattcctgcatttaatgaagaagaaacagtagccaatgtgattaatgttgttaaaaaggtcaaatatgttgatgaagttattgtagtcaatgacggatcaacagataacaccgaatcagaagctaaaagtgccggggcaattgtaatcaaccatgaagtaaataagggtaagggtgaagctcttactacaggttatagaaaatctgaaagtgatattattgcatttattgatgcagatattcataatttaacttctaaaaaagtagatgctatgattaggcctattttagaaggaagaacggatattaccaaaaccaaattcgcaagagaaagcggtagagtaacagagttaactgccaaacctcttttaaacttttttttcccggaaatttcatttgaacagcctttaagcggacagtttgctgcaaaaaggtcagctttaaagaaaataaattttgaaaaggattatggtgttgatgttggtattgttattgatgctgatgttttaggcatttctgtagaggaagtggatattggagaaattgaacatgacatgtctccattgtctgatttaaatttaatggctaatgaagttgtaagaacaatcattgaccgtgctaacaaatatggccgtgttgtaatgattgatgaaatcggttactttattagaatgtctattgtaggtttgtccttaattattttaggattatttgcaatattttttgtaaaaccagttcctttagaggtaggagttattgtttctattgtaggagttataatagctatttgttatattattaaagtaattgtaaaatctgttgtaatatatagaaaagctccaacaggcaatttagttaaatcatttattaaggttcattttccgctgattatttcagttattattttgattttgatgatttcaacatttataggggcagccacttttgaagagggcactatttctattgaacctagttccagaaatttaattatttttgcagatgatagcaataatacaatttctgtaaggggaccatacactgtagactctgcaattgaaaatgaaacagatgtaatccgtatgccagcagatagcttacaaacattaggtatgaattatggtgatagtcttattgtaaatggtgtaccttacttgataaatgatactcgtagcggcgaggtagatatattaagactccctattgatgctaaaaatgcacttaatctggaagatggtgatgtcctgcaggacagccgtttaggtcagatctttgaaggaacagtagttcaccatattttcaacaaaggaaatgccagtttggttgaatcatatattatatcttcaaaaggtggaaatacatattcttacggcatatatttggataatgaatcaatagctaattcaacagccatatttgaagataataatacctatagtgtaggtttaaatcaggaagaaataggaacaattgaatatcagaatgcttcatttacaaataatactcaaagtttttattatgacggtcatgtaattgaaattagatttgaaaatagcactgctaattcaataaaacatataactaacatcaatcagggatttttcattaatttaaatttataaaaataaaaaaagaaagtttatgatttgtcataaacttttacagcttcttcaacatcattataaagtccaagagctgcaagagcaccaacttttccttggtctcctgtaacagctattaaatcaatacctaattctttagctgtagcttcagcagtttcaatatccatcattccagacttggtagctattgaatactgtcttaatttttcaggaatttctaatccttctaaaactgcaattgcggttttatcagataatgtatctcttttaagaatttctacagttcttttgattaattcttcttttttatcttcaggcactgcaaaagttaatgcaattgaaacgcaattttgtgttttgtgtgggttatggggatataactgaacaataatgtgatccaaatattcaaatccttcatttttaagttcaacacctaaattatgagccattgtccaggtagcaccagcatctttaatatcagtgtcatcgacaccaataactactttttcaagtttaggggtaactactctggctcttcctactttagaacctcccccttcttcaagaagttcaatgtatttaacaccttcgcccattcctctacacattccagcacctacaccagctccagcaaggcctgcatgagttactttgacttcatctccatcaacaataatctcatcaattcctgctgcattaaaactagcttttaaatcaagtggagcacaacctatatggcatgaataaacatgtttgtttccatctctgtatgcagaatcaattaaatcactgttgtttttgtattggtaaagtaaccagtgtgatcctgaaatacaagggtggaattcaacgatttcgactttatctccatctaccattgtcaatactttttggtagggtgcaatccaggggtcattaaatttttcttttaactgatcaggttttagaatttccatgtaatcatctaaatttcgtttaatctatcgcacattttaatagctgcttcaacagctcttttaccgtaatctacacgtttgtgtgcatctaatcttgtcatacctggtccgctgattcctaaagctactggtttttcgtattctaaggataagtcagctattttacgggatgcatgctgtgctacaatttggtcgtggtctgtagctccttcaattactgctccaagagtgattactgcatcaatttcatctttttcaagtaattttttaatagctaatgccatatcaaatactccaggaacggttactacctgtgtaatttcacagtctctggatttagcttcttctttagctaaacctaacatcatctgagttatgtcataattaaattcagcgactactgcgcctatattatattttgccatttttaagtcctccaattagataaccattaacataaaacttgcaacaccacttaataccataattaagatgataaaaagtgcagctgctctttttttatcgattttcatattattttcctcatttagataatattataatttaagatttttattattatttaaattttcttttaatttttcttaacttttcagtagccttccaactatttgaatttaatatttgggaattaatattttctaattcactgattttattttcatattcactgtcttttctaaactcttcttggcatacatcaattaattcggatattttttgggttaattgtattagtctttgatgatagtactcttctggattaatgtcattattcaaaacattattttcaatatttagtttgtcttttacaatattttcaatggctgtttttccagaatcaatattatttaatttggatttgtaatcaatatctaagttgtccattacactttcagattcacaaactccccaaattgaacttccactgcctttatagtcggagatttttgaaggcagatagggattaattttaaaattgcctttttggctgtcttcaacaagcaaaacatcaaattttgttgtaaggtttaaaaattctaaaaaatcaactgaagggtttaaaatagttttttcatatatttttgaacttaatacctgttgaaatagagttatagatgatgtaaatatgtgtaaacgaattttatttcttatattttcatttaaactatcaaatgcatttataaagtcttcaaaatgtctattgctgtatatatccccgaaatatgctaaatttaaatagttattgtctatattatagctacttttaaaagcatagtaatatttcatatctaatgtgggatgggagctaattttagcttttttattaacaatatctttaacatcatagggattggtgctaatcataacctctttctgatttttattggtaaagattatctcatcacacaataaaaaggttaaatactcacaaatgcagtttatatcatcattaactgataaattcagatttaatttttcattaattcttccaatgtagtcttcatcttcaatagctacacttaatttgtcttttccgaaggcgtaaattaatggatctgaaaattctgcacgccaataggtttcaggatgggctaatttatattcaatcgctaaaaaatgtgaatggacaaaattggctctactgtaaattttatcatagacttctgcattgtctaaagcagccattgatttttttacaaagtttttaatattttcccagccagtggaaaaattgctttcaattactattttatttattaaaaattgattaacaatattttcaagtgtaaaatctttatccaattcatccagacttccacaaataacatctacattttttttctcagttaaaattcttttagctactgtattgcttgttgcagtgtttgttgggctaaaagcataagatattattaattctcttttaggattatctaatttggagatatcttcatttaaatatttaaatgggaaaaaatcaaagttataactatttatatcttccaatacttttttataatcctcaggatgtttttccaagtattgatttattttaaaaacttgtcctccagttaatgtttttaaaaaactggtgacttctatttttttagctctttttaaattcttattaatttcattaattacttttaaacggtctgtaacattaaaatcataagataaaggcattcttgaaatagaattatctcttagcagacgataataattggcaccttggtttttatcaattatgtaaaattcaaagtcataatctacataaagttgaatataataggcgatatcaacaccattttttaaatcaggattaaaagagtatttttttacaatatcagttggaactaatttgtctgttgtaattgtaagcatttctcttaaattatcataaggatttttgaataatcctgatttttctaatttgggagttaaataagagtctctgacttcaccgctattttgatcaacatcataaaaagttccaataactatacggtcttttttagcatattcatacattttttcaaagtaattatagctgatgtagtcatcatcatcaataaaaatagtgtactctttatttataagttcaattccatgatttcgagcattagatactccggggtcactataagttaaaataatattgatttgaggattttcctcctggtattttttaataatgtctggtgttgaatctaattctccgttaacaataaaaacagcttcaaaaagatttggattaatggtttggttaattaaagaatccaataatttagaaataaacgcttctcccttgtatgttgggataatggcacttatgcctttttctaaattagattctttaatcatatgatttcctcttataatgcatttttaacagcttgtgctacttccatggtagttgcactgccgcctaaatcaccagttaaggttttaccttcacttaatacttttaaaatagcagcatcaaatttgtcagcagcatcattttcaccaaggtatctaagcatcataattgctgagagcatcatagctattggatttgctttttgctgacctgcaatatccggtgctgaaccatgaacaggttcaaataaagcaccatctgctccaatatttgctgatggaattaaaccaagtccgccaacaagtcctgcaccttcatcagataaaatatctccaaataaattggtagttacaacaacctggaattcctgaggctgtgttacaagatacattgctgttgcatcaacgtaaaagtcttcagtatcaatatccggatatttttcgccgacttcgtagaatatttttttaaataatccgtcggtttttttaagaacattagctttgtgaactgcagtaactttagttctgttgttgtcctttgcatattgaaaagcataatcaataatacgttcttcagcttctcttgtaataacacgtttagctattgcaccatcttcggtttcttcttcctggtctgcaatgtataatccttctgtattttcccttacaatcataaagtcaacattttcaaataatgatttggtgttaggataagatttgacaggtcttaaattagcaaacattttcatttcctgacggatttttacaataacatctgctgcagtttctccggcagctccaaataaacatgcatcagaatcccttacaatatcgatagtttcctgaggaagaggtgttccatgttcttcattgcattcgtcacctgctataccataaatataatcaaaatcaacatctaattcgtctaaaacagagattgttgcttccataacttctttacctattccatcacctggaataacagctatctgatatttattgtcttttttgtttgaggtactcaattaaaccacctttttctaatatttctaacataaatggaggtaattttttaaatgtaattgtttctccattttcggatgttatagttcctttatccatgtctacttctatttcttctccattttctacaagtttacttatacctggagcttcaagaagtggaactccaacatttgtagcatttctgtaaaagattcttgcaaatgattcagctattactgcagctactccaacaccttttaaagctattggggcatgttctctggaagatccgcatccaaagtttttgccagctacaataaagtcaccttttttgcatttttcattaaatttatcatctaatccttccatacagtgttgggataatctttcttcatctgtataaattaaatatcttcctggaaggataatgtcagtatcaatatcgtctccgaatttccaaacagttcctttcatattctcactccggtgcaacaattcttccttcaatagctgaagcagcagctactgcagcagaagacaggtaaacttttccatctggacttccttgtctgcctttaaagtttctgttagatgtggaaaggcttacttctccaggtcctatgattccggtatgtcctccaagacatggaccgcagcatggagcagatactaaagctcctgcatcaacaaatattttaagtaatccttcatcaagtgctttagagtatacttctttggaagctggaataactaacattctggttcctttagctacttttttaccttttaatattttagcagcatctcttaagtcactaatcctaccattggtacaggatccgaggaatacttggtcaatttcctgatccacttcacttactgctttaacattgtctacatggtgaggacaggctacttgcggttccaactcacttacgtcaatatcaataatattaagtgacggagcatctaagtcagttttaaatactttatatgctttgttggaacggctttctacataatcaatagtttttttatcaggttctactaaaccagtttttccacccatttcaatagccatatttgttaaaaccattctgtcagaaatgctcatatttgaaacagtttctcctgcaaattcacaggctttatatgttgaaccgtcaacgcctacctggccgataatatttaaaataacatctttagcataaacattatcttttaattcaccggtgatttcaaatctgttggtttcaggtactttaaaccataaattaccttctgcaaataccatagccatatctgtagaaccaattcctgttgaaaacgcacctaaagctccatgagtacaggtatgtgaatctgcaccaacaataacttctccaggaacaacatgtcctaattctggaagaatctgatggcagactcctgcattaacatcataaaagttttcaattttctgttctttaacaaattttctcattataatatgattgttagctgagtcgatagaatcagctggaacttgatgatcgaatggtattacaatttttgacgggtcccagactttagtagcaccaattttctcaaaagattgtactgaaagaggtccggttaaatcatgagtcattgcaacatcaatattggcgataacaatatctccagcctcaacttcgtctttaccagctgctttagctaatattttttcagacattgtttttggcatatttttaaacctcacatattaatgataaatatatagatgtttgtactatataaactattttagaatggggctttgtttatttttttttcaaaatttcattttttttttattgaatattaaaaatagagtataagttttcccattgatttgttatatctgtattagtataaggtattccgtctaatttttcaactaaaacatcacattgcttgcataattctaagttttttctgctattttcttttttatagagaatttcacgtatttctttagcttttttaccattccaaatatctacaagttttgcagtgtttaaatctcctaaaataacttttccaaaaggatcacaacagcataatgggactttaccatctggttgaacaactattttgttaaatggtaataaacaggatgattttaaggttaaaatttcatttctgttgtctgactgcccgcctctgcttgttaaaatttgattttgaagtcttaaatcaattaaaactttctttttaagttcgggatgttggatacaatagtcaaaaatttcttttactggttcaataagttgtatgttatcattatagttatcaataactattaaatccaaattttcggttaaatcaagaaatttgtctattgttaataatgtaccatttgtatataggtaaatatagctatttggaagctcttttctagcatattcggcataattatagatttctttatcaagcaatggttcattattggaatggagtgcaatagctccatcataattaatttcttttagctctttgattattttttcaaacagttctttaggcatttttttatattctctagggtcttgattcttgttaacaggacaaaaagagcatgttccgttacatctgttaacagtttcaatttctatattgttaaataatggattaggagttgttttcataaaattatcaattaaattatagatgttctgaaatatttcttcatctttttgtttggtttttaaattataatctgtttcttcagtattttcaacttttgaaacttttttatttgttgatggtttttttaatttatttattaattttttaatattgtttgaaaacataatctttaaccccttttgtttaatgcttttgtttttgaggtatttttattttttgtggaatgtcgatttattaaaaactttaaatattatgtataataaaatactgttcatgaataactcattctttggacgatttaaaaaaaatgataatcaggttattgaagaacaacctccagtttgggaggataggattttttgggtagaaaccttgcaaaagattgcatttccagtattaaacaatcttaaaaaggagtctcttaagaaaaacatgtctattgaatcatttagctctgaaagcaataaatttgctcatcttggggcattttcaaatgtttttaatggaattgcgccgtggttagaattgggacctgatgaatctgaagaaggtaaaattcgtgaaaagtatattgtattaactttaaaagctattagtaatgcagtaaatccaaatagtaaagattatattctttttacagagcctaaacaatctttaatgagcatggctttatttgctcaaggtttacttaggtccaaaactcaaatatggaataatttaccaatggatgttcaagctagagttatttacgaacttaaaaatacaaggataattgcaccatttgaaaatcactggctgctatttacttccatgattgaagctactcttttagaatttactggtgaatgtgatagggaacgtttaacttatagtattcgtaaatttagagatgaatggtatcttggagatgcaatttatgcagacggtcctgaatttgatgtaaattactataacagtatttttattcatcctatgcttaatgatattttaaaagtaatgagaaaatatggtattaacgaaggagagttattggatgttcaattaatgagatccagcagatatgcatctcaattagaacgtataatttctccagaaggtacataccctcttttaggaaaatcaatggcttatcgtacaggaattttccatttattagctcaagcagcattatttaaaatattgccaagaaatatggaaacatcacaggttaggtcagctttaactaaagtgttaagaactcaatttggaggccatcaaaactttgataataagggatggttaactattggattaaatggctgccaagctgaaattgctgaaaaggatatcaatacaggcagtctttatggatgttgtgcaatatttttacctttaggtttatctttcaatgattcattttgggtaggtccttttgaagaatggactactttaaaagcttggaatggtaatccagtagaacctgatcaatcaattgatttctaatttttctttttttctctttttattgtttttaaagactaaataaatttccataattgtaaagcttaatgtcttcaggtacttcttttattatatttttagtgtcgaatataattgctttttccatgttttctttgattaaatcgtaatcaaggtctttaaactcatcatggtcacataatattaaaataaggtttgcatctttggtagcctgctttaaatcaacatattcttcattggctacatggggatcacagatgcttatttcatagttgtcttcttttaatttagctattatctcatatgccggactttccctgtcatcaccagtgtttcctttatatgcaactcctaaaactgctattttgccatttggtgttatttttttaacattttcatatacaaattcgggcattgagttgttggtgtctctggctagttttattatttttgcatattccggtgcttttgaataaatgaaataagggtcaatagctaggcagtgtcctccaactccaggtcctggtgagtgcaggtttactcttggatgtttatttgccatttcaattacatccaatgcatttactcctattttagtacatatttttgtaagttcattagctagtgcaatgttaacgtctctaaaagtattttccatacatttggataattctgcagtttttgcttctgttttcattaatgcaccttcaacaaactgaccataaacttcactggctttaattgagcattcaggggttattccacctacaatacgatcattatgtactaattcatacatgatttttcctggaaggactctctcagggcaatgggcaaggtataagtcttttcctattgtgtaaccggctttttcaaaaataggtttaacataatcatccatagacattggagctattgtagattcaacaattacagtatttcctttttccaaataaggaagtatggattcacatgcactgataacataacttaaatcacatgtgtaattttcagcaatgtatggtgttggcacagttattataaatgcatcagcttttacaggtgttgttgaagcagaatatacgcctttttcaacagcttttttaattatttcaccaattccaggttcttcaatatgaatttttccctgatttaaagtttcaacaaccttttcattaacatctactccaacaacttcacagtgattttttgtaaaaagtgcagctgttggcaatccgatgtagccttgtccaataatacaaattttcataaataaaaagccccttttatttttcaaataattaaatatattatgtttattaatataaataatatttagtttttattaaataaaaatagggataattatgaaagttttaattacaggatctaatgggatgttaggtcatgatttgacagatgttttaaatgacaaacatgaacttatacttacaacatctaaaacattggacattactgataaagagcatacagttgaatttataaaagaaaataaacctgatatagttataaattctgcagcatacaccaatgttgacggatgtgaagaaaaccagaaactggctttcagtgtaaatggggaaggtgtaaggaatttggctattggatgcagggaagctgactgtccattagtccatatcagtacagattatgttttcaatggcaaaaatgacactccatgggttgaagatgatgaaattggtcctataagtgtttatggaaaaagtaaacttgaaggtgaagaggctattcaggaaatactcgataaattttttattgttcgtacagcatggttatatggaattaatggaggcaatttcccaaaaacaatgctggaactggctaaaacacatgatgaattaacagtagtttatgatgaagtaggaactccgacatacactctggatttagcagaagccattggaaaattaatagaaactgattattatggtatttatcatattacaaactccggaagctgttcatggtgtgaatttgcaaaatatatctttgaagtagcagaagtggatgtaaaagtcactccggtaacagctagtgaatttgcaagacctgcaccaagacctagctattcagttttaaataataaaagatgggtcgataatggttttgaacctttaagaagctataaagaagctattaaagattatctgttttgtttaaaaaaataaaagagaattagttaattctcttattctatttttattgtgtttcctgtttggaagtcgttccagtaggaagttatgatgtattcaccggccatcagtctgattcctaatttggcaataccgttattgtctgtgagtttgtggtaaaatactccgtttacattaaatgatacgttttggttagctattggtttgccttgaccgtctaatgtttgtgcagtgaagctgcttccgtccaggtatttcatgtttaagtttttagtaattaatgtcggcaatacattgactttgtttcctatacttaatccgtcaaccattgtggttattatgtattctccaggtcttaaagagattcccatgcttgcaataccgttttcatctgtttttttgtggtagaatacaccgttgatgttaaaggttacttccttgtttgcagctaatgatccgtctttgttgtagattgttgtctggaatctggaagcattcaaatagtatttagttaaatcattttgaacaatcagtgattttacagtaatattattacctgactgctcaccagtaacaaggttaattgctgttataacatatttgccgggatttaagttaatacccatcatagctattcctttatcattggtggttttagtgtaaaagacaccattgatattaaactgaatatctttgtttttaagaggatttccctgtgaatcagtaaatatagcataatactgagtattgtttctaaacattttaacaacgtccaatcctttaactgtcggttcaatagtaactttcgcctgcctggttatcggagtatagtttaataatcctttaaagttaacagttactgtgtatattccactgtccaagctcaatcctaaacttacaacacctttttcatctgttgttttagtataggtttttccgttaattgttatttcaattgcagcatctcttataggatttccctgtttatcagttaaagtagctatgaatcttgtgccgtcatgataagtcattttaacatcaggagcatttaaaataacattatattcaacagatttgatttcaaaagttccgttgtcagtagctcgagaaattttatcagttcctttatatgttgcagaatatgtgtatttgccctctggaagtttatcaaagcttctaaaaccaacaccatcagttattactattttatagaactctttattaagctctaaagttacattacctgtaattggtcttccatcttctgttttaagagttgcactaaatattatttcattttcacctatttcaacattaactttcaatatacttcttgtttgattgattacaagtattttagttgtattggaacttaaataattattatctccattataatatgcatttatggtgtatgatccacttgttaatggtgaaattaaccatgatgcattaccgttgctgatggttttatttcttggtgaatataatcctaaaattctaaatgtaacattacctgtagcatcatcatttactactgcatatattctaatattttggccttctatgatttctgaagttataatgtttatatttgaaggtgctttagctattttaaattctttggtgtcagaggagccttggtaaatattgtttccgttgtaggttgctttaacagttttatttcctgcattgactttattgaatgtaactttggctactccgtttactatttcaacagtttttgagtcatggtcaatagtaaaagtaacgtttccatttgcaccgcttgtaatgttggctgttatagtaatggattctccatagatgctgtctttaattgtattgattgtaatggtggataatgagtttttaatattgaattcaacttcttttgtgttattggtatagttggaatctcctgagtaaattacttttaatgtatgttttcctaaggttaaattagctatttcaacacttgcagttccatttttcaatgttttattgtaagttttaccatctataacaaataatatagttcctgttgcattggcaggtaatttaacagtaattacttcagtttctccggctaaaatgtctttaatgtcaatatttaaatctgctggttttacaataattttgtttttggctgtaattccattgaatgttgctttaaggatatattctcctgcttttaaatttaaattaagataacctaaacctttagaatttgtcattactgtgtaatttttgttatctatgtttatttcaacttttgtataggtgtaaggatttccttgtttgtctgttaaattaaagtgatatattgagttatcctgctctttgattgttaaattttcaccagttaatataaaatcaatgcttgttatgtttattgtggtattccagcttgcagattcaaactgtttatctccaaggtataaaacataaatgtaattgcttccttttgtgaaattaacattaaatacagctgttccgtttgtgagagttaatttatagaattctttattgatataaactccaacttcgccggtacaggtgttgggattagtttttacattgatgattccggttaaatcattgttatatgtaatatttacagttagattgcatgaatcttttagaactttaaatgttgttgttgcagttgatggggcgtatttggagtctccgggataataaacagttacattataacttccgctagttaaattgtgtagtgtgatgtttgttacttctgattttaaaaatattgtagtatttatgccatttacacagagtatagcttctccgcgaagattgcttggatttacagttattgtagctgttgcatcttctccagctttaacatcatctacatttattgttaaattagtgttaaatttacttactttaaaaattgtacttgcattgctgctttcatagtattttgaatcccataaaactactgtaaggttatattctccaacagcaaagtttttaagtggaattgtagtttttccggcataaatataaattatttgtttaagttctccattgatgtacaggtaaccttgtgtttgggaacctttaggttcaagatttataattagttctccgttttgcccgattttaacttcaggtgcagtaatatttaatgtagttggatgtttatttacagtataattgcagtaatagaagactttagcataatctgagtcaccttcgtaaattattttaatagtgtaatttccaggtgttaaatcagaaacttttaaattagttgacccatttactaggtttatggaatattttttatcgttaataatgactgttacatttccagttgggatgtgtgtgtagtttccgtttactttaattttaaatattgcatcttcaccgtagataatgttgttattgaaatccacatctattttagaatcttcttttccaacatcaaggattatttcttctgtgtgtcctcctaaattagtataaactttgtattggcctttttgagaggtgtaattatagtctaatgaggcggttccatttattaaaggtttagttatatttacttcttttccatcaattatagttgtaaatgtaacattcatttcaggaagtaagttataatctgtaaatagttttccattagctagttttaaatctactttaagttgaatagtatctccaatttgtaaagatccatattctggtttaaatgtgaatataaaataattatctatttcagagtttgaatcttttggataaggattatcatttgtacaaaaatagttgtaatccatatttatagtgccttcattaaataggaatgcatatggatcttttggtattatgtagggggcgggactggttgcttgtaggtgttttgtattaataaacatgttataaaatgcatttatagtacctttattatagatattaaatgcacctgtaagataataaaaattattatctccataactattattgttaaatatagttctgttaattgtgagagtacctaaattttcaattgacccataataaactttggtattataaccgttttttgagtaaattttgttatttttaattattgaattaattattattcctgttcctgattcatcattatatattgaattatatccatttatattagatattattgtattatttaaatgcatgtttccagaattttgtatggcatttccattatatgtggatttagttttatttatcaaggaattccataggtaaatgttcccagtattatatattgcacctccatggtatcctgctgataaacttatagaagtattacttatatttaaatttccttcactatatattgcaccgccattacttgaagatttggaattagagatggtggtggtggttataattaattgacctgtgttgtatattgttcctccagttccagatgttgaatttatgtggttaaatgttgaattttcaattgttccaaaacctatattgtatattgcacctccagttttgctttttacattattaaatgagctagatttaatttgaaaagttccagtattatatattgcaccaccattacttccaaaccatcctgttgttccaaaaaagtctgtaggagctggtttaatgcctatataatctatattgttaataatgtctgtaatgtttttaaaacttgagttttcaattgttaataaattagaattgtatattattgatccatttatagttttaatagctttttctcgatatgtttgatatatgtaattatttgataattcttgataagtatcattgataattatattaatatgaattttagttttattttcaaaagaagaattaacaataatcagtcttccattattcttaataactctattttcaatgttggtaaattttgaattgttgatggttaaatttgcattttctgcgttgtagattatgctgtcccatgttatgttatttttatttgttattatttggttttgaagggaaatctgcttaaaagtacaattttctatttttaaaagtcccttgttgtagattaaagagttatttaaattgctttttaaattagttattttagggtgttgataaattgaatctgtggtaaatgttatgttaagtaattctaaaattcctgtattgttaatagctcttccgagaatgtttttaaatgtgcaatttattaaattaacttttccttcagtatttatactgtaacttgtggtatttgtaattgtcaaatttacaaaagtcacttttgcattatttgttatattaaagaggctttctttttcaaatccattaaatgtaacattatttccaattattgtaacggatttatttattaaaatattttcattttggtcatgaattatatttaaattagataaatagattgttccttcattttcaactaaatctaatgcttttttaatggagtttatggaatttgtccaattattattggatttaattttattatcaataattatattgttatttgttaggtttgttagttgtattttgtttaatttttcaaaaacaattgtattagaaaatattccaaaaatatagacttgtaatctacttttatcttgtacatggtacggaaaacttatgtcaaatgtgtaatttccaggggttgtaaagtgttggtatggtggtaaatttaattcgtttagggttttctggcttattattgtgttattctcataaattattaaataagttttgttaaattctttttctcccatggtgaactttccagttacatgaatatttacagttatatttccagttttattaaactcacttgtgtcattaacggttattgtattttcaatacttggatattttgaaccaatatatacattttctccaactttgtttgtgttgtcaatggatgtatatttttggttataatcttttattttaacaatatctgcactattttgatttgattcatcagtatctattgtactgtcagcttcactaattccaatatcttctgtgttagaatggtttaaagtgacagttgaattatcctcagcattaacattgcttaatgctataaaaaataatcccagaatcaatattaaaattatttttctatttttcacataaatcttctccttattaattaatattaaattattaacaacttattatataaattttatttgattcgtaatcaatatttattgtttcataatctttttcatgttttattcatttttttttaaaatcattaaacaaattttaaatataatgtaattttgggtagtttatagctatatttatatattatgtttgtagatattcaattagttaatgtatatttaataattatccagttaaattatatttatatttatattttttgaatcattgatggaaattgttgatatgtggataagttattgatttacttaactagttcatttaattgggggatttattattaaatcaaactataaatatatattaatcgcctttttggtgttgatttgtagtattggtgcagttaatgcaactgatttagatgataattctactgttgaagtttcttctgatgtagatgatagtatttcagttgatgaggtaccaattactgatgatgttgaacaaagtcaggatgtggctagtacaaatgctgctacttgggatgagttaaaaacagcttgtcaaagtagtggtgataaagttattacattaactggtcaatcttataatgcaaatagtcaaattgtttttggaaatagtgctactatagttggtagttctgatagttatatcacattatcaaatgggaatcttattcctttcttaaattctaattctgaactttccattacttttcttaatgtaaattttaaagacagtaattgtgatatgttagttcaattatgtggtaatagtaaactagaaaattgtacatttgacaatattactgtaggatctaaccataaatctgtgctttataatacttatggaagtatggaggttattggttgtaattttactgattgtacaagttcttttggtgttataacaaattataatccaagttctacaacaaatgttcttatgaatgttgaaaattgtaattttataaacaatgttgctacttatgctccaggtgcaattaataattgtggtattttgaatgtattaaattctaattttgtaagtaattctgctagatattgggcaggtgctattcatactcattgtaatgcatatactagaattttaaattctgagtttaagagtaatactgcaggatggaatggtggagctttatactcttacagtaaattagaagtgtataattctacttttacagataataattgtactactaataatggtggaggagcaataggtgcatttaattatatctccacatataatgttacagttgaaaattgtatatttaaagataacaataatttatgcggtgattttactaatgaatctacaacttctttaggtcgtggaggagcaatttctgtattaaatggtggatatttaaatgttcatgattctacttttgtacataatggggcagtaattggtcaagctatttgtgcatataatacaaattatgataattctactggaggaactccaaatttacaaatttataataatgaatttataaatcatacaattaccacaaacgatactgtatttatttcagagggtaattatacatttagaaacaatacctttactaacagtcctcaaactattggtacagatagcaatataattgaaagcaataatgttaatttattaaaatctcttaaaattagatctattgttttcaatcaaccaatttctgattttaatactgttactcaaaatcaatgggcaatgagtggatatgataatcataattctgctaatgttccatatattggtgttactacaaatccaaatatttggaaaaaggatgttggtggagttgtatctggtttagtaattgatgaagacggtactttttatttgattgcagggtctaatgtcactgcttttgattctactggttttttaaaatggagtaaaaatttaggtcaagttacaatgcctggattagcattagataatcgtggaaatataataatacctgttaaagataatcgtcttgtaatattaaataaaactactggtgcagatttgggcggaaatattttccaagcatctagtgcatatgctcctatgttggatgatgatggaaatatttatgttgtaggtcaatatgaatatgataatggttatgtgcctattgttaaatattataacagcacatcttataatcctaatggtggttatgattatgtatataaaagtttattcaatacagcagttagtactattccagttttagataataatggagttttatgggcagtaagtggtactaatttagttgctgttgatgttaaaactggaaatcaagttgctagttattctgattgttattctggtattcgtcctattgtaggggaaaatggtattgtatattttgttaaaagtgatagaaaagcagtatatgcagtatctgtaaatggttatttatggaatacatcattacctacttatcagctttttggtacaaaatatgaacaggctactgcattaggtattgataatgaaaaaaatattttatatgttggaacatctagggcaattaacaaaatagatatgacaactggtattctaactgtattccgctcaggttttgacatggttaatagtataattattgatggtaatggtacattatatactacaaagactaaccaaggttcattgtgggcattttattcaaatggtacacaagcatggagtaaaaatatgggaggctctttaaaactacttgcaatggataaaaatggtaatatttatacaagttataataattacttatgtgttttatatgctcaaggagtagaccctaacatgacaattgatgctaaaaatatcttggcaaatgaaaacacagatattgtagtaaaattattggacggagtatatggaaatgttgtatttacaataggtaaggatacatatacagtagctattgaaaatggttctgctaagttaaatattggaaatttaagtgttggaagttataatgtgactgcaagttttgcaggtaatattaaatatgcagctagtgaaaataatgcttcttttatagtatctaaagtacctacaaatatgaatattgccgtagataatattaatgttggagaagatgcagttattaacataactcttcctaatgaaatttctaatgaattggttagtgtaactattgacggtaaatcctatactgtacttatcaataatggtaaaggatctttaattttatctaatttagtagctaattcttatccaattacagctaaatatgatggaaattacaaatatactgaaggtgaaaacagtactactttaactgtggctaaaatgtcttcagctgtaaatgtcacagctaataatatcaaatttggtgaggaagctgttattaacattgctgttcctaatgtatctttaggtgtagctactgttgttgttaatggtaagtcttataatgtggctattgttgatgaaaaaggtgtcttaaatatttataacttagctgctggtgattataatgttgatgtaacttacttaggtgataataaatacctttcaagtacaaatgctgctaatttcactgtttccaaagtgtctgattataatatgactgttgatattgcagatattgttaaaggtgaaaatgctacaataactgttagtgttcctgaagacggaaccggaagtgtaattgtaacaataaacggaacagattacaaaggaacagttattaaaggcattgctaaagttattatcccagatttagatgaaggaacctacaaagttgtaacattctacactggagacaacaaatacgattccatgattgttaacggaactataacagttaataaaaacacaataactacattaataatgaatgatgttgtcaaatacttcagaggttctcaaaaactcacagctaaacttgttgatgcaattggaaatccaatagctaatgcaactgtttacttcacaataaatggcagggtttatgctaaaatcactgatgaaaacggtatggcttcaatgggtatcggattagttcctaatgaatacaaagtaagtgcagtatttaacggaacaaaagaccatgacaaatcaacagctaatgcaacagtaactgttaaaagcacaattttaggaaatgacactacattatacttccttaatggaacaaaatatgtggctaaattcttagacagtgatggaaaagcattaacaaatactactgttaaatttaacattaatggtgtgttctacactcgcgtaactgatgaaaacggtatggctagtttaaatattagactaaaccctaaattatatatcataactgcttacaatccagtaactggtgaacaaagagctaatgaagtaactgttttaccaagaatcattgctgaggatctctccatgaagtatcttgacggcagttcatttaacgcaacacttgttgacggtcaaggtaaagcagtagcaggtgtaaacataacatttaatgtaaacggtgtattctatcataaaacaaccgatgcaaacggtgtagctagattaaacatcagattaatgcctggcgattacatcataacatcaacatatgacaaatgctgggcatcaaataaaataacaatttcagcttaagaagttaaaattcaacttcttatctttttcttttttaacccatctatattaaataaaaaaactgctttttttaatttactttaataatttcacagtatcaattaaaatacttaaagaaaaattattcttttgtctgttatttagctataattttaattattcggtaatgaaaattatttgaagaaattgtctgataggtattttaattaattagaaaaaatatatttttaaacattataaaatttattaaaagggatatttatgaaaggaattgtacttgcgggtggatctggaacccgtctttatccaattacaaaagcaatatctaagcagctagtacctttatatgataaaccaatgatttattatcctatttctgtattaatgcttgctggaattaaagatattttaataatttctactcctagagacttgccaatgtttaaagagcttttaggtgatggcagtagcttaggaattaattttagctatgaagttcaagaaaaacctaacggtcttgcagaagcatttattgttggggaagactttatcggggatgatgatgttgctttaattttaggagacaacattttccacggtcatagattcactgaaatattggaaagagctaccaaattggaagagggagcagtaatattcggatattatacaaataatcctgaagcttttggtgtagttgagtttgacgatgaatggaatgtactttcagttgaagaaaaacctgaaaaacccaaatccaattatgtagtgcctggactttatttctatgacaatgatgtagttgaaatagccaagaatgtaaaaccttctgaaaggggtgaacttgaaatcacttctgtcaatgaagaatatcttaaccgtggcaaacttaaagttgagcttcttggaaggggaatggcatggttggatactggaactcatacaggtcttttggaagcatctaattttattgaaacaattcaaaaaagacagggactctatattgcatgtcttgaggaaatagcttataataaaggttatattactaaagaagagcttttaaaaacagctgaagaacttaaaaaaacagattatggacaatatttatttaatttagttaaggatgattaatatgggaaattttaaatttacaaaaactgatattgaaggaatgtttgtagttgaacctgcagtctatggggacaatagaggatatttcatggaaacatataatgaaaacgatttcaagaaggcaggttatgatttaacttttgtacaggataatcagtcacagtcatttaaaggagtgcttagagggcttcacttacagttaaaatatcctcagggaaaattagttagagttattaagggggaagtatttgatgttggggtggatcttagagcagattccccaacttatggtaaatggcatggggaaatcctttcagctgaaaataaaaaacagttatacatacctcctaaatttgctcatggttttgtcgtattgtctgatgaagctgaatttgtatacaaatgcacagaattttaccatggtgaagatgaagggggaatcatgtggaatgacccagatatagctgttgaatggccattagaaggaattgatgaaatcactctgtctgataaggataaaaaatggaaaagcttaaaggaatcacagattaagtattaggggcattatcatgacaaaaatattaattactggcggagcagggtttattggaagtaactttgtaaaatatatggttgataagtatcctgattatgaatttactaatttggatgcattaacatactgcggtaaccttgaaaacttaaaggacattgaagataaggacaattacacttttgttaaaggagatattggggataaggaagttgtcaataatttagttaaagattccgattatgttattaattttgcagctgaaagtcatgtggacagaagtataagcgatccggaaatatttatcaaatcaaatgttttaggaactcaggtactgcttaatgcagctaaggaatatggtgtggaaaaatatgtgcaaatctctactgatgaggtttacggaacattgggagaaacaggatattttacagaaaccactcctttacaacctaacagtccttattctgcttcaaaagctagtgcagatttagttgtaagggcatactatgaaacatttaacttgccagtcaatataacacgctgttccaataattacggtccttatcagtttccggaaaaactgattcctttaatgatttcaaatgctcttgaagataaaaaattgccgatttatggtgacggtaaaaacatacgtgactggttacatgtatatgaccactgtacagcaatagatttggttttacatgatggaaaacttggtgaagtttataatattggtggacataacgaaagacaaaatatccaaattgtaaaattgatactggaagctttaggtaaggacgaatccttgattgaatttgtagatgacaggttaggtcatgacaggcgttatgccattgattcaactaaaattagggaaaatcttggctgggaaccaaaatacacttttgaaacaggtattaaagaaaccattcaatggtatttggataatcaggactggatggatcaggttaaaagtggagagtatcaggaatactataaaaaaatgtacttaaataaggtgtaattttgcctcaaatttcagtagttgtaccggtttataatgtggaaaaatatcttagggagtgtttggatagcttagctaatcagacatttgaagattttgaagtaatctgtgtaaatgacggatctgacgattcttcacctgatattttagaggaatatgcatctgaagatgaaagatttaaaatagtttctcaggaaaataaaggattaagcggtgcaagaaatactggaatgaattatattaaaggcagatatctgctatttttagattctgatgactggttagagttaaatgctcttgaattattatataatcatgcaaatgctttgaactctgaaatggtgatttttccatacagatattttaatcaggaaactaagcaatatgaggaaaatgactttacaaaattaaacatgtttgattcatcagttgataataagaattttaactataaaaacatccctgaaactgtatttagaattcctcatgaatctattaaattatatgatgtcaaaacactaaagaaacttgctgttaaatttccggaaggacttaattatgaagatgcctatttcttttacaaaatcttttttaaattaaataaagtttcaattatcagaactccaatttataattacagaataagaaatgattcaatctgcacaacaggcactgaaaaatcctttgatatatttaagattttaacttccataaaaaatttcttaaaagaagatgaaatctatgaaagttttaaggatgaatttattttatttacagttattaatctcaaattcgtttatttaagattggatgaacgatttagagacagatatcttgaaaaaataaagaaaaattatgaatttttttccctaaatcaggttaacaagaatcatttagctacctggcattttgatgacagggcattttatcaggcaatagatgtttcaaacaatggaatcgagttcgaattaaattataagaaattgtactatgaatttttagctaatcattatgaaggtgtaatagaacagttgtgtcatgaaaatcaagttttagcacaagaaaacaatgatttaaaagaacagtcagctgatacttctattaaaagtaaatttaagaaaatcgtgaaattatgagttataaattaagtgtcattattcctgttttcaatgctgaggattatattaaagaatgtttggattctgttgttgaccaaagcttaggaatagacaatattgaagttataatagtcaatgataattcctgtgacagtacgttagatataatcagccaatatgctgataaatatccctcttttaaattaatttcaaataaaagtaatctgggccccggtgaaagcagaaatatggctcttaaggaagttagctcagattatgtaacttacttggatgcagatgattttatatcacaaaatgcatatgaagatgcattatctaaaataaatgaatttaatgcagatttattgatttataattgggaaacatacactggaagcgattatgttgaaccaataaatatccaccagcaaaacactttggaaaataaattaataactgatattaagcagaatcctaagctatttttatcaacagctccatggaataagatttatcatagaagcttatttaaatatctgaaattctccaaaggtttttatgaagacaatattgtagctattttagctttaatcaatgctaaaaggatatttttatcaaaagattctatttattactatagaaagaattccgattcaactactgaaaacattacagttgatagttctattcatctttcaaattcaataaaagaaatatttgatttaagatatgaatatccggagtttttaaattatcttaaattgcttaacattaattttatttatgatattctattttggatttattattacaactggacactggctgatgagcttaaaataattaataaacttaaatcagttattattccacttaaaaaagaagacattgacagatttaaacaacttttcccagataaacttagctatggagaggatattttagatttgaacaattatgatgctgaaacatttttagccaaatataaatattttaacagattaaataaagtaaattcacaggctagcttatatgttgatgcaggaaatggatttaatgaatcagataaagtagctattgactattcacctttaaaaaagaataatcttgaattcagcctggaaaaatttgataatatatctaagctgcgttttgaccctttggaaggcagttttgttaagtgtaggataactaataatttaccgataagtgatgcaaattgtgataactcagttgatgatgactgtcagatatttactaatttggatccatattatgttttggatgctgattttagtgatatttcaagtattcaaattaattttgatttggaaatcttaactaatgatgatattgctaatttatttagacaaaaggacaatattataaatgatttgcaagtaaaacctaaaaaaaggaaatttagctttttcaataaaaaggagtaattttcaatgtctgatatttcatattcaaaatttttaattaaatctaaattcaatccaaaaaaagcaaaaaaatacatggaaagctatgataagataatggaatcaggattatttgataaaaattattatcttaaagcgtatccgcacattgctaaatctggaatggatcctttggttcattatttattttatggatataaggaagataaaaatccttctgctcagtttaatttaaaaagatatttggaagaatatccggaaattaaaaaaatgggattaaatcctttagttcactatattgacaatgatcatgaaggttttactttggaagaaaatccttttgtggcacgcagaaagaaaatattggataccaactctttatttttagctgattatagctttgatagcgaacctttagtttcaattataattttaaacagaaacggtttaggacatttgcaaagattatttgcagattttgataagaaaacaaattattcaaactatgaaattattgtagttgataatgcgtcctgtgataagtctgttgagtatttgcactctttggatttgccaattagagttattgaaaacagtgaaaatgtcagcttttcaaaaggaaacaatgatgcagctaaaatagctaatggggagtatttgattttattgaataatgatattgaaccgacatacggatggcttaatgaaatggttggaaccgtcttaaataatgaaaatgtaggttctgttggagccaaattaatatttccttactatgaagatatggaaagccagggaaaatcattttcaattcagcatgcaggagtaaaatttagagaagaaagaacaccttatatttatgggccatatcatgagcatatgtatttaacaatgcttttttcagatgagttaaatcatcaaaaagaagtgatttcaaatactgccgcatgtttattggttccaaaagaagtttattttgaattggacgggctggatgaacagtatatttatggatatgaagacattgactttgcatttaagttatacaaggcaggatataaaacaatctacaatcctgcagtgttactcttccatcatgaatcagcaacaagacatgaagatgatgacaggaaaaatcagctgaattatcacaatataatgcactttgctgataagtggggagacttcatttttaaggaaattttaaaggataaaattgaggcaaataactttttcacaaataaaaaactggatttcacgattgtaggtaaaaataatgatttagtaaaaaaagcagtttttaaattaaacagtgagggttataatgttaaacttgttcccaatattggtgatttggacatcggccaggactgtgatattttaatatcaactgaaaaggaatatgatattaaaaatgtaagctcaagacttaatttaataaaaattttaatatctgatgaagataatgatggttatgacatggttttaagtgaaaatgactttgaatttaatcttttagataaaattaaagaaaaatatttgtgatactatgagttatgaggaaatttatgaaacatatcaggaagttgcaaaggagcatatcaacagggatttatttaatcattcctcagaagatgcggctgaaacaattgaagatattaaaaataataaaatagctatttatacagctttcacaggtgattatgatactctaaaagaacctgaagtaattgatgaaaactgtgattacatatgttttacagataaccctaatttggagtctgacacttggaaaattattcaaatggaagaaactaccttagacaataataggaaagccaaacaatataaattacttcctcataaatatttaaaagattacaaatacagtttttggctggatgggacatttagaataaaaggaagcatcagggaatatatctacaaaaacatcagggcttcctctccaatgctttgtgtagttcacacagaaagggactgtgtttacgaggaatacgaagcttctaaaataattccaagatatcctcgtgctgtaatggaagaacagattaattattataaaagtcaggggttcccggaaaaatacggattgggagtaatgggagctattttcagaaaacacaatgattccttagttattaaagtcatggaagattggtggaatgaaaatatcaggtttacaaatcaggaccagcttagttttgcatatgtatgttggaaaaatgatttccatccgtcagttagtttaatttattactgggacaatgaatactgggccaaagacaagggcaattaccaccataaggtagtgttttcaatgcctataaccagtgataacctgagagctaaaataggaactcaggtagaaaatatggacattggggatacaatcgagctttcaaaagaagaaatgtatcttttaattaatgatgtaaaaggaatggcaggttatagaatagatactgcaggcagagtgggatacctgcaaaatgaatataatacctttttaaattccaattcattaaagcttacaaaaccgttaagagtagctggagatgtagctagaaaagttaagaataaccatttcttaaaattcgccaaacataaaaatgcagaagaaaacattaatatttatgatactataaaacattttggcatttttgacgaggcagaatacaaaaaattgcatggggaggttggagatgctgttttacattttatagaagaaggttcaaaaacagacagcattgatgataaattaaaatatatcaattcaatatttgatttatattattatatcagctcaaacaatctttcagctgatgaagaccctcttattcattatataactaaaggttttgataaaaaattagctattaatagaaattatcctcattttgtcgagtatttgcatggaaatttacatgagcagttagatgcttttgtcactaaaagaataaaagaaaaactggctgatgagagttatatttcagattcaaaaattttaattgattatattcatacaaatcatgaatttaaaacagatacaattaaagtgggagtatttttagaggataattttgataatatgaatgcatgtccatttataaggattcattcattgtttaaagagttaagcaaaagcggagactatcatttctttgtttatggtcaggaaattctacctttaattgatgtgaatcaaataatcaaatcaaaaatctttgatgtaattgtaattcaaagagtaaatccgttttccactaaactagctaaaaaagctaaacagcatggaattaaattggtttatgaaactgatgatgactttttggatatgaattcgtccaatccctcatttaactatattcagggtaatttggcaaatattaaaaagctggtttctgcagctgatgaaatagttgtaagtacttcagagcttaaaagacgtttcgataacctgaatttgtccagcaatgtaacaatcattagaaattactacttggataatgtattgccattaaaagaattttcatatagtggcaatcagtatgtaaaaataggttactttggaacaatgactcataataatgatttggagcttattcataatgttatattaagattaaaagatattttctctaaaaaaggtattcaggttgatttggaagtcattggagcatctattgatgaaaatgtagactggttcaatgttaaaaaaatgccgtattatccaatgtcaatggctacatttatgaagtggatatctgtcagggcgaactgggatattggaataattccattagttaacacagaattcaataaatgcaaaagtgagttaaaatacattgaatttacagctcttggagttccgatagtagctagtgatgttgatgcatataaaggtactgttgaagaaggagtaactggatttttagccaatagtgaagatgagtgggtaaataaattatctatgttgattgaaaatccgaaacttagacatggaatattaaacaatgcacgtgatgatattttgaaaaactatgatttaagatcccgtgcaaaacagtgggatgaaatttttaagagggtgtcctgataaaaaagttttttattaatggaaaattgatattatttcgtaaattgttttaatttcttaaataaaagttatatactaataaaatttataatggaggtaataaatttaatgtacttgttaaagatagggatacatataagtttactactgcaggtgcattattttttacagagaatcctaataaatttgatggaatagatgtaggggttaagcttgctcgttttgatggaactgataaaacgatattcattgataaagctactttgaatggttctttattaaaaatattaaatgaaattgaatctttttttaaaagaaacactagatatgctacaaaaattatcggttttgaaaggtatgatataccggaatatccatacgatgctgtaagagaagcaattattaatgcaattgctcatagggattatgaaattaagggaactgatgtaacattttttatttatgatgatagaattgaaattattagtccggggaatttaaagtttccattaaccttgaataatctagaggatggtaattctgttaggagaaatgaaataatctgtaatttgtttcatcatacaaagtatatggagcaatatggaactggaattgaaagaattaagacaaaaatgattgaacatggcctgcctgcacctaaatttgaattgaatggaaatttttttaaagtaatattatatgggcctggagaaaatattcttaaattacaagattcagttcatgctaataaaatagatcttaaaaaatatgatttaaatgatagacaatataaacttttagaaatactttctcaaaataatgaaaatattacaaataaagaatatagagaattatttgaagtatcaagatccacagcagcaagagatttaagaagattggttgaattaaatttgattcaaaaatatgagatcagtggcaaagaagttatttattcaattaaataattcttaggaatgatatgttgattaaagtaaaatgtttgtttattatttttaagtttctttaagtatctgtaacatgatacactcatgacacacttaaatattttttttaagttttattatatttgaatggagcttttattattgtgtgttgtgttgtgttttttattatttttttgaagttttctttcagtatttgtgtgtgtcctatgcatgacacacttaaatattttttttaagttttattatatttgaatggagcttttattattgtgtgttgtgttgtgttttttattatttttttgaagttttcttttagtatttcactttgatgaatcatgacacactaaaattcaaatcttttttttcaatctctgttttatatttttagttttatacttaaaccagccttttgtagtttgcagattagctatctgctgggttttatgagccaattcaacttccagctgatggattctatttctaaatagctgataatcacccatgagactgtaggcttcatccagatttctggctcttatctgggttattatacttttaattgcattattttcaggagtcggattaacatcacccatttcgtcaaataatttaagtgacttatttaccagctcctttttatcttcaaagtcaattgtttcacttagagccacatcactaatccagcagcttaaatgctggttaaaaatagtgtcgtaatatttgcatgcattgtttttcttaagtacatctactgtattattatatccttcaattaatccatctaaataatgcattcctttagataaacttgttgagctgttatcaccagttcttaatctgaaattataaacaatatcatttataaagactatttttgaggcattcacaaaagcatcaatcataaaagttaaatcttcggcaaaaactccttccggaaaagttatttcatttttattaaggaaatcttttggaaatatcattctccatatattatttattgaaaaaaagcgtaaatcttcatcaattgaatttaaaacaacatcatgtgtaatccagtcttcaggaactattttttgctctccaaatgtttggaattttccgatagctacatcacatgaattttcagtaactgcattgtataacttttcaacactttcgggcaggtaattgtcgtcatgatcaataaacattatatattctgctgtagaattggctattcctatgtttctggctcttcctggtgttcctgtttttttacctgattcgaaggtttttatattttcatatttttcacaatagtggtttattaactcctgtgtgttgtcagtagagtaatcatcaacaataatcagttctatattttcaaatccgatgctctggttcataattgaagctattgttgaatctaaaaattctacactattgtatgttggaataataacagtgactttataagacataaatttatttttatgttaaggtattatataatatattatgaatttgtctaaatcaattaaaagcaatcctttggcttacatagccatgaaatcaaaagccaatcctaaaaagatttcaatgtataaaaaaatttattcaaggattaaaaatttggaattaattgataaagacaaatatttggctattcatgatgactgcaaaactcaggatatggatgttaaccttcattatctctattatggagttaaagatgatttggctactcagcagtcatatatcacagatgtatttaaccttgaattttataaaaacagatatagtgttgaaaatcctgtttttgattatgttttagaaggattttttaaaaacaatcaaatcaatgtttttgacagtaggtatgtcaatacacttgaaactcctatcttcaatcagtattatgggggtcaaaatgataaactgctttcggaagttaaagataattgctatataactgataagcgaactttaattccatatattcagcttgaaaaacctatatattcagataaaattagaattggtgtttttacaaatgatccttttgaaaatttggccccatgtccatatatccgacttcatgccccatttaatcagctaagcaaatctgataaatacacctttttcatgtatggtatggatagctatgttatgatggatatagacaatattttaaggtctaagctatttgatattgttgttgtccaaagaattttgccgtttttggatttgttactggccagatgcaaaaagcatggtattaaagttgtttatgaaactgatgatgatttgttgggtgttgaaaaaaacagtccttcttttgaatatgttgacagtgtcagaagtcaaataactaatttcattgataatgcagatgcagtaactgttaccactcctaatttagcttccaaatttgattcagataagactatgataatacataattattatgtaaatactgtttttgatgttaaaaaagatattaaaagaggtggtaaattaaagttagggtattatggaacattaactcattctaaagatttgtttttaattaaagatgttattttaaagcttaaagaaaaatatgattttgattttgaggtaatcggaggctttaatgcagaggataatgtatgtgaagactggtatgatgctgttgagcttccttcaaataatatgtgttttgaggtatttatgccatggctttcaaaagtggctaattgggatgttgcattagttcctttggagaattcaaaatttaatttgggaaaaagtgaattaaaatatattgaattggcagtattggggattccaggcgtttatagtgatatgcctgtttataatggtgtggttaaagatggtatcaatggtttattagcgaaggatactgaagaatgggttttaaaaattgaaaaattgcttttggatttgtctttaagagaaaatattcgtaaaaacgctctggaggatgttttaaaaaattattctttagatgatgttgtaagtatgtgggatgaactattttcaaaattgatttaagtttatttaatattttataaactttacttgatttttcttaaaaattattataataaatgatttagctacttattttggacattatttccatagtataaagtgtttttatatagttctttgtttaatatatgttaaactgtatattgttgttgtatatttgcttgctaactgttttaaacaataaggttaatttagttttatgtaaaatttaattttatttagtttctattttcccacagtttcggatgttttagttgttgcagtatttatttaagtattaataattgttatagcatttattatttcaataatttaattaaaattcttaattaaattataataaaaagtataatattttatttcatttttaaagctttttcagtttcatatattatttttaaatatattaaaaaaattaattactatatttataccataattttatatacaattaattttaaagttgattagtgtggatttttttattattgaatgttattcataatgaaaaaatttacatatatggaatatggtgatttgaatgttagaagagtatataccttttataggtttattaattttcggtaatattgaaaacttagtattatcttcacaaggtgtggttgccggagcaaatattttaaaattaagtatttacagtattatttgtgttcttatttggcttattgtaggaactgtaggggctactgttgctgcacaatatgctagtttcattgattttgttggcggtcttgctatctttatattaggtcttcaagcaatgtatgaatccattgcaaataaatagttaataggggattaaaatatggcaaatgaatttaaacaatttatgggattattaatttttggtaatattgaaaatttaatattgtctgcacaaggtgcaacagcacatgttgacccattcatattaggtgggttaagtttaatttgtgtagtttgctggcttttaataggtacttttggtactaaattcgctattaaatatgctagacacattaactttattggcggccttgctatcttcattttaggtattcaatctatgattggagcaattccaggtatgttaaaatttttttaagcatttttaatttttagtttgaaaaagtttttaatcattaagtgtcttaaaaacttttttaagctattatctttttttagatatatttaattaatattaaaatgaaaattattatcagttattttaataaattgttttgctgatttttatgactgagaataatgttgacccttatgaagtagttaaaaagagatatgaatcaacagtagacagctttgttttaagtgatttattccaacctactttagaaagcaatcaggaattaattgatgatgttaaagataacagattagttatttacacagcgtttacaggaaattatgatgaattgaaagaacctgagtttattgatgaaaattgtgattatgtatgctttacagaaaatcctgatttggaatctgacacatgggaaatagttcaaatggaaaagtcaacattggatgataacagaaaagcaaaacaatacaggttatttacagataaatacttcccagagtataaatacagtttttggttagatggaacttttaaaatcgttggaagtatcagggagtacatttacaagtatgcaaaatctaaaatgcttgttgttgttcatccggaaagagactgtatttatgacgaggcagtaatgtcaatgccgtttccaagatattcaaattacaccatgaccaaacaggttgaaaagtaccgttctgaaggaatgcctgaacattacggtcttccagctactggtgcattatttagggcacataacgatcctgaaattatttcaatcatgaggcaatggtggagggaagttgtaaactacactaatcaggaccagttaagtctgccttatgtcatgtggaaaaataattttcacccgtcagtttcggatgtttattattgggttaatgaatactggtctaaagaaggaagttatcaacataattttgaaattgaagattatataactagcagaaatttaattgaatctttggagggtaatattaaagataaaaacactttaactaaagaggaaatcaatttgctattcaatgatattgatgcacttagggatgaagctaatgcattaaacatagctcgtgatcattgggatagacagattaggggagttagaaattcaacttcttggaaattaactagtaagttacgtaatatgcgaaataggggaaacaatgactaaacatttgattaatttcttgattaaatccaattttgattttagaaaagccatgaaaaattataaatattatggggctattgaagaatccgggctttttgatgaaaagttttactctaaaacttatgatgatgttaagggggacggtttaactcattatctggttaaaggatacttggaaggaaggcttccgagtctggattttgaccccgacttttataataataattatcctgatgttcacagggctcagttaaatcctttacttcattatattgctcatggaaaagatgaaggcaaaatatttcaatatgcatattctgttaggagaaaagaggaaatttgcgaaacaaattcagtattcttaactaattatgaatttgacacagaacctctggtttctattatcatactgacaagaaatggtttaggtcaccttaaaagattatttaaagattttgataagaaaaccaattattcaaattatgaaattattgttgtggataacgcctcagcagatgaatctgtcagctatttgaaaaatctggatttgccaattagaataattgaaaatgaggaaaatgtcagcttttcaaaaggaaacaatgatgcagccaaaatagccaacggggaatatatattacttttaaacaatgatattgaacctacttacggatggcttaatgaaatggtgggagctattgttaatgatgaggatgcagcgtctgtaggtgcgaaattggtttttccattttatgaaaacaacaggaaaaagtcatttagaattcagcatagtggtgacatctttgcagaaaggatgtatccttgctgtttatatgcaatcaataaaagtaatgaccatttagacatttttgactcttcacttacaaagaatgcccaatgtgttgcagttacaggagctgttgacctaattgataaaaaagtctatgatgagcttgggggtcttgacgaagattatatttacggccttgaagatgttgatttttcattaaaattacataaaaagggttataaaaccattttagcttccaatgctttacttttccatcatgaatcaagtacaagggttaaatccaaagattatgaagataatgataaacataattacaaagtattttggtctaaatggggaaattatctttctaaaaatatgcttttagataaaatacatgataacaaatttttcactcaaaagaaacttaaaattacaatagttgatgaaaattatcatgataattttgaatttttatctaaaatttccaaaggcttcaatgaattgggttttacagttgagctgatttcggatctggaaaacatgtatattggaaactcttcagatattttgctttgtctatctgaggattatgatttggaaaatatggtggccagggatgatattgtcagggtatttatttcacaaaacagtaaagataatcccaaaggttatgatattgtagtatctgatgaaaataagacttttgattccaaatataattttgcaattaaagataattttgttaaagaatttttggagaatttggaagatattttaataaaaagtgacggatttttatgagttttaagaataggttaatgagtaaaattccagctagctatattttacataaatcatccaataaaacagaggctaagttaattgttaaaggatataatgcgattcgtaaaaataacttgtttgatgatgaattttacttaaataaatatcctaaagttaaagcttcaggaatggatcctctccttcattatattttcttcggattcaatgagggaaaaaagccaaataaggattttgatggggtattttataaatatcactatgatgatgtggagattaatcctttaattcactatgcattatatggaattgatgaaaaccgccagattaaagtagccaatgaagatttggccaatttcaatgatttaaataaaactaatatattatttgttctacatgaaaaaataggaactattggaggcacaggctttaccaatctggatattataaacagcttggataaaagatttggggcatttattttaacttctgatggggaagatgttgagctgtggaaattcacatcttctttagaaaaaatagctaattttaactgtcatcctaaaaaatatgaatttttagacaataggttagctggtatttacgaagaaatcctatcaaaattagatattaaaattattcatattaatcatttaattaaccatacttttgatctagccgaaatagcaaataaaaaaagaattccttatattgtaagtatacatgatttttattatatctgtccatcaattcatttaatcaatgaaaattacagttattgcgagttcaaatgtaaaacttgcaaatttgaaactattttaaaggattggcaaaaatacggttttaaattacttgaaaatgcttatttaaatattgtaccgtctgattcagtaattgaaatctataaatcggtttatccggatttaaataattttaaattaatcaaacatgggcgagatattgaaaaatcaaatattgaacctgaattatctaaaaatccaattaaaatagctattcctggccatatctcacagcataagggatctttattgattaaaaaaataaaaaatttagataaggacaatgcactggaactgcactttatgggaactgcaattccaaatttaaataaatatgggataaatcatggaaggtataaaaggggagattttaataaagtaatagctgaaatcaatccttcatttatagctattttatcaacatgtcctgaaacattctcacatacattaaccgaaagctggaaatcagggattccagtaatagctacaaacattggagcactaaaggaaagagttaataagactggtggaggatggttagtggattataagaatccgcaaaaaatatatgataagattctaagtattgatgaaacagattatctggaaaaagtagaaaatatatccaaaatcaattttaaaagccttaaagaaatgactgatgaatacaataagatatatggggaaatgtctgatgaattataaaatatctgtaatagtagctacttacaactctggcgattttttaaatgagtttttagactcaattaaatctcagagtttgggctttgaggatattgaggttatttttgttgatgatgcttcaactgatgattatactttggatttattgaataatttcaatgaaagctacccgaatgtttcagttatttttttagatgagaattcaggttttccaggaactggtaggaacaggggtttggatttggctggcggtgagtatgttatatttgctgatcatgatgacagctatgtggaaaacgcttttgaagtaatgtatgataaaataaatgaaaatgatatgctgatatctaattttaaccaggtattcgatgataaagtagttaaattcaaatcattatacaaagacactccgacagtctgcgttaaaaacattgatgaggatagaaatcttttaagaattcctgcagctatatggacaagattattcagaaaggatttcctggttgaaaataatatccgatttttagagaggatgctttgtgaagatgtttatgtagccactttaggttgtttaaaagcagagggaataatttatctcaatgatttctatagctacaactacaaaatcagggattctgaaggaaacagatcaacaattcatattagaaacagaaaatacattgaagcaatgttggacggatattatgaaatagctaaaatgcttgaaaaggaaaataaaacaggttatggaaaggaaatatttagacaacatttaacatcatggttatatacaattgtattaagtaaattagattataatgataaaaaagaattatttgaaaaatcatatgacatttttaaaatgtattatacacaagatttatactttaaaaaaaggtataataaccttgttgacaatattttaagtaaggactttgataaggctgttgttgaagcaaataaattagaaaaaactcaagaaaatatgaatgacagaagttttctttcaaggttaaaacgtaaattgggaagataaaatgtataaaatttcagttgtagtggctacttataattccggtgattttttaagtgagtttttagactcaattaaatctcagagtttgggttttgaggatattgaggttatttttgttgatgatgcttcaactgatagttgtactttggatttattgcatgattttaataaaaagtattctaatgtttcagctgtgtttttagatgagaattcagggtttcctggaactggcaggaacaggggtttggatttggctggcggtgagtatgttatatttgctgatcatgatgacagctatgtggaaaatgcttttgaagtaatgtataatgaaataagcaaggaaaatgctgattttttaattactaactactataaagtttatgaaagggagacagttaaagaaaaaactgtttttgatggggaaaatgttgttgtaaatacttttaaagatgatttgaggttatttgacattggcccaagtatctggacaaaattgtttaaaaaagacttcttagctgaaaacaatattagatttttggaagggatgcttgctgaagatttgtatgtttatgtttatgcacttctcaaatctaaaaaaacagtttatttggatgatttttatagctataattatagtatacgtgatgttgatggaaacaaatcaacaatacatatcagaaataaaaaatacttggaaagcatggtcaatggttattttgaggtagataatttattggataaactaaataaagaagaattcttttcaaatatttttaaaagacattttgtttattggttaacgagtttggtagttagtgatatttcagatgcagaaaaaagagagctagtggtagctattaatccattgcttaaaaaacagctggctataagttctgaatttgatgaaaaaagttacttgccattaattgatcttattttagcagaggattatgataaaatagttgaggaaatatgtaaaattaaaaaatcaagagccagaaaggataaaatcaagtcattttttggtttgcgataaaaatattgattgtttaagctaatttgactcattattttaaacacaatataaatttcgtgtttaatgtgtggggataataagtttaaataatttttggataagcaatctttttataattcttttattaaaaataactaacagttttaaaaaatttattttagagagttcctgttcatgtttgaaaacaatgtgtatgtgcaaaattttaataagtatacttttctacttactgaattgattaaaagggatataagtggaaaatataaggattctactttaggtttattctggagttttttaaatccgttattatctatgattgttttaacaatggttttctctttaatatttgcaaatacaattgagaatttcccggtttatttgctaagtggtaaattggtatttgatttatttgctaatgctactactggagctatggattctattaaggcaaattcagagattattaagaagatttatgttcccaaatacatgtttgctgttggaattgtctgttcagagtttattaactttttaatctctttggtggtattggttgctgtaatgatatttacaggtgctccgtttcattttgcgctgatttactcaccgattccattgtttttcttattggttttaacaatgggggtaggtttaatccttgcaacagctacaacattttttacggatattaaatatttatatggggttcttgtaatgcttttatcatttatgactccgttgttctatccgattgacattattcctcagcagttcttatttgcatataaattaaatcctttatattctgctgttgagtgtttcagaaacattatacttggcggaactttcccggatacctggccgtttgtgtttttaattgtaacttcaataatttcacttgtcattggtgtttatgtattcttcaagtatcaggataaatttgtacttaatatataaggaggtttttttagtttgactattcaagtaagatatccaaaagttattactcaggaagaaaattccaataagtctgaatgggttgatttaaataatgttagaatcgatgattgggatgaattggcttctacagtagttaaatcaaatgaagctcctcaggttatatgtacaagtcattttgattttaatattcctggtgatgccaaagtatcagaaattattgtagaacatgattttcataaagattcttctgaaaatcctattaaaatggatcctccaatgattaaggcagtcataggggataatgaatttgaaaaggaatcctttgtccatgcagatgtttatcctgcagacagatctgtaaagataactgtcgatgacatcagaggtgaggacatcaacaatgattttgccgttaaagtagaatttcctaaaaacacaagtgaaaatgacggaatactttattttgattatgttcgtgttaaattagtttttgaagttaaaagatatctcataacttctggtgaaactaacaattatttcccaacaaaagaaaaacctataaaaatagcagtaggtgaagaattaaggtactctatttacttcagaaatgtgaatggtatttcaaaagaacctcagaaggttaaaatcaatgttcctgaaggttttgaacttgtaaaatattatttcaaacctaaaaaggttaataaattagctgaaaaagatgttgaagtagctgaagatatatttgatgaaaagaattatgtttggattccttcagcacgcggaaaaggaatgtccggattgagattgattcttaaagctacccatgaaggatccagccatataaatgcttatactaaacattatggtgcaactcctaatttttatgttgaagttcatcctgaaggctttgaaagcccggttaacatgtttgatgaaacttcaggggtttgggcttctgaattggaagataatgaagaatttcagaaattaaatcaggaagtagctattgaagttgacaatgtatctatggaatttgaaatgcctcaggaaaaagtggataatctaaaagaatattgtattaaatgggccaaaagagaacttaagcctaaaaccaacttcaaagcacttaatgatttgtcatttaccattaacaaaggtgaaagggtaggaattataggattcaatggtgcaggtaaaagtactcttttaaaagtcttgtccggggtatttaaaccaactaaaggtaaggtatacactgctggaaaaatagctccgttactggaacttggtgcaggttttgaccataattacagtggaagggaaaacgtatttttaaacggagcaatattgggttattccaaggagtttctattaagcaaatatgatgaaattgttgaattttcagaacttggagactttatggaaattccaattaagaattattcttccggtatgaatgccaagcttggcttttcagtagctactgttgttgagccggatatattgattttggacgaaattctatctgttggagatgtaaaattccagaagaaaagtggggacaaacttaaatctatgatgggttcaggagttactgttcttttagtatcacattcaactgctaaaataagggaattatgtaccagagctatttggttggataaaggtaaggttataatggatggtaatgtggattatgtctgcgatgcatatattgaagcagctaaaaaagcatctgcagatgaaattaaagatttagagcttgtataagtatgtatcttaaacataaaatttatggaaaactctttaatttatttacaaagttttcaattaatgataagcaaatatcctttattttagattccagcgaatcatttaagggaaatttggattatattaaaaaggaatttgaaaaaagaggagatttccaatttaactttttttataaggataaattatctttttccagttttaaaagattggctacttccagatatgtatttctgaatgataatttttttccattggctttcatgaattttaaaaaggatacaaaagtgattcagctatggcatgctccaggtgcctttaaaaagtttggtgcatcaagtgataataaatccagaaatattttaggtaaaatcagcaggaatattgattatctgattacctcttcagacaatattgaagattattacagtgaagcatttcagataaataaatctaaaatcaagtctttaggtcttccaagagcagattattactttaaaaatcataatttggataaattaagggataattttgattccaaatatcctatagctaaaaataaaaaaatagtgctttatgcacctacatttagggataatcctgagaacaataatgtttttaactttttagatttggaaaaattcaatagggagttgggggacgaatacattttggtgttaaggctccatcctaagattaaaaagttttttaaagataaaatcgaagttaatcaggaatatgttgattgcagtgattttaaaaatgaacaggagcttctgttaatttctgatgttttaataagtgattattcatcaataatgattgaatttgctttgttggataaaccaataatcttttttacttatgattatgatacatacatgtctgaagataggggattttactttgattttaaagaaaatgttccgggacctgttgtttatacaactgatgagctgatagctgaaattaaaaataatgatttcgataaaaataaaatttccgagtttagaaaaacacaatttaatgcaactgacggtgaagcatctaaaagagtagttgatttcttattaaatgatggtggaaaaaatggataatattaaagtaagtgtaattgttccagtgtataatggtgagaaatatatacagacttccatatcctctataataaatcaggagtttagtgagaattatgaaataattgttgtagatgatggatcagatgacaacagtttggatattgcacaggaactattaagtaaatctgacattccatataaattggttcatcaaagaaattccggtgtaagtgtagccaggaataatggaattgaagtttcaaggggggattatctggtatttgttgacagtgatgattatgtattgacaaatcatctctctgagttatacaatggaaaaacagattttacattaactcaaatggcaaaagaaggttcaaaatcaacagtcaattcaatcagttatccggaagttccaatatctgctcatgacttaattaaaatggaacttcagatgataattcctgaattcagcttttgccagctaatctataaagcagatttaattaaggataataatttaaagtttgattcgaaggctgtttacggggaagacactgaatttgccctaaaagcgttaagctatggtgaaagtgtagctgtcggggaagaaataacttatctttatattcaaaggaacgactcagcaacaagcaaatcaggtcttaaaagatttaatttcattgaaactttggaaaatctctcaaaattttataaatcagggggacaaaatgaattagcggacttggtaattacaagcagaattcccagagccatttttggcaacatgaattattttttttaccatggttatgattttgatgaagtaatgtctaaaatggatgatttggatttattttcaaaattgtctaagtttaagggagattctaaattcaagtttaaaataaggctatttttattaaatccaaaattatattataaaatgtggaaaaaatttaaaaatactatctgattattatgaaagcttctgtagtgactccaaattataacggaaaagaatttctaaaaacatatttcgattctttaaataggaataaagaatttgttggtgaagttattttggtagataatggatcaactgacgaaagtattgagtttataaaagattattcaagtaatttagattttccggttatcataattagaaatgctgaaaatttaggatttgcaaaagcagtaaatcagggtattttaaagtcttcctacccatatatattttctctaaataatgacactcaggttgaagaatccggaatcaaaccattaatagatttaatttcttcagatgatagtattttttcagttgcttctaaaatggttcagtttgataataaaaacttgatagatgatgcaggtgatgaatacaatattctggcctggactaaaaagacaggtgaaaatcagcctgcagaaaattatgatgaagtatatgaaatattttcaagttgtgcgggggcagctatgtataataaggccattttagagaaaataggtctttttgatgaaaatttctttgcatatatggaagatgttgatttaagctacagggcgaaaatcaacggatataaaaacctattctgtcctgattctgtagtttatcatattggaagtgcaacaagcggaagcagatataataagtttaaagtaaaattggctgccagaaacaatgtgtggacggtttataaaaattttccaattcctcaaaagattttaaattttatatttctatttttagggtttttaattaaatatttattctttgttaaaaaagggtttggcaaaacatatctggaaggcattaaagaaggtttaaaaacaagaaacaaaatcaataaagttaaattcagcaaaaaaaataccaaaaactactttaaaatagaatggaaattaattgttaatgctgttaaatttttaaaaaaataaaattagttgagaattatggatctttcagttgtaattgtaaattatcagacatttgacctgacaaggaatactataaattccatattgaaatatgagtatccttttagctatgaaataatagtagttgataatgcatcggaggataatagtttaagtaatttaaaagattattttaaagattcagttaaatttatttcttcaaaagaaaataatgggtttgcagcaggtaataaccagggtttaaggatagctggtgggaaatatcttcttttattaaattccgacactgttgtttgggaaaatacattagagaagatttataacttcatggaaaataatccttttgttggagcatgtggctgcagggttcttttagctgacggaactttggataaagcatgtaaaaggtcttttcctaatgttaaaaattcattttacagattatttcacattccgacaaatagcaaagaggataattataatttggataatctgcctgatgacggaatttatgaaattgactgtctgaccggagcatttatttttgcacgtaaaaaatgtttggattcagttggattattggatgagacatttttcatgtatggtgaagatattgatttatgttataggattaaacaggacaattggaagatattttactttggtgaggctaaaataactcattttaaaggatcaagcagtaaaaaacagaagtctaaattaatatatgagttttatagggcaatgtatatttattataaaaaacatcatgcaaacagcacttcattttttgtcaattttattgtttatttgggaattgtctgtttatgcattttaaaattgattttaaatttctttaaaaagaaaaattaaatattataagaaatttaaagatatacttaaatctatttttgtgataaatatgattaagcagaatcaaagagtattaaatgtagttatggttttatcagatgcattagttgtaactatagctcttttctgtgcatggtggttacgttttaaaaccactttatttggtccgattggaggccatttaggtttacaaagctatgttctttttttaacatttgctgtaatacctacatacttgatattgtacttttcttttggtctttacaaaccttatagaactcataaaacaattttttcagaagcaactaagcttataaaagtgaacattgttgcattctttgttttagttgctattttatttattgttaatgaacctaacttttcaagaatcatgctattccttttagctattatagctactgtttttggaataactgaaagatttgtcattaggagcttcttaaaagagattagatctaataacaaaaacttaaagcatattcttattgttggggataatgatttagcttatactttcgcacgtaaaattagaaataatccctatttggggtttgttgtcagcggatttttaggtaaaagcaatcatgtaggtctggaaattgaaggaagcaagattattggtgcgtttaaagacttagatgacgttcttgagaaaaataattttgatagggttgtacttgctattccgttaaagtattattttaaaatcaatgagcttgtggaaagctgtgaaaaggtgggaattaaagcagagattattccggattatataaggtatttccctgcacagccatcagtagacatgattgaagatattccgattataaatatacgttatgttccattagatgatgcatttaataattttttaaaatcattatctgattacataatatctattatagctattataatcacatctccgatcatgctgattactgcaatagctattaaactgacttctaaaggccctattatatttaagcaggaaagaataggatatcatggaaaaccatttatgatgtacaagttcagaagtatgaaagttcaaaatccgaatgaagagaaatcagaatggacaacaaaagatgatccaaggaagaccagagtaggtaattttatcagaaaaacaagtattgatgaattgcctcaatttttcaatgttttaaaaggagatatgagtgttgttggtcccagacctgaaagaccatattttgttgaagaatttaaagaaaaaattccaaaatacatggttaaacatcaggttaagccgggattgacaggatgggctcaaattcatgggtgtaggggtaatacttctattaaaaaacgtatagaatttgacattgagtatgtagaaaactggcatatgggtttagacttagctataatgattaaaacagttgtaaaaagaaatcctaatgcatattagaattttgcacatttgaacttttgtgtagtttattaaaatttatattctatttttttaataattattttaaaaattacttttcaaatgctgtctctaatagtttatatacattttaatttaaaataataattaactttctaacgaggggtttggtatggataatgaaattttagaattatatgaacaggtcaaagataaattgactatagaagaatttcaagcaaaaataaatgatatttctaaagaaaacgaagatttaggttttgttgatgattattatgctgctgaacaggtggtaaacaatataattggagctagtgaagatgatcaaaaatccaatggtgaaattttaaacataggtgatttggaacagggaccccaagcagctattgttggaaggattatgggtatctcaaatccgaaatcttttaaaacacgtaaaggcaaatctggacaagtctgcaatatggaattgaaggatagcactggtgatattagggtagtgttatggacagaaaatattaaacttcttaaaaattttaaagaaggaaacattgttaaaattactgatgttgatataaaagaaggttttagaggagataatgaagctaatttaagacctaggtcaactataactcattttaaagaagcggatttatcaaaattccccgaatatgaggaaaagataactgatattgaagatcttgtccctgaaactaaagcaaatattattgccagaatagtaaggattccaactccaagaacttatgaaaaaaatggaaaagaaggaaaagtcacttctcttgagctaaaggatgcaactggagaaatatcctacacattatggaataaaaatgttgatttgattgatgaattgggtttggatgcaggagattctgtaaaaatattaggtgcacaagtaagagaaaggaacggtgaattatcattaactcattgggatggcagaataatcaaaggagattttgatgttcctgaattcactcaggaatttattaaaattggagatattacagaacaaaataatatagctattaaaggagtaatttctaaattgcaggatatcagaacgtttacaagaaaatctgatgggtctgaaggtaaattaagaaactttgatgttagtgatgatacaggttctattagaactacaatatggggaaatgatacagatattttgttaactaaaggagatattgtcaaaattattggtgcagatgctcgttttgatgattatacagacagtggatattcacttaacacaaatttcaacactcaactttcaataaatccggaaaacttatctgctgaagaattggacatctttgatgaaatcaaacagaaagtttctcaaattaaaagacttagtgaagttgaagaatttgatgaagacggaattgaagttgatgttataggaagaatgtttgctattggtgaaataaatgaattccaaagagatgacggtagtgtgggatatgcacgttcagccaaattctctgatggtgaaggacgtgttggcctaacattttgggatcagaaagctaaacaggaatacaaaaccggcggagcatacaaaatcgaaaatgcaaaagttagattgggaatgtatgaagttgaattgaatattggaggttctgcacgtataatggaattacctgaagacagtgaccaagcaagattccttccatcctttaaaactattgaaacaatgctttatagccacaaatcaatagctgatgttgaagaagatgatgagggcattattgttacaggcagaataattgaatcaagtgatgttcgtgaatttgatagaactgacggaagtaagggatatgtcaaatctttagaaatagctgataattcaggttctattaatgttactttatggaatgaaaatgctaaaaaagaatggaatgttggagatgctattaaattccaagatcctcaaatctcatttagaaacgatagcttggaaattaatgtatcaaggtccacttctattcttgaacctgatgaatcagaaattgatgatttaccaacttatgatgaattaaaagaatccatttatgttcctaaaaccattgaagctctagaggacgatgataggaatgttcgtataacaggtactcttaaagaggtattcggtaataagatattaattacaaaatgtcctagctgtggaaatactgtagatcagtcatcagatgattttgtttgtagtttctgcggagagcctatcgatgaacctagatatcttttaatggttccggctagacttgaagatgacactggtgaaatttcaatcactttctttgataatttggctgaagaacttcttgacatgaaaaaagaagaaataattaatcttactgataatggttctgatttaggacctatggaaggtagaatagatgatttgaatggtttaactgttgaagttattactaatgttagttttgacgattataatgaagaaattaggctcaatcctaagagaattttatccaaatattattaaaataaaacaaattaatgaggcatgattattatggtggaattagaagatttaccaagtgttggtgaaaaaacagcggaaaaattaagagatgcaggttttgcagatatgatgagattagctactgcaactcctaaagaattatctgttaaagcagaaattggtgaaggtgtagctgaaaaagttattgaagcagctcgtaaatctgaaaaaatagactttgaaacagcttacgatgttcttgaaagaagaagagatgtaggtcacatttctgttggtagtgaaggtttcaatgatttaattggtggcggaattgaaactcaatcaattactgaagtattcggggagtttggttcaggtaaaagtcaaatttctcatgaattggctgtaactgtacaattgcctcctgaaaaaggaggacttgatggtgaatgtgtatttattgacactgaaaacactttccgtccagaaaggattgaacaaatagctaatggttttgaattggatattgatgaagtattgcaaaaaatccatgtagctcgtgcatttaattcttctcaccaaatcttaatggctgaaaaaattaatgaacttatccagcaaggcaataatattaaattggttattgttgattctttaatggctcatttcagagcagaatatgttggaagggaatctttagctgtaagacaacaaaaattaaatcaacatttacatgcacttcaacaaatagccaatacttataatgtagctgttttcataacaaaccaagttcaagctaaacctgattcattctttggaagtcctactaaagctattggtggacatgttttaggacatgcatctacttatagaatctggcttaaaaaaggtttagcaggtaaaagaattgctcgtttagtagacagccctcatttgcctgaaggtgaatgtgtatttaaaattaaaaccgaaggtattgttgattaattataccttttaaccctctttttttacatttgaaaatattttctgctttttagatttgtctctaattttttattagtcgttataaccaatgttttataatctttgctgaattatgcaaagccaatttcggttctacaataatgatatggattttattcgtaaggaacttattctcagcatttttaacatattcttaacattttttaatcctcattttattatttaattcaataaaattaataatgttttgttttagctataacaaacatttataaatatctaaatcaatagttatatttcgaggtattaatatgaatgcaattgaaattacaattatatctattgttttaatgattggtttaggttatttccttaaaagaatagattttttaagtgaaaaggatattgatcccttaaataagattgtaatgtatatccttatgccttgtatgattttttctgccctttattctgcagatatgagtctgttacctactttgggaattttgccgtttgttattttaacagcatcaattggttcaggtgttatatcttatattgttcttaaaagacttcattatgatgataaaaaaatttggagtgttttagtaacagtaatgatagccaatacagctttcatgggatatcctgtcaatttaggtgtttatggccatcccggatttttaagagctatattttgtgatttagctacaacatgcatgttcttgttattgtcctttgttcttgttcttaagtttggaggaactgttaaaagagcatttagggaaattttattgttcccacctttatgggctgttgttttaggtattttatttaatttattaaatattcctattggtccagttttagataaaacagttaattatcttgctgatggggctattcctttaattatgatttcacttggtttgtcaattgaacttggaggtctggccagaagtaaagccatggttattttcacttcaattgttaaattaggagtatttccattaattgctttgattgttgtatcacttttaggacttactggtttacaacatgatgtaggaattattgaggcagctatgccttctggtatgttgtctttattactggctattacttataaattagattatgaattaacttcagattgtattttaataaatacggttatttcattaataacattaccaatcataatgacattattataaatgttgatttttgaacagttttttctgttctattctttttttttaatgattggtgctaaatattttcttaaagggagtgattttttaagtaaatggggtatcggcattttaagtttatattcttttgttagctggttaacctgcagttgatattttagtaaatgctattgatttcattagttgcccggcatgtgctgatattgctgttatgacccttaaatttcaaaatttaactttgcctaaatttattatttttcttaaaggataattgttattattttatagcttttagaaagctgttttgaatcggtttttagcttaaccaatgattttaaacatgttatttttttatagtatataaactttactcaccaatttctatagaaatctttattaatgtgggtttactacatatttaatatctaattaatttctaaaaattataatattttttttgcattagatttttattaatataattagattattttcacgacttgtacaaggtgaattaaatatggcagaagaaaaaagagataataatgaagaattaaggattggtgtttacgtctgtcactgtggtgtaaacgttggtggagttgtagactgtccggatgtcgcagaatacgcaggtaatttacctgatgttgtagttgcaaaagactacaaatacatgtgttctgacccaggtcaattaatgatccaagaagatattaaagaacacaaccttaacagggttgttgtagctgcatgttctcctcgtcttcacgaacctactttccgtagatgtgtagaagaagctggtttaaacaaatttttatttgaatttgcaaacttaagggaacaagactcttgggtacacatgtccgaacctgaagcagcaaccgaaaaagctaaagacttaactcgtatggctgttgctaaagcaagattactcgaaccattagaagctactaaagtagcagtagataacaaagcattagttatcggtggtggagtatgtggtattcaaaccgctttagatttaggtgacatgggctttaaaacctacatggtcgaaagacaccctaccattggtggtaggatgggacaattagataaaactttcccaactcttgactgttcaatgtgtattttagcacctaaaatggtagacgtttccaaacatgaaaacatcgaattaattacctacgcagaagttaaacaagtagacggatacattggtaacttccatgtaactgtaggtaaaaaagcaagatatgtaatcgaagaagattgtactggatgtggatcttgtgtagaagcttgtccaattgaaatacctaactactacgatgaaggtgtaggtatggtaaaagctgcttacattccattccctcaagctgtaccattatgtgcaacaattgataaagattactgtattgaatgtatgttatgtgaccaagcttgtgaacgtggagctattgaccacaatcaacaaccatctgaaattaaattagatgttggtactattatcgcagctactggttacgacccattcgacccatcaggtatttaccaatatggatacggacgttactccaacgtaattaccggtatggaaattgaaaggatgattaacgcatccggtcctactggtggacacgttgtaaaaccatctgacggtaaagaacctgaacgtgttgcattcatccactgtgttggttctagggatgaacaaatcggtaaaccatattgttccagagtatgttgtatgtactccatgaaaaacgctcaattatgtattgaccacgaaccagataccgaagtaacctgttactacatggatattcgtgcatttggtaaaggatacgaagagttctacaaaacctctcaagaaaaatatggtattgaatttatcagaggtaaacctgctcaaatcttcgaaaatgatgatttaaccttaactatcagagcagaagacactttactcggtaaagtaactgaatacacttacgacttagttgttttaagtgttggtcttgaacaccctgaaggttcagaagaactcagacaaactttaggtgtttccaaatcctccgacggattctatatggaagctcaccctaaactcagacctgttgacaccttaactgatggtgtttacattgctggtgtagcacaaggtcctaaagatattcctgactccgtagcacaaggttcagctgcagcatctagggcagctatcccaatggctaaaggtcaagtagaaatcgaacctattattgcatgtactgacgatgtaatttgtggtgcttgtgaagtttgtgttgaattatgtccatacggtgctatttccattactggagatgacaatgctgctcacgcagaaatcaatgctgcattatgtaaaggatgtggtacctgtgtaggtgcatgtccatctggagctatggatcaacaacacttcaaaaccgatcaaattatggcacaaatcagtgctgctcttgaagacgtaggtaaatagatgcggagatttttatctccaattctttttttttaaaattttagactatttttaaaacttaatgacttattttacttatcttagtcggatgttgataatctgattatctgcatttggattattttttatatttgctgcaaaaatcttatattataagataagcataaatatctatgtatcgttaatttttaatactaattggatacttaggtgtagtaaatgactgattatcaaaatgaagttttagaatttgaaagaatcatgaaagaacacactaattatatgagaaacagtataaatctcattgctagtgaaaatattacaagttcagatgtaactgaggctgtagcttctgatttagctcatagatatgcagaaggacaatctcatgaaagattatacgaaggatgtcaatatattgatgaaatagaagaccgtgttattgacttatctaaaaaattattcaatgttgactatgcaaatgtccaacctatttctggagtaactgctaatttagcagcatttttcggttattctgattatggtgacaaattaatggcattggatgttccttatggaggacacattagccatgctaaagttagtgctgcaggaatagctggtttaaaaaccataagtcatcctttcgacaaagatattatgaatattgacatcgatgcaatgaataaaaaaatcctcgaagaaaaaccaaaaatagttcttttcggaggaagtttattcttgttccctcatcctgtaaaagaagctcgtgaagcagctgatgaagttggagcaaaaattatgtatgatgcagcacatgttttaggacttattgctggaggccaattccaacaaccaatagctgaaggagcagatttgatgatgggaagtacccataaatcattcccaggtccacaaggaggaattattctttcccacaaagaaaacaaagaagttattgacaatgcagtattcccaggtgttgtaagtaaccaccaccttcaccacttagctggtttaggaattgcttctgcagaaatgttggaatttggacaggattatgctaaacaaattgttaaaaattctaaagcattagctcaaagcttatatgaacgtggatttgatgtattgtgtgaagaattaggatttacagaatctcaccaattagctattaatgtttcaaatatcagaagtgctagtgatattgcacatgatttggctaataatgatgttattttaaacaaaaaccttcttcctggtgacaatgtagatgatagtgacaatccgtctggtttaagaataggaactcaggaaattaccagaagaggattaaaagaaaaagaaatggatgaagtggctgaattcattaaaagagttgctgttgataaagaaaacattaaagatgaagtacgtgaattcatggaccaatacactactgtccattattcattctcacaaaatgaaggttacaggtttcataaactttagataatatgagaataggatttgcatttaccggagctggtcatttactcaatgagtctgttcaggtagctgaaaaactagctaaggatcatgaattaactatatttttatctggtgctggtgaagatgttttaaaaatgtatggtctttatgatagggtagttagtttaactggtggaaaatatagggaattagctactgacaggactcaaaaatttagctatccaattactggaagactttcacttggtaaatatgatttgctgattgtgactcctgctactgccaatacagttgcaaagattgtgcatggtatttcagatactttagttacaaatgccgttgctcaggctggtaagggggctgttaaaacacttatagttccggtagatattcatccgggccctatcgatacagttttaccttcaaaaatggaagtttctaaatgtgaggattgcaaagagtgtgttgcatctttaatatgtgaacagaaagctattgttcctcacaaggaaattgacttgctaaaatgtatcggatgtggtctttgtaaagatgcatgtccaaatggagcaatatctgaaggtaaaatcataacaatgtatatgagggatattgatattgaaaatactaaaaaattaactggtattggagatattgaaatatttgaaaatcctaatgagttattggactttttaaaagattattagatgaattctatttcatctcctttttttaatttattttttattttattttcttcaaactcaattatgtaatctgctttttttaaaggggtatatttttcccagggttttagggtttgaatatcaaaaatctttaaattttcatctaaaaagtacacatctatgttaaatttcataaaggatgtatgaattcctgagctaaatctatttttagcttttataataaaaactaagccataatcaatattttttttaaacatcaatcctttaaggcgtttgaaatatgtgtctgcatatttaaggtttatattaatgttttctttagtggttttattgtaaattccttttttcattagcttagcttttgtttttattgtttttaagtttttagaatctgattggggaatattgcttttgttttaagaaatttagtttgaaagttaaaatcccatacatttatttattaattaaactaaaaaaatataatataaataactgatatgtgttgataaaatgagaaacataattgtaaaagaattaaatcaaacttatattgaagatatcgatattgaaatcgttgaaagaaaaggtataggtcacccagacagtattagtgatggtattggtgaaactgtaagtgaagctttatgtaaaatgtatatggatgaattaggtggagttcttcaccataatactgacgaagttcaaattactgctggtgaatccaatcctgtattcggcggaggtaaaatcttaaaacctatcgatatattattaactggtaggggagtttcagaatatgacggaattaaattccctcttgacagagtagctattgaagcagctaaaaactttttagatgatactatcattaatttagatgttgaattggatactgttgttgaatgtaaaatcggacacggatctggagatttagtagatgtatttaaaagagaaggtgcaccttcttcaaatgatacttcttttggtgtaggttatgctccattttcagaaactgaaactttagttaaagctactgaagaattattaaactcaaaacctttcaaagctaaacatcctgctgttggtgaagatattaaagttatgggtttaagggaaggagaaaaaattaccttaactattggatgtgcaatggtttcaaaatttgttgcaaacagagaagaatacattgctgttcgtgaagaattaaaagatattgtatctgatcttgcaaccaaatacaccaacagggaagttgaagtattcgttaacactgcagacaatgatgatgcaactgatgaatcaggttattatttaactgtaaccggtacttctgctgaaatgggggatgacggttctgtaggtagaggaaacagagctaacggattaattactccgtgcagaccaatgtccatggaagctagttccggtaaaaaccctattaaccatgtaggtaaaatttacaatattttatctaatgaaatagctaaggatgttgttgaaaatgttgaaggaatcaaacagatgaatgttatgattttaagccaaattggtaaacctatcgatcagccaaaagcagcttctactcaggttatcttggaagacggtgtcaaacttgaagatgttgataaaaaagtagaacaaattgttgacaggtggcttgaagatatatcaatcattacagaaaatgttgttcaaggaaaaacaagaacattttagattgcaggtgtgtttaatcagggtttgataactgtgtattaaatttcctttctcgttttttcaactaaattaaatctctatttattagagatttttatttttttttaaattattcaacacaatatatcaattaatttcttattaatatagggagaattaacatgccaataaaagaggcagataaatcatatgatcataaaaaaatagaaaagaagattcaaaacttctggatagaaggagatactttttctaaagtaaataaacttagagctaatggtccccaatattcatttttagatgggcctccatattgtagtggtaaaatacacttgggaactgcttggaataaagttattaaagattcctacttgcgttataaaagcatgaacggatttagcttaaggagacaggctggatgggatatgcacggtcttccgattgaacacaaagtggaagaattgatgggcatcaaaagcaaacaggaaattgaagaaaacattggaatagctaaattcgttgataaatgtaaggaatttgcaatagacaataaattagctatggaaaaagaatttgatgatttgggagtttggatggactgggaagacccatacatgactttggatcctaaatacatggaatcttcatggtggactttaaaaagagctaatgaacaaaatttgcttgtaaatgataaaagagtaattagctggtgtcctcattgtgaaacagcattggctgcagcagaaattgattatgaagaaaaggtggacccttcaatttttgtcaaattcccggttaaaactccaatattggaagacaatgatttgcccgaatttttccttgtatggacaacaactccatggacacttcctgcaaacttggctatctgtgtaaatcctgaatttgattatgcacttgttaagattgacggagaaattttacttcttgctcaaaacttagtagaaaccgttttaggtcctgctaccattgtacataaaactaaaatacctgctgagaatgaagatgaagaagacaaaatcataaaagaaactgaagttgtctatgagatagttaaagttgttaaaggtgaaagcttacttcataaatcctacatttatccgttggaaaaagaagtttcaatacatgatgaatttgataaaaatgaaaatgtccacactattttacctggagaccatgtagagcttggtgaaggtactggatttgtacatacagcacctggccatggtcctgacgattttgaagtaggtaaagcttatgatttgccgattttctgtcctgttgatgaaagcggtaatttcactgatgatgcaggaaaatatgcaggtgaattctgtaaagctgccaatgacggaattattgctgatttgcaagaaagcggtttgatgtatagaaatgaaacaatagaacacagatatggagtatgctggagatgtaaaactcctattatatatttagctaccaaacagtggttcttgaaagtaacagacattaaacaaaaaatgcttgatgaaatcgacaaagtagaatgggtaccgcaatgggcaggtcagggaagattcagagactgggtagacaatgctaaagactggaccatttcaagacaaagatactggggtattccaattcctatttgggaatgtcctgattgtggtgaattaaaagtaataggttctgtagaggaattaaaaaatgaagctttaaatgatatttctgttgatgatgatgagcttgttcacaggccatatgttgatgaaatcataatgaaatgtgataaatgcggttctgaagtaaaaagaattccggatgttttggatgtttggattgactcaggagtagctggatgggcttcattatattatcctcaacaacaggagaaattcaatcaatggttcccgtatgacttcattacagaaggccatgaccagactagaggatggttctactcacaattaggtactggtgtaatttcaatgggacaagtgccatataaaaaagtattgatgcatggttttgttttggatgaacacggtaagaaaatgagtaaatcattaggtaatgtagtttctcctgaagaggttattgaaaaatacggtgctgatgtattaagattctatttattatgggcaagtaaaccatgggatgatttaaaattcgtatgggatgaattgcttaacgtaaataagatgtttaatattttatggaatgtatatgtattttcaactacttacatgtctttagatgaatttaatccaactaaaataactgaaaaagatattattttaagggatgaagacaattggattatgtcaagggccaatactttagtaaaagaagttggtgaagatttagaaaaattatcattccataaggctacaagaaaaatcaataacttcatattggaagatttaagccgctggtatgtaaggcttattcgtggaagaacatgggtagaaagtgatgatccggataaacttggagcatattacagtttatacacagctatctacaagctgatttcagttttatgtccgatagctcctcatgtctgtgaagaaatctatgaaaacttagttaaaggagtagatgagaatgctcctgaaagtattcacatgcttgactggggatatgatgaatctaaaatagattctgatttagagcaaaaaatggatgtagtaagggaagtaattgaagcgtctgcaagagcaagagatatagccagatataaacttagatggcctgtatctgatattaccatagtatctcaagatgaagatgttcttaaagctattgaagagttgcaagatattattaaagaccaatcaaacactaaagaagtattgactgctgcagagtttgaaaacttgtcatttaatgcaaaacctaatcttaagactttaggtcctagacttaaaggagatatgggtattgttaaaaaatatcttgaagaagctgacggtaatttaattaaaaatgaattggatgatactggtaaattcactgttgaatcagatggaaaatcatttgaattagatgatggggatatattatttgatactgagcttcctgatgactttgtaagttctgaatttgaattcggtaatgtatttgtaaatactaatgtaactactgaaatcaaacaagaagctatggctcgtgaacttattagaagagttcaggacatgagaaaagatttggatttagatgtagaagctaacattgatgctgttgtaagtacttctagtgaatttaaagaattaatactcccacaatctgaatttattgttaatgaaatcagagcacgcagtttaattacttctgatggaaaagaatgtttagattgtgaggatgtttatactaaagattgggatattgaaggcgaagacgtctgtatttctataagattagtgcaataggtgtttaaaatgactttgacagattctgaaatggaatatattgaaggaatccttggcaggaaaatgaatgagttggaagaagggatgttagatgtaatgttttcagaacattgctcttacaaaagcagtaggccaattttaggcacatttcctactgagggtgaaaatattattttaggtcctggagatgatgcaggtttagtttcagtaactgataaatatgctttggctgtaggtatggaaagtcacaaccatccttcagctattgagccttatggaggggcaggtactggaatcgggggaattttaagagatattatttctatgggtgcaagaccaatagctcttttagattctttacgttttggatctttagatgatgaaaaatcaaaatatttatttgaacatgttgtagagggaatttccgactatggtaacagggtaggagttccaacagtagcaggtgaagttgaatttgatgattcatttagaacaaatcccttagttaatgtaatgtgcgtgggacttgttgaaaaagacaaaatcgttcgcggaaaagctccgtatgttggagatgtctttttattgatgggtggtacaactggccgtgacggaattcatggtgtaacatttgcatcagaagagttaacttcagatagtgaaacagaagacaggcctgctgtacaggtagctgatccatttactaaaaaaagagttttagaagcttcacttgaaattttggacgaaattaatgttagcggagttaaagatttaggtggtggaggattgacctgctgtatttcagagcttgttgatgaatcaaataacggtgcaagagttgatttacgcaatattcctttaagggaaactggaatgactccatatgaaatcatgctttcagaatctcaggaaaggatggtttttgtaattaatcctaaagatgttaaaaaagcacaggaaatctgtgataaacacgaaattgtttcagcagttataggggaagttattgacggaaataatatgataattgatgatgaaggttcttctttagctgatttgccaactatcttattggcggatcccccttcacttaatcgtgaattaaaagaaatagctgaagatacctcaaaagttgaagtggatcatcctccagttaggcaatcattacttgaacttttatcttcacctaatattgcttctaaacaatgggtttacaaacaatatgaccatgaagttcaggtaagaactgttgtaaaaccaggtgatgatgcagctgttttaagaattgatgatgatactgctattgcactcacaactgatgcaaatacaatccacaccaaattatctccgtttgacggtggtgcaggttgtgtggctgaagctattcgtaatgtaatttctatgggtgcaactccttatgctgttgtagattgtcttaatttcggaaatcctgaaactccggaaattttgtggcaatttaaaagaacaattgaaggtatgtctcttgtagctgagaattttaatgctccagttatcagtggaaatgtaagtttctataatgaaaccgaaggtattaaaatcaatcctactcctgctgttggtgttataggtgttgaaaacattgaaaacatcagaacaatggactttaaaaactctggtgataaaatccttttaatcggtactacctatgatgaggtaaccggttctgaatatcacaggactatccataatattgaaaaaggtatggctccaagaataaggattgaagatgaattggctaacggtaaaactattttaaaattacttgatgaagattcatctaaaaatattacagctgttcatgatgtatctcatggtggattggctgttgcattatcagaaatggttatgaaaggtaatattggttgtgaaatagatttggattcaattataacttctgaggatttggaagaatcagatttaatttatagtgaatcacatggtagatatattataacagtaaatgctgatgctgttgatgaaatattaaataaaatagatgttcctgtagctattataggggaagttaaaggagctgttttaaaacttggagataatgaatttaccattgatgaattaaatgattcttatcatggagttattgaaaaatatatggcttaagctggtgcgctgatgtttttgtctaaattagattctctaaaagatgctttaaaattaatagaaaataatcagaaggtaatggattatgaagaaatacctttaaaagatgctcataaaagggtattggctgaggatattatttcttttcatgattctcctccttttgacaaatctgcaatggatggttttgctcttaagggagtaaatacttttggagcatcacaaagtaatcctaagcatttaaaaattgttgattcaattggtgcaggggatttttgtgataagacaataggtgaaaatgaagctattgtaatagctacaggatctcctgtgcctgaaggtgcagatgctgttctaatgaaggaatatactacaacacagggggatgaattaactatttacagtcaggtcactccaggtgaaaatgtaagcccaaaagctgaagatatcagtaaaggtgatgtggttttatctaaaaatacatttatcagatatcaggaaatgggtttaatagcttctgcaggttacaatacagttaaagtttttaaaaagcctaaagtaaaagtaattattactggtaatgaacttgtagagccgactaaggaagaaatatctaaagctaaaataatcaactctaaccagtacacaattggctcaatgcttgaagactgcggggttatttttgatatttgtcatgtaaaagatagttttgaagaagtcaaagaagctattttggaatcattggaagaatatgacgttataatgactactggtggaacagctatcagtaaaggtgatgttgttttagatgttgttggtgacattggtgaaatactgttccatggtgtatccataaggcctggaaagcctattggtgcaggtattgctaatgataaaatgatatttacattttcaggacagccagttgcagctatgtctcaatttgatatctttgcaaggaaatatttatttaatatgcagggcagagactttaatttccatatcgtccaaagagaatctttattaaaaattccttctcagcttggaagaactgatttcatccgtgcattttcagatgatgattttgcaaggcatgtgttaaacagaggttctggtataatcaggtctatggtggaggcaaacagctacatcataatagatgaaaatgatgaaggatatcaaaaaggcgatatagttgatgttgtcttctttgattcattaatttggtaggctaagaggtcgtttaatgaatggtatttattattatttaatagctttcattgttatctggatattggcatttggactgaaaaataaattaactaatcatggatttgaaattcagtttcctcttataatgtggagaactgaaaagtttaaaaatttcataaaaagaatggctaatctttctccaaagttttggaaatggtttatgaatatagggattgtaatttcatatattgcaatgatatatattacatggactctggttagttcattatcatcaatgttggaaactccttcagtttctttagttattcctggtgttgaaatgccgggttcatcaatttatgttcctttgggatatggattaattgctttagctactgtattgatagttcatgaattttctcatggcatattggctattgttgagaaaataaatgttaaatcagtaggtttgatgttattcgcaattcttccgggagcatttatggaacctgatgaggaagaaatgaaagaagctaagaaatcttctaaattaagaatatatgctgcagggtcaatggcaaacattactttggcagtgatggctcttttaatagtttctgcagtaggatcttatgttattccttctacttttgaagaagatgggattgaagttgacaggcttgtaggtgattctcccgcaagtaaggttcttaaagagggaatgattattgaatcaattgataatcataaggttcatgattcaaacagctatgtaaatgcggttaataatcttaaacctggtcaaaacataactataggcacgaatgaaggtgattattctataattttagataaaaatccaaacaatgagtctaaaggatatatgggtattcaagcagctaaacattatgaattaaatgatggtgtagctagcatatatggtgatacactgccttggatatggtttggggtacttgaactgttccagtggatatgtatactgaatttaggtattggtttatttaatttacttccattaaaaccattggacggagggcacatgtttgaaacattgcttagctataaactgcctaaatacttctataaacctattgtaaattcattatctttgattttaggaatgattattatatttagcattgtatatggatttttataataaatcctgttttattttttaatagggataatttcctttttcttcatattcttttttaaccattctttaaaaatagaatcatatattttatacttattttcatctaattctattaaactcttattttgcaaggttttttagtgaaacaccaatagtttcgatggttacatctaagtttatttgctatttcaattctttttcaataagagatataatgattcttttcttggttatttagtttgtaccattcatttgttaaatgcatttcctaaggcaagctggtcataatttcacatttccgttaatatgtttaaaaactcaactcacctcttatttattatatattttatcttcaaagtatttaccttctttgttgaaaatctccaataaactcatactagttattgattcatagtttatgatatctttatttagtaattcttctttgagaactcctttaaattgaggatacttttcaacaaacctcactaattcttcagcatgaaagaaaaaatcagttttatgcattttaacatactcattacgtttcacatgttttaatacatataccctttttaaattattttcttcaataatttttaatctagtaggattatctttaaattgtaaagaaatcccccatggtaaaaaatcaggtatattaattaattcttcttttttttgattcacaaatgacaaatcaatatattttgacttcaaattttccatttaattcaccaacaagatatcaattattcttaagtcataatttcacatttccgttaatatgtttaaaaacacacattgcattattataaatatggaaaaaacttgaaaataacttggttttttataaaaaagcataaatgcttttgagaactcttgaaaaatcattaaaaataagtgttgtaaaattagttaaattaaaaatagattcggatactgaatataaatccggagttaaaaaaaagattaaggaagaataattaaattctttcctaaatctagaagtatctttctaaaattccttctaagattttgtagtggcgtccttcatctttggaactttctttgaagaagtcagttgcatcttcgaggttttcagctgcagctttttcagatgcttctcttttttcagcgttagccattttttctccttctaacatcatttcaatgttagctttgagatcatctttaatgattccgttcatttcacagaatcttgctgcgtgttctgcttcttcccaagctaatcttttgaatacttcagctaattctccgtaaccagaccttgatgcttgtctagacatagctaagtacatacctacttcttgggtttctccgttgaaattgttttgtacttctttttctactccagtacctacagtactgcctattttatgttcgtatttaatcataataataacctccaattattagtaattaataaatttatatttcatattttataattctttacatgctttagctaaagtttttcctaactcataactgtcaatattctcttcttcagttgggatgtaataaatttcttgggagtccactacgtcaaatccgtaattttcaagtttttctgcgagttttttagcagttcctccttttccacccattgaaccaaatgtgactgcttttctgttgatgtttgttttatcaaatctaagaccttttaagtagtacatgatgtccccaatacttgggtatggttcgtcattaatggtaggatctccgatagctattcctttactggttaaaatacttttaacgatttcacttctttcatcttcgtgcaagtagaatatttcaacatcgtaaccttcagatatagcaccttcagctaattcatgagccattttttgggtagagtagtgcatagtatcgtagacaattgtaattttgtcttcacatacaccttgtgcccagtcagtataagctccgataattttcattgggtcagtccagatttgaccgtgggacggtgcaatcattttgatttgttcaagtaaacctaattccactacttcgtttaattttttaagaacaagtttggaaagtggagtgattaagttagcatagaatttttgtgcagcatccattaacacatattctggaacttcgtggtcgaatctttttgtgaaacataaatgttgaccgaatgcgtcatttgggaataaaattccatcatctacaagtaaggtaaacatactgtcaggccagtgtaataagaatgcatctaaaaatgcaaaggttctgccgtccatttctaaagtgtcgcctgtacctacagtaacaaattctgcaccttctaatgcgggataatgttttaaaagaccttttacagcaatttctgaacagtaaattggtgcttcagggaatcttttatgtaaatctacaagaactcctgagtgatctttttcaacgtgattttgaataatgtaatctacaactacttcatctctgccttcttgtgcgaaagcatcttcaatacgtgccatcatttcttgagttttacccgggtaagcattatcaataacagctacgtggtcttcaccaaatacaatgtatgcattataggttgttccgtctaaagtgtatccatggtaacttcttaagtcccaatcgagtacaccaatccaatatactccatcaccgattttttgagcatttgctttcattttgaatcgccttatatgtctttttgaattttgttttatttcatacgaataatttgcatgattagaattgtattatgtatgaactaatatataaatttattgggtctttgatatatccttaagttgaacattttataaatgaagggttaattttattagatacgatatacttatataaatttagtttgttagtatagttacaaacggagatatttttaatgattaaacaaaaaccacttcagatattttctaaagatgcggatatgggtattgatgttgttaaaagcccagtcaaacttacaattttggaaatgcttcgtagcaatgacatggaatttgatgaaattgttaaaaatacgggtaaatcaaaatctacaatttctgtacatttaaaaagtttacgggaagatggaataatctcatacagattaggcgagtcagacagcagaagaaaaattttttatttaaattcaaaatatcttggttctgtagaagtatcaaagaaaaatgaaattgaagaaacaagagctgaatatttaattgagaacattgttgaaaatgacggagatttcacagtcttattattccatactttaaggtccatgcttatacaggaaggaataaatattgatccggtattgcattctactggtatacgtatgggacaatctttatataataagttgtatgatgatgatttggaagtatttatagaaaatattgctgaattttgggaaacaaaaggcttaggtaaattatcttttaaattaggtcaaattatcaaaatcacagcttccgattgttttgaatgtgaattgcttccaaaaacaggaaaaccggcatgttatttggacacaggtatttttcaagctttgttcagcgaatttttcggattgcctgttcgtgtaattgaaattcaatgctgttcaatgggcgatgaaaactgtgtttttgaaattgagccttttaaacgcaaataattttagtcatctgtaaatttaattatggttgttgtaaggtatggtttttcagttgaaaaaccttccactattttttcattttcttgggtacaattttgtactgaaaatacttctttaggtctgtttttttcatcaatagcagattccaattcttttgtatttctggaagctttcattaaaacgattgaatcactatgttccaggaaattgtccaatctgccatctatttttggaacaatagttaatatgtcatttttttcaactaaaggttcatttttagcagctgcacaggcagtaaatgaagtaatcccgggtattgtttctatttcatatctattggccagtttcttttgagtatatgaatatgtactaaatattgaaggatctccaagagttataaaagctacatctcttccgctgtctaaataattagctattaattctgcagcactattccaatatttttcaagctcttgctgatcttcaatcattgggaataaaggttctacaaccattaatcttttataatcttttcttttttctaaaattggtgttacaattgacaatgctatacttttcttttcttttgcggattttggtgaaaatattaccggaacactttctaaaactttagctgcttttaaagtaagtaattctgtatctccaggtccaacaccaattccaattaactttccttttttcgccatattatcatctttatgatttaatttttgtgaatattagttttcatatgcacttctataatttatttatagtattgtaactaatatattgtttgatgtctaattctattttttgtccaaattgtggtatgttaaaaagtaattgtacttgcggtcattcaaataatgaggtttcttcatcaaatggggattctgttgatttgtttagctttcaaaagccaagatcttcttctattttagatgatgaaattcctgaagtttattctattgaagaccacaggttagatgaagatacagtttcttatcttcagggaaaatacccgcacattgaaacagacataattgaaaattttccttttgaaacacctagggtggggcagcttgatattatacaggatattaacgatgcaattcgtcagggatataaatatattattttggaagcaggaacaggaacaggtaaatctgcaatagctacaacattagctaaaatgtacggttctgcttatattttaacaatgacaaaacagttgcaggctcaatatgctgatgagtttgatttccctttagttaaaggtaggcagaattttgcctgtttaaatgataatttagagtctacatgtgatatgggaacttgtaagacaacgccaacttcaagtaactttttctgcccatatggtgtagctaaaaatcctactttagatgcagaattagcttttgaagattcttatggtggaactgtattttatcaatcaggtcagcactgccattattggaatcagaaggcaaatgcagttaactctccaattactttgatgaactatgactatggaattctggagttaaattatgtaaaacattttggtacaagatctttattgattttagatgaagctcataatattgaaaataaattaatgaagacaatggaagttaatttatttaattaccgtttagagaaggatattaataaagtaatatctaaagaaacattgaaagacggggaacttgaagactggataatggaaattgcagctattacagaaagctatgaagatattgacattaaagatatttctaaaaataaggcggatagagtgaggtcaactatcggaaggcttaagtcacttaaaaataacctggaaaaagaacctaaaaattgggttattgatgcggatgatacaggtgttacatttaaaccattaaaagttcatcactatgctaccaataatttattaaaatacggggatgttgttatatttatgagtgcaactatcctttcccataagatgttttcaaagtggttaggtttaaatcctaatgaagtatatcatattaaagttgacagtccattttcaaaagaaaaaaggcctattattttagatttggcaggtaaaatgtctgcaaacaggattaaagatactgcacctaaaacaattcctattttgcaaaaaattctggaaaaacataagggcgataaaggtttgattcataccaacagctataaatgtcaaaggtatattaatcggaatttgcctaattcaaggttaatttcacatacttcaaaaaatagggaagaggtattaaattattttgaaaaagatgaaaatcctttggttttggtatctccgtcaatgagtgaaggggtggatttgccatacgacaaatgcagattccaggttatttataaaattcctttcccttatcttggagataagcaggttgatatgagacgtagaagagaccaaaaatggtatgcatataaaacagtaatgactcttatgcaggcttatggtcgtggaatgcgtgcagaagatgattcttgttatacttatatcttagatagtgatgttaacatgattcttaaaagtccattatatcgctctttaatccctgacttctttaaggaagctattgtcaggcttaaggattaaaatattttaaaaaaagtacggacctagggggatttgaacccccgacctcaggatccgaagtcctgcgtcattcctggctagactacaggcccaaaatagtatttattcttttttatttttctttgaatcaacagagacaataggaatttcatctatttcttcaacacttgagaaaatatcgtcaatagattcattatctaaactagctttttcgtattctatttcttcaatttcttcttgactaagtcctttttcttcttcaggtctttctttaggtaatgggacatcgtccagtgttgcttgtttggtgtgggtgactccttctaatttggaaacaggttttttaaggttttctttaaattcaccaatgtcaaattctccaattttgtaagattctttatctaaagggatattactttttggaataattttttcttttggtttttctatttcttttttttcagctttttcttccctgtctatatttttaattgaactagctagtttatctgcttgtttaaagccaaatattttgtatgctccaattatcaccaacagcactccaattattatcataactgcaacaatactgttgtgttctccggaggttacattgtcaataactctatcactagctcctataaacataataatggatccaataagtaataatattcctatagctaaactaactattccacttacaggagttccacctatttttgcatttaatagattatcaaagccttcagaaatagttccgtctaaggaatcagagggttcttcgctgtattcttcattatcttcagaaaattcaatatcatctaatttagtttttatgatgtaatcttcatttatttcttttttttctaaattttccccgggtgttgaatcagaatcagggcgataaataaattcatcatctatttcgtattctttgttgtcatctgtgtcatgaaggtatgcaagtaattcttcatcttcttcatactcttcattgtcttttacatcgaatacatcttctgaattgtcagcagattcgtttatatcttcatctttgacattatttagcatatcctttaaattagaaatcctatgctcattttctttagattttttcataaactatcctcttaatcgtattctctccatgtgtgtccacatttaagacacttaaagaaacgtgtttcagcttcatcagcactacgggtttgttgtaaccaccatgaagcttctgtgtgaccacattctggacaaaccgcttttgtagttggaagtgtatttacatcttctcctttttcaataacactatcattttctttaattttttcattaacattatattctgatttatcttttgataattttttagtatatccgcaactacattttaattcattgtcttctgttggaagtaacattgatccacattcaggacaaaattccatattttttaaccccttatataattttttcttatcaaaacttttataacattttaaattatattctcaagttatttatatttttactattttttaacattaaaatttacttgaaacggcatttaaacaatcgttaataatttttgcatggtcgaaagcaagttcgatgttgaccaaatctttttgggaaaaaatacctatttcacaggcatcactatctgcttttttattatccatatttcctttggctatataagctacggttattgtgtgcccacgagggtctctatcaggttttgagtaaacattaactaaatctaacagttctacatcaatgtttgtttcttctttagcttcacgaatagctgctgtttctacagtttcaccatattctacaaagcctcctggaagagcccaatgatttttaaatggatcattttttcgtttaataagaataaaatcagtgttttcatcaaaaataaaaatgtctgtggttaatgaaggaattttataatctcccatcatatcccctcaaaataaaataagtttttattgaagttataaagtttcttcaataagttttttaaagtctgcagcatcatctttaagttggctagctgcttttttcaatactttccttggtctttttcctcttttggttttgatggtcatatttggttcaccggtaagaggatggtcaatattgtaaacagcatattcaacatcactatcttgcattaagatgtgtctaagtgcattacatactccgtggctttcgccatgtacaataaattcaagttctaatgttttatcttcaataatttcaatattggtattgttatccatcatatcaaccttaattagctattaacataatttatagaaacttcacgtttttcttttttcttacatgttctacactggacttcattttctttttgtgtggtattcatataatctctgcaacgggtacacattgcttttaaaactccacaatcttcatccactgtagctaaatcaacattatctccagtaatttttactacttttgcttttacaatatctccaattctaaaagcatctgtcaatttatctaaatatcctgattttgcttgggatatgtgaattgcacccatgtatggaagtgctaaaggtctactactatctgttaaacaatcaatatttacattagctctttgagtttttatatctgtaatctgtccgtaaacagtatcacctaattttaaaagagcaggttggctagatttggcttttacagtaatagtcctcatttttgaatcaatttgaacatttcctaatactgatgatttaatctcgccgttatcttcataagtaccttttccaagtaaatattgctcaattattcctagtttatctccaggcattacaaatgccccgttttttatactcataatcaaatcaccaaaataaggaattattaatattaatataataattttatttttattaatatttaaaactatttgtacctttcatggaataaaatttcatccaattggtaattttcccattgtcttttatttaaaactatttcaagttcctgtggtgttaataatggttttttatacatttgagaatcatcaatagctattcttggacaggctgaaacaacaaaagcatctaattccatgtatggcagtaatatgtcgggatttatattgtccgccattatgatatatgcctccattttgttatcttctagaatttttttgatttctttagctagtttcattctgtattgtccctctttagaagaaactattattccccatttttcagcttctcttgcttttgtaattcttgcaaatctgattctcaatattctgtctgcaaaagcactgatatctcttatttcactgttatatgggtctaaagccaatactggtgatttggtaaataaataaattcctaatggatggaaatttccgctacctataaataagtaaacttcagcgtccaaatttttgattgatgaaaaattgcatcctaaaacttgtccttttttagtatttttagaagatccaagaactacttcttttccattgtcttccaaataatctttaatttcatttaacaaatgtaagtgttgtgttgtagttacaagagctatttttgaatagtcttctagtttttcaagacatttttcaaggtcttttttgacatcaatattagaaaaagcttctatgaacagtgtcggcacttcatattttaatggaagtggggtgtggccataatgaacgattaaatcaacggaacctttcattttgtaatcacttacatcacaggctccaaaacaagggtctccagatattatcacggtagcaggagtttgtgattcaatagcctttgctattttaactgcctgcattttaagaccttccggaaattgaagacctacagttctagctccttttttattaatctttcttatgactttgtctaagtccatgttatacattgacattttaatcttcaatggttttttcgataactactttgccgtcaattacatctaattttacaactgaaaatattggaatgccagtttctttttcaactaattttttgccttctcctttttcaataacagctactgcagcttttatgtcaatatttaattcttttagtgcatttaaagttgaaattaatgttcctccagtacttacaacatcatctattaaaaggattttttctccttcttttaaatcatttatatataatttagaagacccgtagcctgttttttgacttatttctttttctccttcaagtccatattgtcttttacggataattacaaatgggatgtcggtagctaaggataaagctgtagctaaatgtattcccatagcttcaatagcgactattttatcaatatccatatcaacatgttcttttacaacatttgctaattcacgaagcattgaaggtttcatagttggaactccatcacttataggattaacaaaataattataatctccttttttaacaataggagaagcttctaaagattttttaacttcttctaacatttatctcacacaaaaatttaaaaattaaatcaaatataatatatatttaatataaatattaatataaatttttcttaaagaataattttaatcgtgtgatattatggcgatgcttggaaatttaggtgaaaatcttactaagactatgaaaaaattagtaggaatatcagttattgataaaaaaacaatagaggaagttgtaaaagaaatacaacgtgctttaattcaatctgatgttaatatcgctttagttttagatttatccaaaaaaattaaaaaaagggctcttgaagaggaacctccaaaaggtattactccaagagagcatgttataacaattatttacgaagaaatggtaaatctgttaggtggtgaggcaccaggattggatattgatgttaaaccttataaaatcttgttcttaggtttgcagggtagtggtaaaacaactactattggtaaattatgcagatatttacagaaaaaaggttttaaccctgctgttgtgtgtacagatacatggaggcctgctgcttatgaacagttaagacaattaactgaagaaatgcaggtgccgctctatggagatcctgataataaagatgctcttgatttggctcaaaaaggtttgaaagagtttaaaaacaggaaagtcattatttttgatactgcaggaagacataaacaggaagaagatttgattgctgaaatggataccttggatgatattattcagccaactgaatctattcttgtaattgatggaacaattggtcagcaagcaggtgaacaggctaaggcattctcacaggcaactgatgtcggttctataataattaccaaacttgacggttcagctaaaggtgggggagcaatgtctgcagtagctgaaactggagctccaattaaatttatcggtactggtgaacgtattgatgatttcgaattgttcgatccggcaagatttatttcaagattgcttggaatgggagatatccaaacccttattgaaaaagccgaagacagcattgatgaggatatggctgaaaaaaccatgaaaaacatgatgtctggtaaattcacattggttgacatgaaaaatcagtttgaaatgatgaacagtatggggccgatgcagcaggttttaagcatgattcctggacttggaaataaggtatctaaagaggcatctaaaatgactgaagacaaaattgacggatataaagtcataatgtcttcaatgactaaaaaagaaatggaaaatccaaagttgattaaacagtcacgtattagaagaatagctatgggtgcaggtgttgaggaatcagaagtaagagacttgttaaaatattacaacaacactaaaaagaccatgaaaggcattggaaaacgcggacgttttggtaataattcaatgaaccgtatgatgggtcaattcatgaaatgattagcatgtatgatttagtcaaaaaaatattgaaagaaactaacggtcaaatttgcaaacattgtttaggacgcaaactttcccatattgtggaaggcagagataatataaatcgtggagaaaagatatttgaagatttggaaattccgaagcctgaaaactgtgtggtttgcggaaatatctttgataaaatcaatgatgaattatttaaaaagatttatgacaaaattgactttttaaatgtggaatttgatacatttcttgtaggatccagaattgataagcaaattaaaacctgggatgatgaactaagtgaaaaattcgatttagatgttgaaccaattaaaaaagaattaaacagaataattggtcgtgaaattgaaaacactttagaaaaagaagttgaatttgaaaaacaggatattgtaatcaatgttgatttaagaaaagaacctaaagttagaattcagattaatcctcttttcattgaaggaaaatataacaaattagtccgtggaattcctcaaacaaaatggccctgcggcaaatgtaaaggaaaaggatgtgaagaatgtaattttacaggtaaacagtatggggaatctgtagaagaattgctgtctgaacctattttggaagctacaaatggctggcaggccaaattccatggtgcaggtcgtgaagacattgatgtattgatgttgggttcgggaagaccttttgttcttgaaatcaaagagcctaaaattagaaaaatcaatctggatgctttggaagaaaaaataaataaaatgactgaaggaaaaacatcttatcacaatttaaaattctgtgaaaggaacagaaaagcagaaattaaggtatcttcaagtgatgcctataaaatttataaagcattggtaaaatgtgataaaccttatgatagggataaattagccagtttaaacaatttggatgaaattcatcaacaaacacctttaagggtgcttcacagacgggctgataaagtaaggattaaacatgttcataatgtttcctgtgaaataattgatgataccacttttgaaatgactgttaaaacagaaggtggtttatatattaaagaattgatttccggtgatgaagataggaccaaacctaatgttggtgaagttttaggagttaaatctatttgtgaacaattggatgttgtagaagtaagtgaaaaataggaggattaatatgggtaaagagtttacacacttaacggatagtggggtgcacatggttgaagttggtcaaaaaccagatcaaaaaagattagctatagctagtggaaaaatacatctggataaaaatactattgaaatgattcagaatgaggaaattaagaaaggaaatgtattaactactgctcagatagctggaattcaggcagttaagaatacttcttcaattattcctttatgtcatccgttaaatttaactggaattgaaatagattttgatgttaaatcaactgaaataactgcaacatgcagtgttaaaacattaggaaaaactggtgttgaaatggaagctttaactggagtaagtgcttgtttgcttgcaatatgggatatggttaaagcagttgagaaagatgagaatggacagtatcctgatacgagaataagcgacatttgtgtaattaaaaaagagaaaatctaaagtttatatactatgaaaaaaataaatatagtcaattatttttataaattaatttaaagggagtttatcatgtcaaaaaagaacgataaaattagcatgcctcaaacaggtgctggtttagtaagatattttgatgaagaaagtgtaggtccaaaactttctcctgaacacgttatagttattacagttattttagctattttctgttttgttttaagattctctggataaaatccagacttttttcttgttttttttaaaaaaacaagctattttttatatttaggtaatttaaatgttaactaaaagaattattccttgtttggattgtgatttgcaagttcctgaaggaagagtggttaagggtgtagaatttaaagaaattaaatatgcaggaaatcctgtagatttagctacacgttactatgaaatgggtgctgatgaaatagttattttagatattacagcatcttatgaaagaagagcaacaatggcagatgtaattgatcgtttgactgaaaatgttttcatacctatttgtgttggtgggggaattagaaaggttgaagattatacaaaaatgctgaaagcaggtgcggataaatgttctacaaacactgcagctattaaaaatcctgaattgcttactgaagcttctaaagttgttggttctcaagctgtcgtcgttggaattgatgcaaaaagaagatatgtggataatccatcagatgctccagataaaaatgttgtggaaactgatgaaggatattgctggtttgattgcagtatttatggtggaagagaatttactggtatggatgctatagaatgggcggtaaaatgtcaggaactgggtgcaggtgaaattcttttaactagtatggacggagacggaactaaagaaggttatgacattgctctaaataaagctatcaatgatgcaattgatattccggtaatagctagtggtggcggaggaaatcctgcacatattttagatgtatttcaaaaaaccgatgttagtgcagctcttgcagcaagtatttttcattttaaccaatattcaattaatgatgttaagcaatacttaaaagaaaataatgttcctgtaagattatgataattaaagctccgattgacctggaattaactcaaaattcaggtcaaacatcccaacctccctggaaattggataataatatttactctgatgttgttgtagctgacaataaagcggttttatttcaagttaaacaaaaagaaaataatttggattttaatttcattggggatatttctaataaggaagctaccaagaaaataaagactatttttgatttggattttaatttaaataaattttataaatatttaaataatcagccggaattggctgatatgactaatttttgtagagatttaagattgtttttagctaaagataaatttgaatgtgtgatttcttcagtatgctctgcaaataattcaatagtcagatggacaaaatccattgatgatattaaaaaatcatgggggaataaatacacttattctgaaaaagattattttacatttcctgatgtttctgattttaaaaacatatattgtgatgatgtagaagagtttgagtgctgcagcaatctgaataatcctggagaatgtatcaataatttaaaaagctgcggtgttggatatagggcaccatacatgaaaaaagccagtgaaatttttacacttgaaatggaccttgatgatatttcaaaaatgtcttatgatgaggcatttgacacaatgctgaaagttcctggtgttgggcctaaagtggctgattgtattttgctttatggttttaattttaggcaagcgtttcctactgatgtttggattaagcgtatagtctcttatctttattttgatggtaaggatattaatgtttctaaaataagggaatttggaatggaagagtttggagattatgcaggttatgttcagttatatttattccattatgccagaatgtccggtctgatgaaaaaacttaaaggaatgtgatattatgaaagtaaagtatgttacaattattgtagatgatatggataagtctgctgagttctatacaaaagttttaggttttgaagttgaggaagtatttgatttacccggcggaaaaattgtcctgcttggcaatgggaatgaaacaggttttgaattgatacaaaatagtacttttaaaacgggtttttattctgtaggtctggacgttgaagatatccatgaggagctggaaaatttcaggaaaaataatgttgaaatagctatggaagcaactagaatatctgttggcatgatggcaagggttattgatccaaatggtgttaatatagttttgattcagcatgatgaaaaagaatagttaaaaataactatctttcttcaacatgtaaatggagcattttgtctccttgttggattttatttacaacatccataccgtcaccaataacatgaccaaatacagtgtgtactccgtctaagtgtggttgtggggaatgtgtaatgaaaaattggcttcctccagtatcttttcctgcatgagccattgaaagagcaccggttccatgtttatttgggtttccttcggtttcacatttgatggtgtaaccaggtcctcctgtaccgttaccgttaggacagcctccttgaatcacgaaatttggtattactctgtggaaagttaatccgtcgtaaaatccttcttctataagtttttcaaagttagctacagtatttggagcatcttcttcgaataattccaattcaattgttcctttttcagtttcaattattgcaactttcattttatcacttttaaattttaaatatcattaatactataaatatagttaatataagtattttatggaagtattttatgaacacaaatgaacttattgaagctgaagataaatattttattaacacttttgcaagacaaccaattgttttagaccatggtaaaggtgtaaaagtatgggataaagatggaaatgagtatattgatatgtttgcaggaattgctgtaaatgctttaggacatgcgcatcctaaattagttaatgcacttcaaggccaagttgaaaagcttattcatgtttcaaacatttactataatgaaccagctattgaatatgctaaaaaattacttcctttaacagaatttgacagattattctatgcaaacagtggggcagaagctaatgagggagctattaaattagctttaaaatacacgggtaaaagtgaaattattacagctaaagactcttttcacggaagaactttattgacattggctgctactggtcatgaagaatatagggaaccttatttaaaaaatctcccacaaggatttattgaagttccatataatgatattgaagctattaaagaagctatcagtgatgaaactgcagctattatgcttgaaccaattcaaggtgaaggtggagtaaatgttccttccaaaaagtattttgatgaaatagcggaaatctgtgctgaaaaggatattcttttaattttagatgaagttcaaacaggttttggaagatgcggaacattatttgctcatgaactttttgatataaaggcagatatcatgactatagctaaaggtgttgggggaggagttcctatgggagcatttcttgcaactgaaaaagtagctggcggttttgcacctggagatcatggaactacttttggtggaggtcctttagtatgtgctgcggccaatgctgttttagatactattttggatgaagatttattggaaaactccaaaaaagtcggtgcttactttaaagataaattaaatgaactaaaagaaaaacatgataaaatagttgatgttagaggacacggattgatgattggtgttgaattgtctgaaagtggtgctggatatgttgataaattaagagaaatgggattcttaattaactgcactgcaggcaatgttttaagatttgttccgcctcttataattaccaatgaggaaattgataaatttgttgaagctttagacaaagctctttaaattttccaatttttcttttttaaaactttttcaaatgctgttgataattccaatgtttttattttttctaaattggcccacatccactcatcatgttcatcactgatagctacatctccagtgatattttttaaatacataacaacttgaacagttcttttatggacataatcatcttgtattgcttcgtagaagtcaccaactgctccatccaaattagtctcttcttttatttcacgtactaatgcttcatcgaaaaattctccggggtctacctttcctccgggtaattcccatttgtgggggtttgttctggattttggatgtcttctaagtattaatatttcgtcattgctgtttttgactattcctctcattgtaagtccataaggtttatccattttaaattcacctgttttactctttgccattggaatatttaattattttgcctatttattttgttcattttcagtattttttcaagagtaatatttataagatattaaattttatatgtagttattagttaatagttcaactttaaagagggtaaagctcaatggaaattagtgaaagaataagatatgttgatcagttaagggcagtcagtatacttttcttaattgcaataaatgtagctatggtttttaagtataaaagtgtgggaaatttgcaggaatatgttgtttttacgacttttgggtttggtgttccgatattccttatgcttttaggtttattaatgcttgatagggattactcagatattgaaacatttattaaaacagactttgtaaggattttcattccttttttaatctggaatacattattggctttacttatgacagcatctgcaggcaagcttagctttagctttagctgtgtagtttatttcatgtctaaattcatgactcagcactggtatgcatggatgctgcttggtctttacctgtctttacctatattttccccatatgtcaggtcaacaaaattaagaggtgcaaaatatttccttatccttgcaatatctgcatcacttatctatcaactaatcgcatatatcgggtctccgacctattttaatctaactttcttcataggtccaatcctttacatgtttctgggatattatttggaaaatcacaggttcaatataaaatccaaatggctgattttactcggttttgccatatttctgataacaactgcttacatgattaattttgacatatttgtaaatggaattcaaaagacaatattcctgcatcattataacttccttacagaaaactacgtagatgtaagtgtagtggctatactgcaggctgcaggagtatttgtaatgattaaatatttgaatgatccaaaacttcaaaataataagattttaaaaagaatccataacagcagaaagttcaattattctgtaatgacaattagtagggcctgttacggggtttatttacttaaccagtcattattgcttatattgactacatttgtggatatttcatttttggataatcctgttggaattgttgtactgacctttgttttagcatttgtatgctgtgcaattattttaggtttaattgaaatgggagttccaggtaaatatataggttatgattaagcggaaaatttttttccttccttaattttaaatacaatatctaataaaaattaatattaataatttaaattacaggagtttttacaaaatggatttaaatattaaaattaatgataaaaaccacttggatattggtggtgctgatgcatgtgacattgctgaagagtttggaactcctacctatgtcatagatgaaaacagaataagggacaattataacagattctacaatgctttttcaaaatactatcctgattttcgagtatattatgcatgtaaagctaacactaacttagcagtaatgaggattcttgaaagtgaaggatgctgtattgatgcagtatctcctggagaagtatacacttctaaaaaattaggattccctggtgagaggatattatttacaggtaacaatgtaactactgaagaattgaaatttgtagctgaacaaggtgcagttcttaacttggattcagtttcagcattaaaaagattggctgaagttgtagatcctgaaggatttaaaatatcattcagagtaaatcctatggttggtgcaggacaccacgatcactgtattaccggaggggtaatgagtaaatttggtattatggataatgaagctgtagaagtatatcaatttgcagaagacttaggtttcactccagtaggtatgcactcccacatcggttcaggaatcttggatccggaaccatttaaattagctatcgaatcaacaattgacattgcaggaaaagttcacactgaagcaggcattgattttgaatttgttgattttggaggaggtgttggaattccatacactcctgaagaaaacattgtagacatagatacatttgcaaaagaaaatattgcattattcaaatctaaattggaagagcatgatttaggcaaaccaacaatgtatcttgaacctggaagatacttggtaggagatgcaagtgtgcttttaacccgtgtaaacagtgtaaaacaaagttacagaaaattcttaggtgtagattcaggattccatactttacttaggcctgcaatgtatgattcataccatcatattgtattagctaataaaatggatgcaccaaacactcaggaagtagacattgccggaaatgtatgtgaatcaggagatttatttgcaagagacaggccaatgcccgatgttgaagaaggagatttattagctattcttaatgcaggagcatatggatttaccatgtcttcaaactacaactcaagaccaaaagcatctgaagtccttgttaaagacggagaatgtttcttaacacgtgaaagagaaacttttgaagatttattcaacaaacaaataattcctgattacttgcaataggtgaaaatatggatttaaaaggattaaaattctctaaaatgcatggaatcggtaatgattttccaataattaatgaaagtgctggagaagtaatacctgaagcagataaggctgaagcatgtaggttcctatgccacagacattttggtgtagggggggatggagtattgtttgtaactccttctgatgtagctgatattggatacagaatgtttaatcctgatggaagcgaagctgaaatgtgcggtaatggtattagatgtttcggtgattttgtatacaggaaaggtattttaaaacaggaaaaaatgactgtagaaacaaaatcaggaattaaaaccattgaaattacattagaaaatgacgaaccggtattgtttaaagttgacatggggacatctacttttaaaactcctgaaattccaatggcatctgacatggatgaatttttagactctccgttagaagtattggacacaacattcaatacaacagctattagtgtaggcaatcctcatgcaatcatttttgtcgataatattgatgaaattgacatagataaatatggtccggctattgaaacacatgaagttttccctgaaaaaatcaatgttcattttgttgaagtgatttccaaaaatgaaggaaaaatgctcacatgggaacgtggagctggagttacactagcttgcggaactggagctacttcaacagctatttcaggatttaaattaggtctttttgatagtgaagttttattgcatcttcctggtggagacttaaaatttaatgtatatgaaaaagaagaagaattaggggcttttatggaaggtcctgcccaattagtatttgatggagaaattcagtaatttctcttttacttttttttataaataaccattaatcaatacaacatcttcaaaaaagaagtgttcactaacagctatttctgctacaaacccctgtttgtccagaatatctaatgttttgtcattgtcgcaaagtgaagactgaatcagctggacaattccaccatcgtttaagtaatttttcacttcatttaaaaaaagatcaataacttttctaccgtctaagccaccatcaaatgcataatttaaattatcatcaagaacttcatcattttcagtaggcagatatggagtattaaataaaattacatcaaactttctatcttttacaggctcaaacagattgccgaacagcaattcaatattttctatgttattaagtttaaaattctttttagctaattctaacgcatcaaaatttatatctgtagctgtaacttttttggttaattttgaagcatacatggccactattcctgatccggttccaatttccaaaacgctttggtcattttcaattaaaagattttcagctagcatatagctgtcttcagcgggtgtgtaaacagtttcggcagtatctattataaaattatccattaaaaatcacttctctaaaacagaatttaaatgtattgaaagataaagtatttcttcaggtgtcaaattggttattctttcagatagaagttcttcaattttcttttgtttaattgaatttaatttagctttcacttcttttttatccaaatcagtgataatgtgtcgggaatcaattaaagcatttttaacttttttatttctgtgctggaatagggcttttacaaatttagaataagttttaaaatctttttcatttatttcattgatattcaagtgtttcaattgtccgtttaattcaggaagcttgggagttaatctgacaacagtagaatccacttttggctttggaataaaactttcagcacttacaccggttaataaatcaacatcacatttaaaatatagcatagctgagagtcgggaataatctttacttccaacttttccgttcattctggatgcaaactctttctgatacattaaaatagctagttggaagtcataattcaggaatttaaatgtaattggtgatgaaatttgataaggtagatttgagatgattttgtcgaattttggaaattccacattcagagcatcatcattgattaattctacattatctatattttcttttttcaatcgattttctaatatctggcaaatattagaatcttgttcaatagctattacttttttaactcttttagcaagttcaattgttagtgtgccgattccgggacctatttctaatacaacatcatcttttgtaagattaccgaactggataatctgatctcgtttatttctgtcgattaaatagttctgtccgagatttttatttaattttatcccatattcattaaggatagcttttgttgttttagataatgaagtggaagcagcatcactattcaaggttatcacttactttctttgattcctactgtttcttggatttctgtgtttcttttgagcttttggaattggagtgaaaaggtaatattttttcttaccttttttagctgttgttgtatctagttcttgtttcactctatttacaatcatttcagcaggattatttaatgaaggtattcttttagttatatcttcgaagctttcaaatggtttttcttttctagcttcaacaatttcccacatatattttttaccaattcctggaatcaattctaatttgtgaagtcgggtactaattgcacctgcggtattgaagaattcgacaaatttttcttcgttgtttttaactatttcgcgtatactatattctaactcaattctgctggttgcagttaagttttcatagtctaattttccaagaactttatatattttgtctctttttccttttccaatatatacagtgtcctgaatttctaaatcaactcctcttttaggaactaattctagtaaagtgaaatagtcagtaccaatagcttgagcaatagctttacctttaaatttagacatatcagagtttacataacctaaactaagataatctaatataacagcatgttcttcagttgctgccggtattttttgttttttgttttttgtttccattttatcacttcacgtttgaattactccgtcctcatggaggatggaattttcttacattaactaattaattgtcagtaaggaaatattagttgttttaatagtttacaatttattttttcttaaagttttattgccactttaataaactatacttatatgttttaattgttaacttaaataaacatatctaaaattagtaatttgattatttgttaattaaaaagtaaaaaaagaagaatagtttaaaaactattcgatgatagtatactgatctaagatttcaagaatatcttccatttgctctttttcaatgtgtgtagcttctttagcaaatattaatcttaaatcggataaatcttgtggaattaaatcaacaatacgaacagctactttatgccttaaaccaattttatctttaagttcagatattattttttcgctgtcttcaacagagtatcttttaaatcttgaaagatgatttaaagtgatattttgttcgtagtttaattcattttcctgtgaaaattcttcgagagcttctttaacttttacactttgaattggttcgctctcaattatttttttcccaatcatagttatcaatttattggcttgtttgtaattttaagtgatcaggtctgataattaattcttttgctttgtttccatcagttaatgaaacaatgtaagcttttccttttttatcagtaattttaccagtttttccatggaaccttggatgtggttgacctttttggatacttgggttaatagtaatgtggactaagtctccttcttcaaatttttgaagtttgttggtaattgggttggatctgccttctcttactactttagtcatttttcttcttgatttacttctaaatcctcttgatctttgcatttaaataacctcttttatatattaatgcactgggtaaatgaatctatgttatcagctacctagtataaaatgcccataatactagtaacatagaatataaaaattataaaaatattatcatttatttgataatattaaattatttctataaagatattaatatacttttagttttttggatttgaagtaacatattaaagttcaacattttctgctgaaaacacattaatatctaaatcttcttttaaaagaccatcgatatctgctccaaactgattgaaatgctctgtttgaaggtgagctttcaatatgtccagattttcccattgttctacgaaaagtaaggtatcttcctgaacattggaatataagttgtagttaatgtttccattttccaattttgatttttcaattaaatttgcagctgctttgataattttgttttttgatgtttcgtctttgggaattgcctttgcttgaactattatcattttaaagcctccttttaaaaaagaaaaagtaatgaaattaatcattactttaatctatttttacgattggtttaatcaggtcttttggtttgtctttcattaggtataatgcatcttcaattttttcaagacctttaaacctgtgggtaaccaagagttccgggtctgcacggttggtaagtgcaaggcgggataatctttccattctcacacgtcctccaggacataatccgtttgtgatattgatatttgacataccacaaccccattctactctaggaattaaaacatcatctgctccacttaagtagtttacatttgatattgttcctccggcttttgtactagctacagcttctttccaagtgtttgttaagtttcctcctacaataaaattacagagtcaacacctgctccatttgtagcttctctaacttgttcatcaattggagcttccctgtaattgataatttctgtagctccgtactcttttgcaactttcactgaaacgggacgggttcctgcagcataaatatctgcagcacctaaaagggcagcacctgcaattgctgaaagccctacagcaccgattccaattactaatacgcttcctcctaatggtatatttgcattttcagatcccatcataccggtagaccacatatctacaagcattactgcagcttcatcagttaatccttcaggcattagggctaagttagcatcagctaaattgacatggaatctttctccaaaagcaccgtctttgaaatttgaaaatttccatccgcctaatggttctgtagtttgtgaaggataacctctttgagcagcttcatcatcccagtccggagtaatagcaggtacaattactttgtctcctactttgatatttttcactaagctgccaacttcttcaacaataccgactgcttcatgacctaagaccatgtcttttctatctccgatagctccttcccatactgtatgtatatctgaagtacaaggagagagacacatgttggtcttacaattgcgtctaatggtccacattccgggacttctttttcaacccaaccagtttcattcagttttttcattgcaaatcctttaaatgttgccataaaatccctcaatagtcttttttatcaattggattttggttaggaaatttaaaaaaatagtagttaaatatgtcaccaattgtaattttaataagactatgtttattagtatgatttatgaactatatattgtttactattggtattaaaaaaagagttagaaagatttaaagtaatctttcttaattaagcagttattggttcaccttttttagcccattgggtaactttaactgtaataggttgtgctacaaatgtccaaatgaacattatgatgaaatgaacaagaatcattattgcaatatttgcccaacttacagtaaatgcaaatgctaatgaaatgaatattgtgttgtctaatatttcaccaatggcaatagctccaatagatttgtatccgacatttccgtcttcggatctttctttaatcatacgggttaatttagcatttacaaagttaccaacaatatacgaaataaaagatgaaatcaacattcttggtgtttgtgagaatatgtatacaaaactatcctgtccttcccagaaaccagctgcaggtagcattaatgcaattgttgaaacaacaacgaaaagcaagttacagactactccaaaaagaatagttttttgtgctgttgattctccatatgtatcagctatcactgatgtgagaataaacactagcggatagattattactccgcagggaactgtaagtccccagaaacctaagtctaaaatttttacagtaacaatatttgttgtaacaaaagccacgcagaatattgctattaacattattttcttttcaaaataatttatatttaaatttatagaaattcctcctattttttaaacaatatgtattatttctggaagatttcatataataatgttctgataaaaataggatgggggtgatagtttttttttaaaggatggtgtttggaagaagattattcatcttcaaatcttcttctgtcaattaactcttgacgttttccagggttccaaccacctgatgatgattttgcacgtcctacttgttgtacgtatccggtaattctgtcataccattcaacatcttcactttctccacaggttggacatttgttgtttaaacctttcattaaagttttacaattaagacagaaacttaatgcagaactgtaagcccagaaaccaatatctgattttttagctattttgttagttaaactcattaatgaatctggatcggagtaggattctcccataaatgcatggaagatatgtccaccaggagttaaactgtggtattgttcttcgatttttattttgtcaataagggagacatctgtgtttactggaacatgtgatgagttggtgtagtaattagcacttccgtcaccttgtacgatagcttgatctccgaattgctctttatcaagagttgcaaatctgtatgcggtggattctgcaggagtttggagaacagaccatctaagaccagtttcctcttttaatttgtcagctctttcatttaagtattcaatacatttgacaccaaatttgtttgcgtctttatcttcgataccttttccaaataaggataataacatttcgttaagaccaacaaaaccaaaagataatgttgaattttggattctgtaatagctgtcttctccaactttttgtttaaggaatggtaatatatggaagtcatttaaacattttaatccttgttctcttctaagcattaatgtttctgcagctaaatccatgtattcatccaaatactcgaatacttgagattcgtctttagattggtatcctatccttggaaggtttaaagttacatatgcaaggttacctgttcttaaacagtcttgttcccagtcaccagtccagttatcttgtaaacaggttctacatcccatataatttgccattttgcccctgtaatccggcaacatattgatgaaatatgatgatccgtattttgcagataattcatggactaaatgtaagtcttcttcataatctccttttaatgtttcttcacggagtgtgtaaatagtatttgggaaaagatgaggttttccttcttggtcaccggcaagtaatgtttcagtaaatgctttttggattaatctggtttcttcttcaaaatcaccataggttccgacgacttgacctttcggaccgtatgcagttacatcctgtaagaactttggaactccgaattctaaaaccatacttgtaaacggtacctgggaacctctagctgcataagccatatttaaattataaataagcatttggacagattgtttgatttcttcataggttctgcctcttgcaaatggtgctacaaatacgttccataaggacatagcttgtcctccggacatgttttgttgtgatgcaagcataatttctccagtatggttcattaaggtttccatgtggtttggagcacctgcaacagatgtatgatctccggttccgtctactttaagtccgtatttgatgaaagttcttatatcgtgctgcatacagtttagaggtcttcctgcaaagaattctaaatcgtgaatatggatatctccggacatatgtgcatcagctaaatgtgacggaagcatttgtaaaagagcatattgttttaatgcttcatcagctacatgtttgtggatactttcagggttgtgaatcatatttgcattgtccctgttaccgttttcaattaatgaagtgatgttgtatacagggatacctaaacgagtgtaacggcttcttaagtcttctaatccatattctacaagtttggtgtttaccatttccctaatcattggcgcggttaagtattccacatttaattttttaagctctttccagacttcagtagctatttcaaatgcggtttcttgggatgcacctgtttcttcaattaaagtatttgcgattttggataaatcaaatgcttcaatggtatctctggaagtacgtacttttaattgggtactggctaagtatttgttagctatttcaccatcaatatcttctaaacattcatatacgatttttttaatttctttggttttaatgccatcataaagtgaagaaacaacctgagctacaattttatcagattcaaagaaaggagtttcaaccattactaaggattttaataatttttcatagctaaatctttctttaataccgttgtttttttcaacgttgattttcttggagttagcaagttctttcattatttcggaagtcttttccatatatgtcaccatcctataaattttgacgagagagttttctctcagttgtattaattatatattcttacttgtatatattatgttcgctttgatacgaacaatgtatacttcagttaaaattatttatcaatttttaaatattatattgaattgcaagagcaattaaaaagtattgatgttctttagaagaaaacatctaaagaactttgtttggatttgtcactttcaaaaagcgaatgaattccaaactcctgaatttctaaacgctgtcttaaataatgagacacggggtatctatttaccaaatcctgtgatatctcaagatatttagttactgaacctttagaaactgaaagtattaaatttccaccgcatttgcattttccggtaaggggcattcttctatattttgatccgcattttgtacatcttactttttgtttggaaaacgcccttgaatttcccataatatccggtaaaaagtgggaagataaaactttttccacaactcccctttgatctacagctctgatattttcagctagtgcaatttgagcttctactttttccctcattgaaggaagccttttataaagacatactgtaggtccagcatgaatacttgaggtatggtgggaaaacatcaatccttcgtattgctgtggggttcccaaatgcatttccacattatcaatgtattctaaaacttcagcaggttttaaaggttcataagttttttcataaaactcaacagggaatctttcaaatatatctaagttgtgagattcatcatctatctcttcagggtcaattcttgaagataaaactaaaggagcatccatacttcctccccttgtatttggcaggtatgattttgagaagttgattaatgcatctaaaagcagcattactgcatcttcatcactatcacaatttctacgttttgcagagtggaaataaggatgggcataacagcataatgcctttgtaaatccaacaatcctgcctaatactcctgcagatgtgtggggagcaagaccggctactaaatgtccaattaaatcagatttatctttgacattgtagaatctttccattccataatatctttcaagttcatcatcaatgaaattggcggtgcggacaaggtagtctgcacagttattggaaataacaatgtcctgtactctaagttctatgatttgctcatcattttcaattggatttccgtaacagtctttagtataacccatttcaagaagtttttcaacagtaactccaatttcttttggtatgaaatgagttagaggtaaatctgttgaatcgtgacgaattgttccatctttaaaagtaaatacttcatttttggacctgagtattcctttttcaagaggttctggcaatttggattcggaaatcatacctactactcctttcatttcatcaactttccttacttttacattgtctgatgcttttttaagcatagctgaaaggtttatgttttttacactatgtgggctgatttctgttggagctccacaatgcggacagatagattggaaggaactgattttacattgtgtacattttcttctagctaaatctactttaacattaccttttttagcagcagtagctactaatcttctgctcccaccataattgccgattgggaataatccatgtggtgcaggtctcattaatctttctttagatttttcaggtcttcctacacgagtaccaatataagctggtgccttatttttaatttcaattggtgaaacttcgtttaaagcttccagagtatgttctttaactggaatattgtctgataatgtatttattaaagcatagctgtgatctttatctattgttattttcccatcttttacggtatgtggaacacctataatttccaatactctttttctgtaatccagatcaatagtaagaccgttttctggagaatattttgatttattttcaagaattacgtcaatcaatgagtttaaatcatttactgttgcatcattatagcagtaagtgtatttcggatgtagtggaatatcatattcttcagacagtttgaaagcttcagtagcaggaatataatcatattctaagcgatgcaaatctaaagtttcatctgtgctgtcaaatttgtcgcttttttgaagtaggccaagccaccattcctcacaccatcctgaaggcataagtggttggttgtttcttaaaaattctccaaatgcaacaagcatgtctcctaaaaataggatttcaacaacctgatttttaagttcttttgcctgtttgattttatctatctttacaacatctccatttttaagctttacaataggtccttctatggagtctactggaacaacacagttaccttttccagggtattcgattttaagttgtgttccaacagctaaaaaatcaagcagtgccattgttgccggatgaactcccatagttgcaagtccggtgtttctggaacgaccatatcttaaacggaatcctcctttttcggaaggatagcctaaaacaggccttccgccaataatatcctgaatatatttcggttcagttactaaatctgtgctgtcatcatcagattttttatcatcactttttggttttgaatattcggaaagccagccccagctatctaatttaagttttttggatatttttaaaatctttttagatttctgaataactccttcaaccatagccaaaagagctcctcctctgatattgttggtttcaacacgttccaaatccctgtgggatacttcaacctggtcggtttgttctcctgtaacttctactggaatgtggttagctgcaaatcttacttcttccggtgttggggagtattgcaggttggtaacttctgattcgtagagttctacctcttccacataacgttcaatttcatcatcaataggcttaaaatcatcaattcctatagcttctttgattttgtctccaagtaaaacagccaatgcagcagcagttcctcccgcacttctgataggtcctgcaaaataaactgcaatatattttgtagaatcaaaattttctttaatctttacctgggaaataccttccaatggagcagctactactccttctgtaagaatagctagtgcagtcctgaggccctggtcacatctttgctcttcgttatagtttgccttttctttggtaagttcaaactttccagatgctatttcagcagctatttcaaaagccacttcttctctggttatatcctgctctaattctttaatacgtttagcaacaccttcaggaccaacaagcccttcaactctttcagctaaatcctttgctaaaggaacttcactttttgtttcaacatctaatcctttagaccttgcttcattagctatttcatataatgctttagtatctgcttccaatctatcaaaatagtccatgtttatctccatgagtttttaaaaattcgttattataatgtatgtttcgctacttatttaatcattggggaagtgcaaaagttatcatgtgtagttgataaagatttaaataatttaataataatattattattttgtatacttgttgttgaacgtaaatttagaaaagattattattgcttatatggtgatatagtgtctgaagaaaacgtaactgaatttgaaagccaattgaaagaaaaagatcaaaaattagataaccagtctagtgaacttaattatttaactaatgaaattattcctaatcttaaaaaagaaaatgcagagttaaagaaaattaaaaatgaattaactgaagcattagaaaacactactaggaaatattatgatcaattagatattaatgcagatttaagcgaaaaattaacaaaaattggtgctgaagatgcaattaataaagtaagggctgaaaagcttgaatctgaaattgaagatattaaaaaagatgcagaagctaaagtagctgatttcaaagctaaacttgatgatgttgatgcagataaagttgataaaataaaagccgaaaatcaagatttacattcaaaattaactgaaaaaacttctgaattagataaacttaaagatttagttcctgatcttaaatctgaaattgacagtttaagaaaacaagttattgaaatgggaaattataaagatgaagttgacgctaaagttaaaagtgaaatgaacaagcttaatgaagaaattaaatcactcactgcagaacttaaaggtaaacaaagcagttacgacaaattacataatgattcacaaaaaactattgatgatttaaaaggacaagtttctaaacttaaaaaaactttagaaaaacaagctaatagaggatttttagacagactttccaacaaaaaagtctcacttgatgatgattaaatcatcacttccatttttttattatgtatgatgacacttattttataaatgaagctttaaaggaagctaaaaaatctttagctgaaggaggcattccaattggtgcagttctggttaaagatggaaaaattatttctcgtggccataataggctaattcaaaatgattctgtaattttacatgcagaaatagatactattgaaaatgcaggccgtttaaatcatgaagattatcttcagtctgtattatacacaactctttctccctgccctatgtgttctggagccatattattatataatattccaaaggttatcattggtgaaaatacaactttgatgggtgcagaatgtttgcttgaaaaaaatggtgtagaagtagtagttttaaataatttggaatgtaaaaaattgtttgaaaaatatgtggaagaaaaccctgaatcttggaataatgaattatccaaagtagggaattctactgatgtttgtgatttttaagcttcctgtcttaatcttttaacaacaaagtctttgtcaagagataataagaatgatgctgctcttggcccttgtttttgacctaaaatcattttataaatagcttggaatcctttttgaggttttaatccttgaccttcaagaatttcgtacattgcatcgtgtaaatcttcagctttgttaaattcttttgattccattaaatcagctaatttgcctaagaattctgtctgttcgtcagttaatggtaattttggaacacttttttcctgaacttggaattttacaaatttaggggcataagtatctaaccagttaacaacattgtcaacacgttcctggaattgttttaattctgtttcattcaaatcacagaattctttgtttttaaagcttttagttaattgggaattgtttttaagaattgtaaatattttttctaaattgtttccagctatttggtaagcattaactaagaatctgtaaggcggtctgaatggtagaggactgccttcatttatttgagctatttcatagatttttttgaattttttaccttctttttcagatggtgcttcttcttcattgtagaatactttttctactttgtcaaattgatccatgaagtctaaaaatgacattttaggtgagaaatctttagctttcataggtttgcttctgaataagtagtagttaagactttcagcaggaccgatagctaaccattgttccgggctgaaaaatactccatgagatttactcatagcttctccgtctaaagtaatccattcataaggaactgggtatggtgcttcgtagtcaaatatttcttttgaaataatgctacttacatcatatgatcctccacttgctgcatggtcttttccgaatggttcgcaggtaacgttaaatattttccatcttgcagcccattccactctccatgtaagtttaccatttccggatttaatgttcatttcaccttcatgaccgcagtcacatctgtatttgatgatgtctccatcaaaatcatatgcataagtggtatttacccttccacattcttcacaaattggattgtatggtaaccagtcatctgctagaggttctcttctgtattgattgaatatttccttgattctgtctacattttccagagctgttcttatgtagtcattgtagactccgcttttatacatttcaaatccggatttatgttctatttcaataccgtatgcatccataactcctaaaaatggtttttcaaagtgttctacaaagttatcacaacagccgtcaggacatggaattgttgagtaaggcattccaagatatttatcgtaattttcaggtaatgggtatggaacttttctaagtgggtcatggtcatcagcaatccaaatagtttgagcttcttttcccaattcacgtaatttttttccgattgcattagctataaatacatcacaggagtttccaatatggatagaacctgatattgaggttccacttgcaattacatgtttatcagtatctcttttacttaattcctcagctatattttcaatccaatgtttcattacatcaccgataatttataatcataaaaataagttatacatttaatatttcttgttattaatataaaaagattaagtaaaaatgttacattattgtgaagtttatatttgtatggctaaaattctctattatctgagattattttaaaattttttcattttattttcccagatgtttttttttagttataatactttaaattaaattgaagttatttaaataaaattgtaagagatataaaaattgttttgaggaaatggcaaattataatttaaaaaaagaataaaatagatagaatctatctatttaattaagtcggaatcggactggtccaaccattcgtttacgatttttactgcacaataatttccacacatggtacatgtgtcttcttcttcaggaggtctttggtctctttttgcacgtgcagcttcagggaacattgcgcatgagtattgtgcttcccagtcaagttttttacgagcttcagccatagctaaatcctgtgaaccgtcgactgcaccagttgccaagtcacctgcataagctccaatttttgttgcaattactccttcttttacatcatcagggtttggaagagcaaggtgttctgcaggagttacataacagatgaaatctgctcctgcttttgcagaagatgcagcaccaattgcagatacgatgtggtcgtaacctggtgccacatcacatacaataggtccgagcatatagaaaggagcgttagaacacattttcttttgaatcataacatttgttgggatttcgttaattggaatgtgtccaggtccttcaatcatacattgcactccagattcacgggatctgtcgattagttctcctaaaatgatcaattcttggatttgagccctgtctgttgaatcggcaattgaccctgctctcataccgtttgcaagtgaaagaacaacatcatgttccttagcaatctctaaaacatagtcaaagtttgagtataacggattttctttttcgttttcaacaatccatccggacataaatgatcctccacgggatacaagtccggttacacgaccctgtcttttgagtctggttaaagtttcaatgttgatactactgtgaacagccatgaagtcaataccatcttttgcttgtttttcaatggttttgaataaatcttcttcttccatgtaaactacggagccgtcctttctaattctttcaatagctgcctgataaactggtactgaacctactggtaatggagacatatcaagaactcttcttctaattacatctaaatctccaccaatacttaattccattaaacagtctgcaccattatcaattgcaatttgtgcttttagtacttcttcatcaaagtcaacaatatctgttgaggttccaacagttgcatttacttttgttctaagtcctgcaccaatacctgaagcttcaatatctctgtttacattagatggaattactattgttccgttagctactgattttaaaatgaattcttcagaaacattttcctttgcagctacctgtttcatttcatcagttaaaatacctttttttgcatccattatctgtgtcataggtcatcacattaatttagtcaaatgatttttaaaaatatcaaataagttttaaaaacttatcatttttggttgatactactctatttttgtgtaatagtatttaaattaatctgattgagtttaattcaaaaaaaattgatatatctaaagtttattttaaaaaaaataagtaaaaaagagtgattaataaaattcactcattctatcaaaggcatcatcgaaagtaggcatgttagtttgacatccttgttcttctacaataaaagaggatactgatgatgcaaatttagcagattgttcaagtgattctccgtttaagaatcttgataaaaatcctgccctgtaggagtctcctgctccagtaggatccacagcttcacgaacaatagcatcaattttgattttttcattgtttgaatagatttcactcccattagctccgcaggtttttacaataattttaggaccgatttcccttaatccgtctaaatccacttctaatgattccagtattcttctaatttcatgatggtttccaaaaaggatggtagtatttgtaataacgtctcttaatttgtctgtatcgtacattccaagatcctgaccagggtcaaaagaaacaagtaaatcctgtttttttgcttcttcactacatttccagttaaagtgaggatcaccagtagctaaatgaacagcctctgcattggatattgcttgtgtaggcactttacttgatgcaaattctttagcagctccccagtagaaatagctaatctggtcatcattttcatcagttaaaacaaatgctgtaggacttgtttctccaggaactatgattaatgaatcagtatttacatctaaactttccattatttcataataattggattttttaaagtccccacctactgctgaaactaatgatgtttttaaacctagttttgctccaacaagtgcaacattagctgcagcaccaccattaaatgtcttcatatcgtttattggtgctgagaaattagctttaggaaactctggtactctaatgatataatcaagtgcagaatgtccgatagatagtaaatctctgttttttgccatgttcttttctccttttttgtttgtctatttattgtttattttatgatttttaaaaaatttttggttgctttggtataaatttttcaacaaaaataacttttatatgtttaattaaatttttatttccttagggcatttgaaaacttttaatcaataggaatgaaaccctggtttttaatggctgtttgtccatcagttaacagatattcaatgaattggtccaactcttctttttcatcatttacttttattaaactgataacatgccttgtatcgaactttaaaatgtcatttcctttgaaataactggcatttaaaaaactatataaattttcagaatttctgactaatttgaatgcatcaaattgtgaatttacatttgatttaattttataattgatgtcatagtgttctagagtattccatgcaagcctttgggcagaaccctgaacatttacaaaattcaatccttctaactcatgtatacttttaataggtttggaattggggctggctatcagtaccagataatcataagctattggaatcatattcaaatcccgttcaaaagctattagtggatcatctaatgttaataaatctacaacacctcttttagccagtttaaaagcatcttcatcattgctgctgtaaatgtttgtattgaatgttgtatcaatactttctaaaagccctgtactgatatggcctccgcagatattgatttcagaggttttatctatttggattaaatattttttatactcttcaagcaatgcttcgccttcaggtgttaataaagtaccatttccctgtttttgagtaattttaactcccaatttgtcttcagctttaagcaatcttctattaaaaacagtatgtgaaatatttaactctttagctgattttctctgtgaacctgttttagctaatgaatttagactttgatataatttatagtcataaatttcaccatttatatctaaattgatgatacctttgctttttagtttcataattaattatatataaagctgtaatcataattaataatattgttttgataatatattttgggaattggataagatggaattgatgaaaacttcaattaaagctattttagataatattgtttgtgctgaagaatttttagatgaagatgctattaatgaatttgaagacattataatgaactcaaaaaatgtttttgtaactggtgcaggaaggtcaggtcttgcagctaaagcttttgcaatgagattaatgcatttgggaattagttcttatgttgttggtgaaactatttctccagctatttatgatgatgactgtattatagctatttccggttctggagaaaccaacactattgtatctgcagcaagaatcgcaaaaaataggggttctaaagtattggctgttacttcatatcctgaatcaactcttggccaattggctgacggtcatttacttgttaaaggaaggactaaaaaagaagtggatgatcaaaattatatgaaacgtcaaatatacggaaattatacttctttaactcctcttggaactgcttttgagttaactacattagtatttttagatgcaattgtttccgaattaatggaaaaaatgcatcaaacagaaagtgatttaaaatcaagacacactgttttagagtaattttaactctaaaatattattctatttttattattgtaaacattaaatctttgacctcttaaaaatccaacaagagttacatttccttttttagctgtttcacatcctgaatatgccggagcagcatttgatgcaagtaccggtattccggatctaactatttttattaccatgtctgcaggcattctgccgctgtaaattacatagctgttgcttaaatcataattatgcaatatgccatagccaataactttatctactgctacatgtcgacttacatcttcttttacaatgaaattatttttataaacaattccagctacatgtgtccctcctgtggcctgccagatttgagcattatttttcagttcttcaattctgttaatcagttcatcagcttcaacctgaaaatcagagcttatcggttcaatttcttttattttacttctccagcctcctgaagaatcggaacataaaactgtttcttttgttttaagaagtttatcatcaatttctacattaatatgattttcattgatttcaattttttcaatgtcatctatggattttaccatattctcattaaataaataacctacagcaaattcttcaagtgaatcttcaattgcagataggctgcggctgatttcattgtttattgttaatgttatggtagaatctttaacgactttttctgtaacataatttatttttccatttttataattttgggctttttcttccattatctgtttcatataattcccctttaattcattatttgatttttgaatataaataacttaaaagttttagtaaattatttatctctttaagtaaataatttcatatcaatatatattttatttgactgaatgtttagtgatatttatggaaaagaagagtaagattattattttaattttggctgttttagttatatgcggagttgctgctcacttatttttaactccttctactgtagaaacagtgggatctaaaaatataactgatatggttggaaggacagtacaaatacctgcttctgttggtaatgtggtagctactagtcctccaatgactactgtaatttatatgattgctccggagaagttaactgcagttaatttccaatggactgatgacgaacttaaatacatcccatctcaatatgccagccttcctgttgttggaggttggtatggaacacaagatggtagctatgaagaattcatagcatctgaacctgatatggttattgaatctattgatgagggaggagatggagatttagctactgttcaagaacgtcagaataaatttggtgaaattcctgttgttgcagttaatgacactacagatgttgaaaaagtcgatggatcaataactttcattggagatgttttgggagcacaggacaatgctaaaaaattaacagatttcaatgataaatatttgaatatcgtacatcagaaatccggccagattactgataagaaaacagtatattatgctcagggtaatgacggacttcaaacaaatccatctaattcaactcatggccaattaattgatcttgttggtggagaaaatgtggctaattctttagctcagggaaatactacttctggtattcaggtatctatggagcagattattaaatggaatcctgatgttattattactaccaatcctgatttctatggaaaagtatatgacaatccgaactgggcagggattacagcagttaaaaatcatgatgtgtatttatcaccgcagtctccatttaaatggtttgacaggcctgtcggagcaaacatgattattggtgttccatggactgcaaaatgtatttatcctgaggagtatcaggatatagatatgatttccactactcaggagttttacagtgagttttatcactttgatttaagtgatgagcaagctaaacagttgttgcttgattcaggacttaaggagtcaaacttgtaagggatttatatgaatgaggaaaataaggaaatattaagtattgtgcttttagttttccttcctataattcttttttttgcatcttttttgattggaagatatccgattgacccggttgatgtgattaaaactatattgtgccctatatttccacaattggaagtgtctcaaactattacaactattgtatttgaaataagacttccacgtattattggggcatttgttgtaggggcagcattggctatggcaggttctgcgtttcagggaatctttaaaaacccgttagtatcttcagatttgctcggagtgtctaacggtgcaggttttggagcggcattggctattttactttcaggattaaatgttgtaactcaaatattcgcatttgtatttggactgatttcagtatcaattacatatttgatttcaaaatcttataaaaacggtggaattttagttttagttttatctggagtagctatttcagcattctttggagcattagtttcagcagttaagtttatagctgatcctgatgataaattacctgaaattgtctactggctgatgggaagtctggcttctattactgttgataaactgataatgatttcagttccgataatcattggcgttgttgttttaatgttgcttagatggcgtattaatctattgtctatgggtgatgaagaagcacaggctttaggtttaaatccttcaagaaccagactggttgtaattgcagcatgtactttacttacttccgcggcagtttccattagcggaatcatcggatggttaggtttggttattccccacatgacaagaatgattgtaggtccggataacaagattctgattcctgcttctttaagtttgggagccagtttcttacttttaattgacaatatatccagagcagtaatttcaattgaaatacctataggaattttaacagcagttatcggtgttccgatattcttgtatttacttagaaaggggtattcagaatggtcgtagaagataaaatattggaagttaacaatatatccttttcttatgaggataatttaatatttgaaaacatcagtttttctataaaaagaggagatgtattatgtattcttggaccaaatgggacaggtaaaacaactttaattaaatgtctaaacgggttgcatgatattgattccggtgaaattttaattaatggtgaaaatattgaaacattgtccttttctcaaatttctaaacatattggttatattccacaatcacatgttccgtcgtttccatttacagtttttgatgttgtgctgatgggtagagcaccatatcttaatttaactcagtctccaagagctgaagatgagaaaatagctataaaatcattaaaaacattggggatatatgatttaaaggataaagaatatactaatcttagtggtggtgaaaggcaactggtatttttagccagagtacttacacagcaaccagatattttaatattggatgaaccaacatctcatttggattttggtaatcagattaaacttttagaaattattgataggctggcggaagcaggtttgtcagttataatgtcttcacattttcctgatcatgcatttttaagctctactaaagtagctattatgaaaaataaaaagttcattgattttggagctcctggagatgtagtaactgaagacaacttaaaagaagcttactctatcgatgttaaattaattgaattagatgaaaatagaaaagtttgtgtacctatgaaaacaaacttaaaattagatatataaggtgataaaatgatgactgaagaagactatgatgaacaattagcaaaagcaggtgatttccacggagaaatatgtggtggaatagctattggaactaaattagccatgtatggtttagatttaatggggatggaattaaatcaaagacacaaaaacttaattgtctttttagaaatcgacagatgtatggctgatgcagttcaggctgttacaaaatgttccatgggtaaacgttcattaaaacaaatgtattatggtaaatttgcagtaactttctataatatggatactggtgaagctttaagagtatctgatgctgatgcaaataaaaaagataaatctcaggaaaccagagaagaaatgattcaccgtttcagagtcactcctcctgaagagttatttaatgtagaaaaagttaaagtagaattaactccatctcaaatgcctggtaaacctcatacttctgcatggtgttctgtctgtggtgaaaaagtaactgatggacgtcatttggtaagaggcggaaaacctatctgtatttcatgtgcagaaggttcttactatgaagtaattgaagatgatgaataattaagccacattttgtggcattttactatttttttttaaaataaaaaaagttagatagtaaataagtactatctattttggaatttcactttcgggaacattataagtgtatattactgtttttggcctatttggatcaaatactgaaaatccttctataatattgtttgatgagtcataatttttagttgaaaactcaaaggtagcttttccttggtgtacaacaacttccactacttcttctttatcagtattatagtttaatacaaagtatgttgttaaatcgggaagtttgctagctatgctgccattattgtagaaagttacttcgtattttccaggggaaatgcagcttatgttgtatggaattagggtagtatgaatcctaggacagattgttccgggcccggtttgatttaatccccaggttgtgtacctgtttgttccgtaccagttaggtcctaattctaattttaaggtgtcattccattcacccggtccataaattccattagggttagcactaacttctcccagaattatttggcttggtcctttagcattattgtaaatggcattattttctacaacaagaacagctcctggagcataggtgtagttttcatttacagttaaaccttcaatggtactgtttgaaatttcattacctgtaattacaattccgctacagtttttagcatcaataaatactcccatgtagttattattaattctattgttggttacagttacatttactccggaatgcctcatgcttattccgtatccataaggaccttcaatcattgtcatggttttaaaaccaatattttcaataatgtcattgtcattaattaaggtgtttgaagcacccttatcaaattcaacaccgaaattgtttttggttatggtgttcttttgaatggtggtgtattttgcaccatttaagtaaatcccattgtaataatattggatgttgttgttttcaatgactgtgtttttggagtttaacagtgcaataccatttccaggaagtaatgttttaccagagttatagttgtccatattgcttttatttaataagttgttaatgttgttattttcaatgactgtatttttaacattattaactacaattccagacacattatttccattaatatttaagtttttaactaaaacattgtctgctttaatatttaaaacacaggtatttaattttccgtttaatgtggtgttgacatcacttgtaagaatgatgctttttgtaatgtctagggaaatatcattgtaaaatttacctaggaatttaacagcacctttattatcgatagagtttataatattttgaatttcgctgtttgtagcattttctttaactacttgcggatttaaaacaacgactttggcacttgcaaaagttgattcatgtgtaatggttgcaatatattctccaggatttaagttaatatttaatttagctattccatttacatcagtaattttattgtagaatactccgttgatgttgtaagttacagtttgattagctaaaggattgccttgcccgtcaactaattttgaatttaatgaagcaggaattccaaagtattttgttaaatcatcagcagtcaatacaggcaatactgtgatgttgtttgaaacaaagcagttgttgtatattgcggttattatgtattttcctgggtgtaaattgatgtttagggtggctattcctttgtcgtttgtggttttggtgtagaatactccgttgatgttgaatgttatttcttggttagctagtgggtttccttgtccgtcaagagctcttacattgtattgtgtgccgtttttgtagtattttactaaatcagtattttgatccatgttaggcaatactgtgatgttgtttgaaacaaagcagttgttgtatattgcggttattatgtattttccaggaagtaagttgatgttttgagtggctattcctttgtcgtttgtggttttggtgtagaatactccgttgatgttgaatgttatttcttggttagctagtgggtttccttgtccgtcaagagctcttacattgtattgtgtgccgtttttgtagtattttactaaatcagtattttgatccatattaggttttacaataattgtgttggagattgactcgccagttgctgtgtttgtacttgttattatgtattttccgggaagtaagttgatgttttgagtggctattcctttctcatttgtaattttggtgtagaacactccattaatgttcatagttacttttgtatcttttaatgggtttccgttactgtctgtaagttttggatagtactgagtttgatttctaaagattttttcaacatcttctgcagtaattgttggaattactgttattgtgctatttaatgtagttcccttgtagtcatcagttcctgcatatgttgcagttacattgtattgtttgctggaaaccaacctgatgttcatatatgcaattccatctttatcagtggttttattgtaggttttaccattgattgtaaggctaatattagcatttgcaattgcagttccatcattgtcttttaaaatgtagattaattttcctccgtagtaaatatttgtattttggatggttaaatcactacttttagtatcatttgacggaatgtcggaatcaggtatattatagtatgcacatggtcttgttgaagtattagtttggcttattgtaccgtatccaggtccaagagcaatcaatacattttgggtaggtttaaaagtagcatttttaaagtttacagtagcagttccatttattattgatacaatttgatatgtatctcccggttttatgctgctgtcagttccttctttatttaagaagaaagttacatttccggcacttaaacattttactacttcaccggtttttgcattaataaaggttattttatatatgccttttgatattttggtcatttctccaaatatcatatcctgtgtaccgtcttttaatattccaggttcatagaatgtacttggacaaagctgttcaaaggaatatgcattgcttccaacataaatgattccggtttgtccagcttcattttgctgtgcaaagattcctctagtgttatgccctacaaaaatgttgaagttaatttcctgtgatttatagttttcttcaaaactttctttagttttgtaagtatcaaatattccgtaatttccattttcaaaaatgtaattgccgtttatttttaagctatctactgcacagtcaacatatattcctgctccgttttttgctcttgcttgaacaggattgtccctatttgccataatgacattgcttattatgttcacattatttgcagaattaacaacaacacctttccaattatttttcacaatgttgttgtttattatgttgatatttttattgccttctccaatgtaaattccggaatttttattattttcaatatcattgtcttttatagtaattttattattattttctattaatattccattttgggaatattggatattgttattgttaattgtaatgtttgaagcatcttttatatatattccaggaccattggttacctggtctattatattgttagttatctgaatatcttttgcaccttcaatataaactgcatacggatcaacttctccgtttttagcagcatcatttacaaaagtaaatcctgaaagaacagatcctgatgcctctgggctgaagtaaaatatcccaacaccatttgatcctttaatattacttgggcatgtagacattgttgttcctacattacttatgatatttaattttttatctacgacaaaatggcagtgttcatagttttttccagtaatttctatggtgtctccagcttttgcattatttattgcagtctgtattgtcgggtcgttcatttgattttctgcagaaccatcgacaacatatgtggttcctagtacttcatgtgtttctgcctggcttattgcattagtgctattgtccatatctgcagcactaatgccttgtgcaaatgcaaataacacgaaaatacttattaaaattaatattattttcttattcatattatttacctcatattttatagcgatatgattaataataaatatcatatctgttgttatatatttgttgtcttttgatttgggaggttaaataaaaaataagggatggacagcaagagcgtctaaaatttttaaaaaaaagaaagaagtagaggttataaaacctctaatttaatatttattggttaacagttacgtgattaccaacttgataaccgttatattcggaggtaatgatgtattggcctggtaataatctaatatttaagctagcttcaccagcttcgttggttgtttttgtgtataatacaccgttaatattaaatttcacagtttggttagctaatactttaccttgtccgtctaatgtttttgcaacaaaacttttattttgaccgtaagtcatttctaagtcgctggtttctaaagttgagagtacagtaactttgttggatatttgaatacctccgtaaatggtagtaatgatatattcgtcaggtaataatttaatacctaattttaccataccattttcatcagtagttttggtatagaatacaccgttgatgttgaaagttacactttgtccttctccaacaggttttccttcaccatctaaaatagtagcttcgaaagaagtaccgtttctgaagtataaagtaatgtctttagtgatgatgttggaagttacagtaataacatcttttgaggttatggtatcatttccaactttacatgttgcagtaattgcgtaatcgttaggttggaggttaatgcccatgaagatattaccgttttcatcagttacttttgtgtattctcttccgtttatttttaatgtaacagttacattttcaatagctttgccgtttgcatcagttaaagtgtaaataagttttccacctttaatgatggtagtgtctttaatggttaaagcggttttaccggatacgcttacttttactttggattcggatgcaccgtatatgtatccgttggtacttgttgtggttcctgcataagcaatgtttaaagtccagtctccaacgcctaatccttcaacagtgaataaaccaaatgcatcagtagtagcttcgatagttttggttatgtctccgctggtagcggtaatggtaacttttgcattagggatagtaataccgtttgctgcaagtaattgcatagtgattgagtcaccaacagttattgcagtagttggtgcttttacggtagtgtctaaagttatagggctaataatgtaagtattattgtcaccttcccagtttttatccatgaatgatacaggagtgattcctttttcataagtgttgtcagcaacagttatggttccgagagggagtaaaggaccaccgttactttgaatatggacagcatcgatggtgtaagggttggtgttgttgtaagctttaaatatattgttttgaatggtaatagtttcaatgttacttggataaccgtgttcggtgttaccttgttctatgtagataggagtacaggttccagcgatggtttttccatttgctgttacggaataatttccagtaatgaaagtgttgtttattattttggtttcaccagcagctttaacaagtcctaagtcataaactttgttgtttatgaaagtgttaccttgaacaacaattcctcttactcctcctccgtagaatacaccgtaccagttttcttcaaaggtgttgttaataaattggaagttgtttttagagttacttgcaatggatactccgtcaagtaaatcttttccaaagtaattgtttagtattttgtggttggatccacccataatagctactgctttggtacctatttcttttttaccaatggttgttacatcagtagttccaataaatgaacatccgtcaactgtaatgtctgaacagctgctggttcttactcctgcattaccgtttgcgaaagtacagttaataactttaatattagttacaccggataaatcaattccacgtccgtttattaagtttgcttgttttatattgaagttaatgttttggaaaacagttccttcaacactagcacttttactgttagctataaatccattgtcacagtcaatagtagcattgtttccttcaataattaaagtatgtggaatagttatagcacttaatacttcagaactatgccagttgtaaacagcatctttggtgaagttaatggtatctccactttgtgaattgtcaattattttttgtacatcttcgtaagttgcacttgaatttacattccaggttttagattctgtagcaggttcatttattactccgcccatatcgatgctggaaatttctacagcttcaacttgttctgcaggggaagatactacagtactagcagcatcatctgcagctgaaacagcagaaagtgaaacagcagcaataaggacaatcaataatgatactaaaatcttattgtttattttcatttttaatttctctccataaaagttataaattagctaataacatctaacgacaaaaaagatagttactatcattaaggtattattagtaatttttagttatgtttctatttagtatataatcgttgtgtttcttctttcagtttgttttaatgtaagctttgaaaattcgatagcattggtgtaattgtttgtttttgttttttaattggaatttaattgaattgtttgtgttatttcattttttaatgttttataaaaattttaagatttttaaatgaaaaataaccgaattacatgatatttatattataagatttatgtaataattaaattacataattatttatattacctatcgctataatcatgtatataattacaattttcgttctgtaattaggtgaataatttaaaagggggtgaaaatatagttaaaaaagtgtttttcatttcaattttaatattctttttggcaataaacattgtagctgctgaagacagtgataatgctacagctgatgcatatgataagtctcaagtagaaaatgttgtattgcagaatatagaaatagataatgttcgattaaatacatctgatgtgtcagtattttctaaaggtgaattttataatgctacccttacttatgatgatggaactccagtttttaataaaacaatcacttttgatgttaatggagtcaaatacaataaggtaaccaacaatcagggtattgcaagtttgagcatacgattaaatcagggaacatatgttatttccactagttttacagattcttatgacagaattttaactcactacaattatgtctatgtgtctgatgttaaaggaactgttattccagagggattgtccaatattgaaattcaaaaaatccttgattctgcaaatgcgggagataatataatttttgcgggtaaaaactatgaaaatatatcattgacaatatctaaaaaccctgttaatatttacagttcagttaaatctactttaaatggaaattccaaaagcccagtttttacaattgaatcatctaaagctgcaggaactgttatttataacttaattattcaaaacggttctgaaggaattttattgaagggaactaataatattacggttcttaataatgatataactaaaaatagtcgtggcattagtgtaatcggtacagataaatcaaatattattggaaatttaatttccaattcaaaaagttttggaatttatcttaaagattcaactaatactcttatctactctaattgtattactaaaggtggaaatggtatttattttgacaatggtgtaaaatatacaactattgaacataatcaaatatcatacaacaaaggatatggaataaatctccatgggtcaggaccttacacaaacataactgacaataatgtttcaaataatgattatggaatcaatattgattgtaagggtgattctgaattatatatcactaacaatgcaattcataataatgacgtaggtcttaacatcggtgaaaattatgtaagatccgatgaggagggattaactggtgtcggatacaattttataggtcttaataatgaatttaatattgcagctaaggaaaatgataattaccctgcttttaagatgggtccggtacttactgatgggaatgatgaaccatttattaagatttgtaataaaataaaaaccgaattcttaagttttgatgttaagcaaattgataaaggttctatacttgtatctgtagacagcaaaatcaccacagctattccatggaaagtttcagttaataatggcggtaactggggatatatggaaattaataacggaaatggtattttgcatgtcaataatggtgacggtattgtaaagttcggttattatggcagttctggtcaggaaacttataagttatctgattacgaagcgtatattaaaccaaattatcctgttccaccttctaatcctacaaaccaaaatacgaatggaaatggaacttcatctaacacacagcaaggtcaaagttctgcaactacttctggaggatcaaatgacggttctttaagtgtggctggggctaattcagtatcagcatcatctgctcaatgttctgcttctgcaagtgactctggttctagtgatggtgcttcttcttctgcatcagctagttcttctcaatctgttgcaaaggttatagatattgatgaagaagttgtaagaattgcaggaataagtattttaatattattaataatagctgtcattgctttgtattataggaatgatataaaatccatgattgaaaagaaaaatggcaaatagtcatttttcttctttttactttttttaaaaaaacttcaacgatatgtttatatattcaggtagcaaatattattactcataataaagagttaatgagctgttgaaatgttaagtttatttgagggatatttattaatatttgttgcattatttgcagttaatattggtctttttttaggaaattttaaaactaataatttgaaagcaattattgttgcagttttatctggaattttgctgattggtgttaacagtatttctggctattttaaagatagtctgtcatttttggcaggtaattttggatatctgtttatagtagcggcagctgtcttatttgttttaacatggatttttttaaaaaaggaaaataatttaaaggaagttactttgataactgccgtcttattttatatatctatattatgtattgatgcacatattgatggattttcagtatttaatagcttattattaactttatttttagttataataatgtttgtagtttatcagctttctaaattattattttatgcaaaaagagagtattcccttattgttggggagtttatgattttagaatcaattttaatttttattttaggattaacttactggtctgttaaagaattggattatagtatgtttagtgcttatctgattttgactcctacttataagctggtgtatgttattattttaatgatttttattttgattgtgggattatattataatgataaacagttgaaaaaaagatagtgaggtaatttatgataattcaaggaactgaaacattatcttcatttattcatatagtatctgaaagcttactgactccggtaatgattttgattgtggttggtttgatagttgttatattatgtattggaggacttattaatgaacgcatttcaagaaaaacaattagctctgaagaattggaaagtttagttagggatgtttcattttcacagtctcacagtgaaattgaaaaacttatagaagaaagcaatttatttgactttcaaaagaatgtccttgttaagatagctaacaattatgatatcggaagtgaggctagaaaagcattagccagtgaattaatttcagcagaagaaactaaattaattaaaagtactaataaaacagatgttcttgtaagagtaggtcctattttaggtcttttaggtactttaattcctttaggtccggggttagcagcattaggttctggagatattgttacattagctgaagcattaactgttgcatttgatactactgtcactggtttggttataggtgcacttgcttatttggtatctaaatttaaaaaacaatggtatgaatcagatttaatagttcttgaaactattgctgaagcagaattagagactttaaatagaaagtgagtattatgcttaggaaaaaacgtagaattagtgaatctttagatgatgacccgatgagtggtttatctaacttgtctgatgcaatgctagttctggcacttggatttttaatttttgctattatggcattatctgcaaatccggaattaatctctcaaacacctgatactcaggatgtttctagtgctgatacttttgaacagaattatactgatgctggcggtatggaagatagcggatacagtgaagtaggtaaagtttatgaagatccgactactggtaagctagtgatggtatcgggataatattaacttttttttattttttctttttatatttgtttttttttagtattacaatttgataattatcttttattttctattttttatttgttttgttcattattttgcagtttttttaatttctttttcctaaatgtttatggaatgttttacacattgttttaggttttacaaaaatcattaggtataacgaagtttattattttggaatattttttggaatcctgtgatttagttagtataaatgttaaaaaggatgtaatttaaattatttttaataaataactgttataaaatctgtaataatgtttacaagtattttaagtaataattttataaaaaaatagatttttcacgatgtgaaagtattttatcatgatttatcaattatatatacattctgttagtggatatatttaaatattactttttaaggcagataacaaatcctttttatattaactgatatacttatagttataatactatgagtcaaaatttaagggagattttcatatgtattataagttttttcccctgtggaaaaattaaaaatgaggttgatattaatgagttcttttaaaagtcctgttgatacagcaaaaactgtgtcttcaataggtggaacaaaaagttccgcaaatgttcttaatgtaatattgttatccttcttagcaggtgcatatattgcatttggtggattgttagctgaagttgcaaatgcaggaatgctcgcagcaggttgtcctcttggattatctaaatttgtatttggtgcagtgttccctgttggtttgatgcttgttgtacttgcaggatctgaattgttcacaggaaatgttatgtacatggttatgggtgttttagatggtaaagcatctgttggtggcctttgtaaaaactgggttctcagttgggttttcaactttgttggtgctttatttgttgcttatgtattagcatatatgagtggtattgctactgatccagtaattgctgcaggagctactaaagttgctgttgcaaaagttggattatcatgggatgtagcactcattaggggtatcggttgtaactggcttgtttgtctagctgtatacttagcattagcatctgatgatatcattggtaaaatttttggtatttggttcccaattatggcgttcgtaactatcggatttgagcacagtgttgcaaacatgttctttattccattaggtatgttcttaggtgctgacggtgtaaactgggcaactactcttggaaacattattccagtaactattggaaacataattggtgcagcaatatttgtaggttgtatttattatataacttaccttaaagatgcaagttagaggtagaactgaattaaaataaataagaagctttatgcttcttattaatttatattatttaaataaattatttggagattataaaatggttgagataaaatatgtcccaacaatttgtccatactgtggtactggatgtggacttaacttcgttgtaaaggatgataaaattgtaggtgtcgaaccatataaaagacacccagtaaatgaaggaaaagtatgtccaaaaggtaactttggctatgaatttattaatagggaagatagattaacaactccattaatcaaagaaaatggggaatttagggaagcttcttgggatgaagctttagatttagttgctaataaacttaaagaagtatctgatgatgatccaaataaagttggattctatgcatgtgctcgttcaccaaacgaaaacatttacattactcaaaaattagctagggtagcttgtggtactcaaaacgttgaccactgtgcacgtatttgtcacggacctactgtagctggtcttgctaccacctttggttcaggtgctatgaccaacggattcgacagtattaaagaagcagactacatattctgtattggttcaaacaacatggaagcacacccattgtttggtcgtaaattaatccaagctcaaaaaaatggtgctaaattagttgttctagatccaagatacactccaactgctaaaatagctgatgaatatgtacaattcaaaacaggtactgacgtagcattaatgaatggtatgattaaagttattattgataatgacttacaagatgacgaatttattaaaaacagaacaaaaggtttcgatgaacttaaagaaacagtacaaaaatacgaccttgaaactgtatctgaaatcactcacattgcaccagaagtcattgaagaattagctattgaatatgctaaagctgataaagcagctattgtttactcattaggtattactgaacactctcacggtgcagataacgtaatgtctactgctaacttagctatgttaaccggtaacatcggaagagaaggtactggtgtaaacccattaagaggacaaaacaacgtacaaggtgcttgtgatatgggtgcattaccttcagattatgtaggttacagaaaagtagcagatcaagaaactactgactggttcaatgaatattatggaacaaaccttcctgcaaaaccaggtttaaccttagtagaaatgatgaatgcagctcatgctggtgacttaaaagtattatacatccatggagaagacccagtactttctgatgcagatatcaaacatactaaagaagcattagctaacttagacatgttaattgttcaagaattattcatgactgatactgcacaatgtgctgatgttgttttacctgcagcaggttggggtgaacaagaaggaacattcaccaacggtgaaagaagagtacaatgtttacacaaagctcaagaaccacctgaaggcgcaatgttagattggaaaattatggaagaaatcgcagttagaatgggagttccaagagaaaaattccattacgaatctgctgaagaaatctttgaagaaatcagagaatgtgctccaatcttcgctggtatgaaccgtgaaagattagacactcctgaagctctccactggccatgtccatctgttgacgacccatgtcaaccattaatgcacaaagataaatttgcacatcctgatggattaggtattttccaagcattagaacacagaggtcctgtagaagttcctgatgaagaatatccattgttattaactactactagggttttattccactatcacgcagctatgactagaagatgtaaaactttagacaacgaagttaaaactggatttatagaaatcaatacagaagatgctaaagaattaggaattctcaataatgaaatagttaaagctagttccagaagaggagaaattgaaattcctgcaagagtaactgatgacattaagaaaggtattgtaaacatacctatgcactttactgaatgtgcagctaacatgttaactaactctgattctttcgatccaaaatgtaaaatggtagagttaaaagcttgtgctattaaagtagaaaaaattgaggagtagatttaaatggctgtaaaaaatagcgacatgtattatgcatactctaacaatgaaggtattaaagaaaaaggtgaatacggaggagtagttacaactatcatgaaacatcttttagaaagcaatgttgttgatggtattgtagctgtaaaagaaggatttgatttatatgatgcagttccatgtcttataactgatcctgaagaagttattaaaactgcaggttcaattcactgtggtactgtaaacttagctagtttcatatacaaatacttagacggttgcagagatatgaaaatagcagttacctgtaaaccttgtgacgcaatgtctataagagaattaatgaaaaagggcaaaatcatcgaagacaatgtcataatgattggagtaaactgtggtggaacattacctcctgtaccaactatgcaaatgattagagatgtttatgagttagatcctagtgacgtaattaaagaagaaatcgcaaaaggtaaactcattatggaaactgcagaaggggaaaaaggtttcggtattgaagatttagaagaagacggtatgggtagaagagaaaactgtcaaagatgtgatttaaaaataccaagtaacgcagatttagcattaggtaactggggagtaatcggtcctttagcaggaaaagctacttttgttgaagtattctctgataaaggtgcagatattcttaatgatgtgattgaagctgatttaatcgctgttgaagaaccactcgaaaaaggaattgcaataagagacaaaattaataatttcatgctctctgcatctgcaaagaaaaaagaagcagattacgcaggtacttccggagatatcatcgaagtattcaaagaatatgaagacgaattctctaaatgtatgaaatgttacggttgtcgtgaagcatgcccattatgtttctgtgatgactgctgtcttgaagctgaaggtcctgaatgggtacctggtggatacactcctgcagcaccattcttccacttaactcgtatggtgcacatggtagattcatgtactaactgtggtcaatgtactgaagtttgtccttgtgaaatacctgtagctaaagtatggagtacagtaaacaacaaaatccgtgacgtatatggatatctccctggatttgataatggggaaccaattccattcactgaacacaaaccaaaagataactggaaatagagtttttactctatttacttcttttttttaaaaaaaattaattttagaagataaaaatcttctgtttaaaaatagcttttaattgttataaggctctcttttgtcaatgcctttaatgaaaacttcttttagttgagaatctgattcattatttcttatatgtgatattaattctaccagattgtcatttctaagtaagcatggctttatttttccgtcaggagttattcttaatctagtacaatttgcacaaaagtcgctgttttcaataggttttactacttcaatttctcctccgtctatgaagtattttttacggttttgcataaattcacgtgttttgacttcatcacatatggaaagcaacttttcattgatgggatctaaattataatgataatctctgctgaatttttcatcatcacagttttcactgtccattaattcaataagctgaagtatgatgccatgttctttacaaaattcaaacatatcatccacttcgttttcatttattcctttcattaaaaccatattgattttaacgggataaaggccaacttcaacagctttcagaattccgttttttgatgattcaagcagatttttagtggtaacttttttgtaagtttcaggatttaaagtatctaaactgatatttaccctatttaatccagcttcttttagatcttttgcatattttccaagtaaggttccatttgaagtaatggatatgtcatcaaaatcaaggctggctattttacttacaatttcaacgatgtcttttcttattaaaggctctccaccagaaatccttatttttctaacaccaatatttttggctatttcacagattctgtaaatttcatctgcattcatttcctcttgagaatcatccatcccatcatggtggcagtataaacaattttcattacatttgtttgttattgtaattcttaatgaaagtattggtcgttcatatttgtctttgatagcttctatactcataaaatcattttttaacagttatattaatagtttcgatttcattgatgtctagttctccaagtttcaatgatttaatcataccgtaaattgtttcctttaggatgccctttacaaatgcattaatctcaacatctttattgtttactgtgagtctggcttcactttctttaagatgttcctgatttattttagaaatatctacctgtgcaattcttgcatcttcatcagtgtttagggaattaatcattccaaatactgaatttgcaacgaagttgttggtatgatgatttaaactaatttctttattgttaattagaacattagcttccacttttgggtttaaatcaatgttatcttcattgtttattattagttcaactttattaatatcttttactccatactcttcgatatgcaatgtttttattattccaagcactgtttttttgataaaatcgctaacgaattcatttaaaccgataactgtattatcaattgacataaacgtattaactttgtccaggtcttcggtttttacagttccttttctgatttctttagctattgcgtctccatcattaaatccgcattcatctaaaaagagggtatcaacaatatcatggcctttttcttcaacagtatccactagatctgacacaccttcgggagttattgaaaaggagtccacttcagctattgtgtattcatcaactacatcaagggatgttactatttttggatagttgtagcttttaaatccttcaataactacaaaatcgacattgtccataaatttaattaaaaacagtaatctgtttagttctaaaatatctcttacattaaaaaatgatgtagacccgattcccacaacaacatttgatcctgccagcttatgtctccaggtatcggtatgttccctgtccatttccatttcatgatgggaatgctttatagatgccacattatatcctcttctggtaagttcttcaataatctttacagttagggaagtttttccagtattttttctacctactacagatacgattttcatagtaaaacctctacttattattatgtattatctagttattataatagatgtgtagttactccacattctcttaaattttagtttttccttaattttttatagatttagtaatacattttttttatttttttattatttttccaataaaaatatccgatattactttttttcaaatcgtattttaacctttatatcttaaattaaattattaggataatttttgtaggaatataactatttaaatcacttattttttaaattaaattgttctaatctttttaactaatttttttgttgtagtattagcacagtcatatatattactttcgccttgcttctagtagacaagtatatattaataataaacaaaagtttatatcattacacatggtggtttatatgccaaaacatattgcatctggtttgaaatatttagctgcagtgaagctaaaagagcaaggtgaaagccaacaagcaatagctaatgagttaggtattgataggtctacagtatcccattatttaaatggcagtaatttatcttggaattctatagacgttgccaaaactatcactgacctgactcctagagatttcttaaaaatgaccagtgcaatatttgatgaacctgaacaaagccgtaaaattgtttctatttgtaatgatagggaatttgaggcagttgttgcagattcatgtatcggttgtggcttatgtgtaagcatgtgttctatgaaagctattaaattagaatcgttaaaagcacatgtagactccatacaatgttgcggttgtcagctatgtaaagatgagtgcccaacgaattctattaaaattttggagatttaataatgattaaaaataaaaaagaagctatagacaataactttgctattacaagggcagctgaagaagtaagaaagttgtcttttaatgatcagatttgtcttggatgtggagtttgtgaatctacttgtcctgttgaagcaattactttaaatccaattgctatcgatgctcgtcacagacgttccaacgatgtctatttcagtggtcataaaaaaatagcacaaaatttccatgctgaatttgatgttcaaaaaatcagcattgatgaaaataaatgtgttttatgtggtatgtgtagtggattatgtccaatagatgcattagttttaactattgatgatgttccaattagtgaaattgaagcatatcctcattacaactcctattctaaaatcgatgacgacaaatgtatctactgtaaaagatgtgaaactgcatgtcctcaagatgcaattactgtcatgagaaaattgccagaacgtcaaaacttagtatctggtgaaattagtgtaagtgatgatgactgtgtttactgtggaatctgtcaagaattatgtcctgcagaagcaattgtagtagataacactacaggtcaagaatctatcgtaattgacaaagacaaatgtgtatattgtcttgtatgtaaaagggcttgtccagttgatgctatttctgcagtatgtagggcatgttcctatggtgaatatgatttcaaagctgaagatgaagttactactggtagtgcagttattgatgatgaactttgtgtatactgtggatggtgtgaaggagtatgtccaactgatgctgttgaaaccaacaaaccattcaaaggtactttagaaattgatcaggaagcatgtcaaacctgtggagcttgtgtagatacttgtccatgtgatgctttagcattccctgtttctactgcaccaggtcaaagattagaccgcattactaaacatgatcaatattgtatccgctgtaaagcttgtgctaaagtatgtccaaacggagctataactgttacaagaactgaaatagatcacactcctataaaatctgtaacatggctcgatgcattcgatgcaattaaaaattaggtgatttaatggaacttaaagttaatcaagataattgtttaggatgtggaatttgtgtaattgcatgtcctgttaacgcatctatcagccctgaaaatgcaggtggtaacggtgcaaagactgatgaagtagttattatggtcgaaaatggattcattaaaattttctcaccagataaatgtgaattatgtggaacttgccaaatgttctgccctgtaaatgctatatggattgaataggaggaataattatgcattatgctaatacttatttatcaaaacctgttgttcctgatgtagaaattgttggtgatggaaagaccaaagtacttaaatgtatgttaaatacaggttctgacatttatcaaggagcttgtaaaaaaagaggttctacattaaaagaagaatataaaaatgcttctggaacttgttatatggacccaagagacatgggtaaattaggtgtaaaaaattgggatactgtccttgttaaaactgaatggggagaagttgtagtaaatgctgcagtatctagagatgcacctcacgaaggaactgttttcatttgtaaaggtccttgggcaaatactgttgtaagtcctgatacttactgctgttctgacccaacttacaaaggtattcattgtactgttgaaaaaacagacagagaagtattactcatggctgatttaatgagatgggtttacaaaaaatatgttgattccgacgacgatgatgttgttgaacatatggaatcattaggagaaagaccagtatataaaggtcgtaaatgggaggagttgattgatcatgacatatgagccacctgtaaccgattatgattacatcgtagaaaattgtacttgtgcattttgtggatgtaactgtgatgatttagattacttagttaaagacaaccatgttgttgctgtaagacatgcttgcagattaggtgcaagtaaagttatggaagatatggaccaaagattagtagttcctatgattagggatgaagacggagaacttatggaagtagattgggatactgctttagataaagctgcagaatatattgctaactctatcaggccagtattctacggttggtctgaaacttccaccgaatgtatgaaagaaggattagaattaggtgaatacataggagcagttttagataaccaagctactatctgtcacggtccaagtttacaagctgtgcaaaatgcaggttaccctattcaaactttaggggaagttcaaaatagggcagacatggttgtttactctggaagtaacgcaatgaactctcacccaagacatgcagctcgttatgctatcttctgtagaggatacttcagacaaagaggtagatttgacagaactgttgtaactatggatccaaaattctccgatactgcaaaaatttctgataaatggataggattcgaacaaaatggagattatggtttttacaatgctatcagagcagtattaagaggaaaagaaatatatcaagatactatttccggaattcctaaagaagacatttacgaattagtagaagaaatgaaaaacgctgaattcggtgttttattcttcggtttaggattaactcacactttatccaaacaaagaaacattgatatagctattaaaatgattcaagacttaaacaaatacagtaaatggggtcttactccaatgaggggtcactttaacgtaaatggtttcaacattttcatggctttcgaaactggatttgcatttggtgttgactttgctagaggttacactagatatatgttaggagaaactaacaccatcgatttattaacaaggaaagagcctgactgtttcatggttattgcagcagaccctggtgctcacttccctaatggtgctaaccaacatttagctgacattcctgttattcaagtggatattcactggggaccatctactgaacttgctgatgtagtattacctggttcattcattgcagtagaatgtgctggtaccagttatcgtatggacggagttcctatttacatgaaaaaagcaattgataaacctgaaacatgtcgtgacgacgaatggattatcagagaacttaaagaaagagtcatgaaactcagagaggagccaaatgtagctccaaaatatgtgcctaatccaaacgcattataaggtgatatgatggaatttatacttaaaaatggtattgtttatgacccagctaacggaataaatggtgagaaaaaagatatcatggttaaagatgatatcattgttgaagaagtctcagctaatgcaaaagtcatagatgttactaataaaatcgttatgcctgctggggtagatcctcacgctcacgttgcaggtccaaaattagttgtaggtagattatacagacctgaagattcaagaagaggagttactcaaaaaacaaaagttacaagggcagaatctggtttttccattccaagttgtccatcaactggttacagatactccagattaggttatggtactgttgtagaagcagctatgcctcctcttgaagcaaaacacactcacgaagaaattgcaactattccaaacatagacattccagctttagcattatttggtaacaactggtttgtaatggaatacgcaagagaaaacaatattgaagacttatccgcatttgtatctgcatggttaaaagtctccaaaggttacggaattaaaatcgtaaacccatgtggtagtgaagcatggggttggggtatgaacgtacatggatacaatgacaaagcaccttactttgatgtaacttctagagaagttgtaacttctttagcaaaagctaacgaaaaattaggtcttcctcactctattcacattcacccaaatgatttaggacaccctggtaacgtaccaactactcttgaaacattagattctcttaaaaatattaagaaaagtcctaaagcagatattagggatcaagttgtacatatctgtcaccttcaattccattcatatgatggaaccaactggagagatgcaagttccggtgcagaagaagttgctaaatacataaacggtcacgaccacgtaacttgtgatattggacaagtaactttagatgaaacaaccaccatgacagcagatgcaccaatggaatacgacttgttcaaattatctggattaaaatgggctaacaaagacattgaatgtgaaaccgcagctggtattattccatgtatctactcaggtagaagtccggttggagcacttcaatgggctattggtttagaattgttcttacatcttaaaaacccatggcaagtatgtttaactactgaccaccctaacgcaggtccattcataagatacccaagaattatctcctggttaatgagtaaccaaagaagaatggaaatgattgaaaacggtgaagttcacaaatgggtacaaaaaagaactactctcccaactcttgaaagggaatacgacttcaacgacattgcaattattacaagagcagcacctgctaaaatctacggtttcagagacagaggagctcttactcctggatacaaagcagatattgctgtatatgacataaatcctaatgaaattgacccatccagacaatatgcagaaatcgaaaaaggtttctctcttgctgattacacaattaaagatggtcaaatcttagtaaaagataaagaaattgtaaaagttaaagaaagtcaaaacatgtgggttaatgtacaaggatacgaacatgaagaacaaaatgttattaataaaatcatgccgttctttactcaatattactccgtaaaatgggaaaactatccagtacatgatcattatgtgtccaatcctataaggatagatgttaaaagataaaaagggtgtttaatttgaaaacaataacatttgatcaattaaaaacttcttcaatcgctttagaatttgatgaattaattcctgatgaaatttatgcatggagcgaagaagattttgcaaaatatgaagtacctattggaaactcaagattcccaattactgatttcttcgatattactgtagaaggtgatgcagaaggacctaatgatgttaaaatgattcttaacggtgacttaaacagggttaaatacatcggttgtaaaatgagtggaggagaaattgtctgtaatggtaatgttgaccttcacgtaggtgcagaaatgagtggcggatccatctatgttcacggtaatgcagctgctcatgcaggaagggaaatgtctggcggataccttgaaatcgacggtgacaccaaagaattcactggagcttcttacattggtgaatggagaggtatgactggtggtaaaatcgttgttaaaggtaatgctggtaaacaatgtggtgaatgtttaaccggtggaagaattcacgttttaggtaactgtgatattttagctggtattcacatgaccaaaggtatcattgaaattgacggtgatgtaaaccgttggcctggaggtcaaatgaaaaacggtaacattgtcattcacggattccttggaagattactcgaaggtttcgttcttgaaggcgttgtcgacgaccctgaaattgacggcgaagtattcaaaggaaaatatatccaatacaaaggggacattggtctcaatggtaaaggtgctttatacttagatgctgaagctaacagggaaaaattagctcattataatgagattgacgacgaatatacttcaattagggaatacaggaatttataattccttttcctttatttttttttgaaaaaagtttaaataataatccttttctgattttgatggattttaatacatacttcaaatgtatgcataacgtttaaatattcttttattaataaattattatatattgatttgacaaattttgtaaactgattattaatttattgtatggttttatgtgtgataatatggttaaggaaattaaaatgtctgctgaggaagctattgaatatgtgagagaaaacgtccaaataagagatattttagaaatatcatacaatcgtatttttgctcccggtgaagtattaaatataatttcagaagacgaagaaactggtgagggactcagggttagtttacaattaaatggtgaaattttaaatcaggttgttgatgtagattttaaggaaattaaagatgatcttttagaattgcgccatattaaggatggtaaaataacaatcgtggaagtttatgattaaatttcccatatatttttttaaaaaattattttgttttatacattacaaacaaatttttatattatgaaaaatatacttattatttaacaatataatgaggtgttttccatgaaaaaattaagtttaactccagataaagctgtagaatatttaaaagataatgtgaaaatccatgataatttagaaatttcttataatagaatttttggaagcggtgaggttttaaacatggacttttctgaatattttggaaaaccagggtttaaaatgttgctttcattagatggtgattcaattaatccgactattgaaattgatgtttatgagattgaagacgatttgattgaatttattcaccatcctgttgaaggagatgatgtggaagttactgtagtttaaaatagctacagtctttccattttttcaaatttcattaattttgcaatagctttaacttcaacatctattcctttttctttaagtgcagcaattaggttgagaccactgcctgcaacaacaccaaaattgtagttatctactttagcattatatgttagttctcttggtttgcctattttataaattgaaaatccaatattctttaagatgtttaataaatgtactgcatagtctcttgaaatataggggatttcttttaaactggccagtattttattggatccgatatttcttgttattgaagtcatgtttttagctatgaatattttatggggatcaacagaagagccattataagaaattaagtcaataaataagggagattcgtttaattccaataatccgccatatttcgggttgctcattattccattgtttattaaaagtccgtcaatacttaaactgcatattgtagctattcctattttggtataatcggtcggatgttctacaagctgatagtaagggttgatgtatttcggatttgattcataggtttctttcataatatatattgctttatctaagctgtctttgttaatgtatgaaacatttactataatgtctccttttctagtttccacatcgaaattaactttttgaattaaattccatgattttgaaagtaaaaatggagtttttgcatgaattttatcatcagcaggtttaagtatttttttaacatcagctattggggataatgtttcaaagccttcaatttcttcagctatttttatgtcaatgtcatatccgagttcttgagctgcacaaaatggggtcactcctccgctgacggctattccaaccattccttcaggtacgggaactcccaacatatttttgccttcttcagaaactgccattactcccccaattccaattttttccaatttgtttatgatgtttagggcacgttcccgccctacacttggaatgaggcgtaaattagcaggtattgttccggtcccggtatttatcacatctaatacagaagtcattcccggagctacaaatgcatcaagaggtgttacagatgtttttttgtaggaaatcagttctgtaaattttgtcggaacataatctctgattttaactaatcctccgtatagtgggattgtaggtattccttcgtttaacagaattccgtcaattgtggttccgcatattgtttttatctgtatttcttctttgctgttaccttcttttaaattgatgtaaggactaacacaaagaccacttttgaaaacatctttgattatattaaatgcttcttcatcgtaaatagttgaagtatttactacaacatttcccgcccggttcatgtagttgaaactagtcaaataaatcatttcttcaaattttgaataaatgaaatcaacctgatcatagattatacctttatcaagctttttcctgcccagttctgtaatttgtctgccggaatatcccattctttcagtatatcctttttcatcaagaatttgcatatgatatctaacagcacgttctcctaagttaaatcctttgtttttcaactcttctgctattaatttagaaccagtaggtttattttgctcatttaatattcttaaaatttcaattattttgtgttctgattcagtcatatgatgctcccttttttcttaaatataatcatgcctaattttacttaagaatcattatatttaaaaaataaaaaaagtatatttagatttaaatatctaaatatttgttttgttcgtatccgaatacttgtacacggtattcgtcccattctttgtatttgagctctaggaatttttcactggtgtggtctcctaaagtggataatatcaatgggtcttcttcaagtgcatggtaagcttcccataaactggatggtaaaacttgaattcccatagcttctctttcttcttcggttaatgagtagatgttaatttcggtaggttctccaggatcaattttattttgaataccgtcaatacctgcttctaacattactgcaaatgctaagtatgggttacatgctgggtctggtgctctgtattcaatacgggttgctttaccacgagctgcaggtaccctgattaatgcagatctgtttttaagaccgtatgctctgtatactggagcttcataacctggcactaaacgtttgtatgagtttacaatagggttggtaattgcggttaatgctggagcgtgagcaagcaatcctcccatgaagtgaagtgcgtctttagataatccggtttcgctgtttgggtcagagaacaggtttctgtctcctttgaatactgactggtgacagtgcataccactaccgtttacaccaaagaacggttttggcataaaggttactctgtaatccatttggtcaaaagtagccatgttgtctacaatagctttaatagcttgtttaaaggtaattacagcatctgcagtttttaatgcatctttaaatttaaatgcaatttcgttttgaccaggtcctacttcgtggtgagaagcttctacttcgaaatctaattcttctaagtttaaggttagttctcttctgaaatcaggtcctttatctaaaggttcaacatcaaagtatcctgcttcatcgtaaggcattgggtatccttcatcgtcaatatctacaataaagaattctggttcaggacctatgttatattgtaatcccatttttccaattttagctaaagattttttcaggatacctcttgggtctccaacaaatggttttccgtcaggagtccagacatcacaaataaatctacatactgcagattcttcaggcctccaggatactcttgagtaagtgtggatatcaggtttgagaacaaggtcactttcattgattcctacgaatcctgcaattgaagatccgtcaaataacataccttcaacaaataagtctgccatgtcatcttctttaaatggaattacaatgtttttagcagttccatttatatcaacaaattgtaaacggataaatttaatattatcctctttcatttgtttaattacgctttccattaattcttcgttaactttttcagtcattaaatcatactccatataaatcttatggatattagtttcaaaaggttagtcggaaaataccttcctcccttggcaatacatttccttctcatattatataaatgttttgaataaatgtacttataaggattatttatattttttaatatataatcacaatgatttttatttttcaatggttaattcaatagcttttttaaaaattaatgggaatatgttcaagtttaaataaatgagtctgtaaaattttataggcttatttgttttttaattttttacagttgaactttcattttgatgaaatttcattctaatttttctttaattttaatataaatgatttaaaaatagtaaaatactttaataagtgaggacaaataatattttatgaccaaacaaaacaaatctgccctcaatagtaatatagacttcatacaacttaaactttatgatttttttgatgaaaaaattgatcaagaaaaaattatttcaaaaagattgaataaaacacctaattttgaaaatactaatcataaactatttttagatgaaaataatacttttaaatatgataatcccatttgtccagtttgtggaagccacaaaataatcaaaaaaggcacaataaagaaaaacaaacaaaatactaatggaaaaacaacagaattcaaagaacagcaatatcaatgcaaaaaatgtggaaaaaaattcggaatatacaataatccattaattggtgaaaataaacaatttttacaagaaataatggataaaattccaggaataatgaaaatagggtaccaatcacttcgtaaaataagtaaatactttgaaatattccttggaatcagaatatctcatcaaacaatcaagaactggtctgacaaaaatcacgaagaaagcatcagcaatgaaaaatttgaatattctggctattatttatatgatgagcaatttttaagacttaatggaactagacactacagattaactttatttgatgcaatactcaatattccagtcacagaacgaatagtacgtcgcagaataccaaaaaacacgaaaaaatttatcttagaatcaacagaaaataaaccattcatttgcctaacaaccgatttattcccaatgtatcgtaatgtagcagatgaaatagaagtaaaacatcaattgtgcatatttcatctgtttcaaacaataaaccataaattaaaagtatattgtagaagaaacaagattaatggaaaacaaagagaccatatttacgaaaatgcacaagaattaaaaaactgtttcagacaaaactcaaaaaaagaagcaatagaacaatttaaacaatatttacaaaaatatacggccataccagttgttttaaaagatttcataagaaaacatatcataaatcacttccacagatacgtagaatatcttgatgatgaaaatatagaaaaaacatcaaataaagtcgaaaattactacagacaaaccaatcctgaaaaaataaagaaaatatacaaaaccaaaaatggaatcctgacatttttagactatcaaatgcaaaattggactgaaaaacacattaaaatcaaataagcctataaaattttacagactcataaatttaaagaatttttattttcttttaatgaagagattcctgatgaattaaaaaatgacattactaaggacttgcttaatttaacagatatctttgaagaatatgaaattaaagattatcttcctgatttttacttagatgattataatatctatatagaacattttggattaaaccgtaactgtgaaaatcatttaattggtggaaaatcatctgaggaatatgttaaagaaatggaatggaaaaggaaagtacataaaaaatatggaactactttaattgaaactttttcatattatcaatcagaaaacagattattaacacgtttggcagaaaaattacaagctcagggtgttgaatttaatgaaattgaatatagggaagtttatagaatattgttggaaaataaaactataaaagaatgggaagatttcattgtattgttaaaaacatttattgagttatttaaaggaaataattatgatgaaactaaatttaaagaattttatgattatgttggtggattaaaagatagtttttcaaaagataggacaatagcatttttaaaaattgttgaagagatttacaatgactatgaagcatatttattaaaaattaaaaaaattgattttaatgatatgattaataaagccagtgattgtattgtgaaaaatggattagatttgccttacaaatatataattgttgatgaatatcaggacacttcatttaccagatataacttgttaagaaatatctgtgatagtattggtgccaagataatggttgtaggtgatgactggcagtctatttacagtttcagtggatgtgatgtaaatatttttaccaaatttgataatttctttgatgtttgtgaaaccagatatattgaaaaaacatacaggaattctcaacagttaattgatgcttcaagtaattttgtaatgaaaaatcccgatcaaaccagaaaggaattaaaatcttctaaatcattgaaatatccaattaaactggttaattttgataatgattttgatgaaatattaaaatttgaattaataataaaaaatatcataaaccaatcaacatttaaaaacaaaaagattctgattttaggtagaaataataaggacatatttaatttactaaagaatttcaatgtagaaaatgaatatggaaaaagaaaatttgagattttaggagatgaagataaattaagaagaaataaatttgtaaaaattgtttatagggagagtccggatgttaacattgaatatcgtactgttcatcagtctaaaggtttagaatgtgataatgtaattttaataaatttgaaaaattggaaggcgggttttccaaataaaatggttgatgatcctgttttaaattttgttaaaaggaatggagattcttttagttatgctgaggaaagaagattgttttatgttgctttaactagaacaaaaaataatgtttatttattagcaccttattttaaaagttcggtgttcgttcaggagctgaaaactgatgcaaatgttgaattgcttaacctggaacataataggctggaaactcttaaaaatattgaaaaaaatggagaacgttatgtaattccaactaaattaaaatgtcctgtttgtaaaacaggtgtggttttgctggaatctttttggaataagggtaaacttaatagggttcttaaatgttctcataatatggcgcctccatttaatcgctgtaattgggaaggaggttattatggaagtgaacttgaggatttggatgatatagaatattgtccaagctgcgatgggatacttataaaacgttaccgacatagtgacgggcatccatttttaggttgtacgaattttagaaaaacaggatgtaggggaaaaggtaaaaaattggagtatattggtaaaacctgtccgaagtgtggtaaacctcttgtaaaaagggttaatggtgaggataatagtttatttgtaggatgcagtggttttcctaaatgtagacacactgaaccatttaaaaaagagatgggaatctagaatgctcctccacctcctccgccggaacctccaccaacgccaccaaagccggagctgtctgaatttgcatttgctgtttgtattccggtatctattgcattatgcatcatgtaatatcctgttccataatagtagtatgaatcaagataatcgtcatcaatgtttccttcaccaacatgcagtttcatggattcgtaaaccttatcagctactccaagagctgttgcatatacgagatattgattccatataactattgattcaggagggtgttctttcattaaactgttgtcacttaaaaacttcttaaagtttttccactttagcatatatagtctgccttcttttgtccattgtccgaagatatcttcgggcaacatgtaaatcacaaatcctgaaataaataaaaatactgatcctataagtccaattgttcctccagttgtatttaaaccattttccagatagaataatgaaccaaacagaactccaataattatacaagctattgaatagtaagtagctattttatttccttcgttattaaagaattgtttcaatctggattttgataaatgttcgtaggcaacatcatttttccatgatttgattctgttgttgaaccattccgcattatgttcatcggataaataatctttaacattacttaaatccaagagattgtctttagctattgttttgaagatatcgaaaacatctttttcatctaatgttaaactgtcgtagtttgtttcatctaattctataattaaatgtttttcttcatttgatttaattttaaatattttacgattaatcaaatccattattgtagcttcaaatccttttaaatcaggagttccaatattgtatcttttttggattaatgcattaactacagctggggggtcgttacttggaagatccctttcataaattccttcataattaactttaggttctacaccatatttgcggtaaataaaaaatggaattactggacttataataaacagtattcctataagtgatccgatattgtcccacattttttcatttgcctgataatcattgtaacgttgttctatttcttttttagctgctttatcaatatggattgcatttggtgagtttgcaaagtcactttcaggcattaaaacttcaatctcgtaaaagtttccagaatctatgtaattgctggttgaagttattgtatttccgtctaatgagctggttttggtatattttgtaggatttaaccagtattcattaccattatcattaggtaaatgtattgttgttattaattcatcaactcctactgcccactggtctccccaaagctgatactgtagagatgcagtgtcctgataaacagtcactacatttttcatatcgtagctgatatggactttaacatttgtatcacttattggttgggttttggcagcatctgaatataaataaatttttatatgctgagttccatcttcctgatgttgctctacttttgtatatgcaccttctgctgatacatgaatatttgaaatactttctccctctttcaggggtatgtctctgtaaactccattaaatgttccgtcaaatgaatagtcaaaggtttcatttatatggagcattccgtttgtatcaactatgatgtctacaagtgcctgtgtaatggaatagcttctgtcatcgtcatctgcataaacacaagagattgttgatgttattaaaaaaagtagaaggaagatggttactatctttttattaaccatatatttaatctcccttaaaattgcactttaggtgcttccctttcaccactggctatttcaaaaaagtcagcttctttaaaattaaacattcctgcaataatattgcttgggaattgttcgcatttattattgtacattaaaacagcatcattatagaattgtcttgagtaagaaattttatcttcggtttctgttaattcggattgtaattctttgaaattttggtctgctttcagttcagggtaattttcagcaatagcaaacagtgatgttaatgcaccagttaaagcattgttggcttcactaacttctttaacgctgcctgcattcatcaaaccgcttcttgctttggttacattttcaaatacatctttttcatgacctgcataacctttaacagtttcaacaagatttggtattaagtcatttctccttttgagctgaacatcaatttgagaataactgtttttaactctgtttcttgcattaacaaggccattatatccgctaatgagatataatacaatagcaagtatgattattataattactgctaaaataatcatggttgtatccatattttttactcctttttattattaatttatatattgattgaagttttattaatatgttgttaatggattgtattattttttaaaaaatatttggagtggttgggagatatttaaaaattgataattttgagtatttatagtagtttttatataaatattaagtaatagatagtgaaactaaaattgtgagaaggtattagtttcaaataaataaattagaatgataaaaatgttatatggaattgtagatattggttcaaataccatcagattaaaaatatatgaatataaaaataataaaatcaaatctgttttttctaaaaagaaaacagcagggcttattgcttatcgtgatgacggtaaattaaacgatgaaggaataaatattttatcatcaatattaaataaatttaataaaattatgaatttattgaatgttgccagaagatatttctttgcaacagccagtttgagaaatatttcaaatacttatgagataattgcttttataaaagaaaagattggtgtggatattcatattcttgatgatgaaaccgaagcacagctaagtttcaattcagttaaaagcacaggactgagcagtgacgaggggattcttattgatgttggtggaggcagctctgaaataattgtttttgaaaataaaactcctgttgataaaggaagtttgcctgtgggatctctatcatgctatgaagattatgttggaatcatgtttccaaataaaaaggaatccgaaaatattgaaaaaagagtaattaaagaaattgaagatttgggtttggttaaaactcataaaaaatatttgtttggtgtaggtggaactgtaagaaatcttaaaaaattattggttcatctcaatttcattaatgaaaaaaaagatgcatttccagtttatttgttggatgaagtgttggatgaactcaaatataacaataaagaagactttaataaaatattgaaagttaaggctgaaagaattcatacacttgtgccaggaattataattattaaaacaattgcaaagtattttcatgtggagaaaatatgtgtttgtaaaaattccataagggaaggagttttatattcacttttggatgctgagggattataatgaaaaaaagggattattcatacactcaaaacagggagctgtcctggcttaaatttgatgacagggttttaaaagaggcaaaagacaatactgttccgctgctggaaagactaaatttcatatctattttcacaagcaatttagatgagttttatatggtcagatgtggaagtctttttgatttaactcttattgatgaagatgactgggataataagactggctggagccctcaggagcaattagatgccatatttaaagctactaaaccgttatatgaagaaagagatttgatttttgatgaaatagctaaagatttaagaaaatatggtattgttaaacataatttcaatgagttaaatagtaagttcagacagtatgcaacccagtatttctatgaaaatgtagctccattattatctcctcaaataattgattcttatcatcctttccctcatatggcaaataaaaagttatatatttattgcattttggaaaggggggccagcaagaaaaaaaattcaaaagaatacattggattaattccaattccatattctctgcctgattatgttaaatttccggatacaaatgaatttattttaatggaagatttgatttatgcatttgctgaaggtatttttacaaattatagggttaaataccggactgtagctgcagtaacaagaaatgcagatataaaccttcaagatactcctattgatgaggatgaggattacagacatttcatgaaaaacattcttaaaaaaagaaaaaggttgtcaccgataagattggagttttacaaaagcaatgattccacatacaccaaatatcttagaaaagaattgggattacataaaaaccaggttttccttacacaatctccaataaatcttgattttattcatgattttataaaagaacttcctggtgatgtaactgatgatttaacttttttagagtttactcctcaaaggacaagtcaaattgacccaaacaaatcattgtttaagcaattggacaagaaagatattttgttattttatccatatcaaacaatggaccatttccttgattttttaaaggaggcagcgaatgatcctgaagttttatcaattaaaataactttatatcgtgttgcaagaacatcacgagttattaaatatttgattgaagctttagataatgataaagaagtaacagttttaattgagcttcgtgcaagatttgatgagaaaaacaatattcattatgcagaattgcttgaagaggcaggatgtcaaatattgtatggttttgtagattataaagtgcactctaaaatatgtactgtaactaaaaaacataatggaactataaagcagtacacacaaattggtactggtaattataatgaaaaaacagcaaggttatatgttgattattgttatttaacatccaatcaggaaattggagatgatgctactgaattctttaaaaatttagcattggctaatttacagggtcattataataagtttcttgtagctcctacttctttaaggtcaggaatcatgaatttgattgataaggaaatagctaaagctaaaaataatcagcctgctgaaattttgatgaaaatgaattcatttacagacaggagaatcattgataaaatagctaaagcttcaaaagcaggtgttacagtaaaaatgattattcgtggaatttgctgtattattccggggcttaaagataaaacagacaatattgaaattcgtggaatcgttggcaggtatttggaacactccagagtctatgcttttggtgttggtgaagacaggattttatatatttcaagtgcagatatgatgacaagaaacactgcaaaaagagttgaaattgcatgtcctattgaagacaaagctataaaagcaagaattcttgaagatttggatattatgttaaaagatgacatcaaaggccgtagaataaattccgacggggattatgaatgcatacagcaggcacgtcatatcaattcacaggaatttttccagcaaagagctattgatgaaatgaaggatgttaaagttaaaaaagataatcctaattttttaaattctattgttgataaaattaaaagtatttttaattaaatagtttataatgaaatttttataaaaatttcattttgattccattttctaacaacttttaaattttagaagttagatatgctattattaatcttattttaacttaaaaaaatcaatacctttatataggtagaaaattaaatatattgttatcatgttaattagtgtttaacatgataggctaagtattttttattatacttggagctattttaagcaataatgccgagatagtctagcctggtaaggcgcgagactggaaatctcgtgggagcttttccctcctgggttcaaatcccagtctcggcgtttattagtttttaacatacgattttttaattatttttttcacgattattaaattatttgttaaactgatattttgcactcttagttgtaaatactaagttttaaattgttgaaagaactgtgttttgaaatcaaaacatttgaatctattacttttgcgtctcgtagattcgctctataaatggaggttatttaatggaagacgactttaagcacttggtgcgtatttctagaaaggatgtagatggtaataaaaccattgaacaagctttaaccgaaatcaaaggtgttggaatatctttatccacaactatgtgccgtactttagatttagattctgaagctcaaatcggttatatcgctgatgaagatgttttaaaaattgaagaaattttagaaaacccacagaaatttaatattcctaattggatgttaaaccgtagggaagactatgaaactggtgaaaatattcatttaattgaatcagatcttgacatgactttaagagatgatttaaacagaatgaagaaaaccagaagttacaaaggtagaagacacgaagcaggtttacctgttagaggtcaaagaactaaatctactttcaggaacagttcttcagttggtgtaaaacgttcataagcatgagaactttttttataattaatattactcaataatttttttacaatgatagtattaatttaattatttttataaaggagatgttttaatgggacaacctagaaaatcaaggaaaaagtataatacaccgccacatccttggaatgcagaaagaatcaaaaatgaaaataaattgatgactaaatacggcttaaaaaacaaaaaagaaatttggaaagctgatactttagttagaagatacagtagggaagcaagatacctactcgggttcgatatggaccaaatgcaagatgaaaaattagaattattaggacacttagctagaaccggtgttttgcctgaaggtgcagcacttgaagaagtcttaaacttaactgttgaagatatcttaagaagaagattacaaactattgtttacaaaaaaggtttagctcgtactcctaaagaagctagaatgtttgttgtacatggtcacataactttaaacggtaaaaaaatcaattcaccaagttatgttgtattaaaaggccaagaagatgaaattggattttatccatcatcacctgtagctaaacagattgaagagtacaataaaaacaaaaatgaaaaagctactgaggaataaagggtgtaattatggcaaaagatgaaaaatggggtatagctaatatttactcatcatacaataacactattattactgtaacagatattactggtgctgaaaccatttcccaatggtcaggtggtaaagttgttcgtgcagatagacaacaagcttcacctttcgcagctatggctgcagcaactagaatagctgatgatgctaaagaaaaaggatttgttggcttacatattagagtaagagctcctggtggaaacggacacagaagtccaggacctggtgcacaagctactattcgtgctttagcaagagctggaattaaaattggtaaaatagaagatatcactcctattcctcacgacggtactggaagacctggtggtaaaagaggaagaagagtctaagaagggtttaatatggagatagaagttaaaagtcaaacagatgatgaaattgttttcattgtccgtgatgcagaagtaccttttattaatgctattagaaggtgtgcaatggtaaatgtacctaaaatagctattgaagatgtaaatatcatgagaaatgattcagctatgtttaatgaggtacttgctcataggcttggtttaactcctttagtttctaacatggatgcaattgaaggtttacctttacctggtgatgatgattacgaggaaaacaatagtgtcatgttttctttaaaagaagaaggacctaaagttgtttattctaaggatttaatatcttcagactcaaaaattaaaccagtatatgataccattcctttagtaaaacttaaagaaggcgaaaaactcaatattgaagcagttgcaaaagttggatatggaaaagaacatgctaaatggatgccaactactgtatgtgtttataaacaatatcctgaaatcacttttaatgaggatgtgggaattgattatgaatgtgctgatgcatgcccaagaggtgttttaaaatctgataaaagatccaaagagattaagattttagacattgaagactgtgctatgtgtaaaagctgtgtaagagcttcaattagaaatgcacaatctgaaggaaaagatgaaagctacatcaatgtaggatatcatgaaaatgattttatatttagaatagaaactgatggatcaatgcctcctaaagaagttttattgcaagcttgcgatgaattaggtgaaaaagcagataagtttatcagatttagtgaaggaggaagtaaataatggttaagaaaattatcaaaacaaatcctaaccttattgaacttattaataaacttaataaaaaatcaaaaacagaaaatgcagctatttggaaagatgttgctaatagacttggaaggtctaacagaagaactgcagaagttaatttatcagatattgcaaggtatgcaaatgctgatgaaactgttttagtacctggaaaagtattatctaacggtgatttaacagaaaaagtaaatgttgcagcatttaaattctcacaaaaagcacaagaaaaaattgaaagtgctggtggagaatgtgtctcaattgatgatataatggaatctaatccaaaaggaagcaacattagaatcatggaataagatggatgtgttgttattatgattattgacggagaaggatgcgttttaggaagattagctagtgtaactagtaaaaatctcttagaaggcgaagaagtagtaattcttaatgctgaaaagattatgattactggtaataaggattgggcttatgcaaaatacaaacaaagagtagacagagcaagtatctctaaccctcgtgatttaggtcctaaatatcctagaagaccagacgatatattcagaagaactgtaagaggaatgttaccttataaaaaatctaaaggtagagttgctttcaaaggtttaaaagcatatgttggtgtacctgaagaatatgctgatgctgatcttgttgcagttcctgaagcagagtacaacaaccttaaaaaaggtattgaattaggtgaagtttctaaacttttaggagctaccttttagataagtgggtgtgtgattatggttaaagttattcatacaagtggaaaacgtaaaacagctatcgcaagaggtactgttcaagaaggtactggtaaagtaagaataaacagagttcctttagaactttactccccagaactcgctaacttaaaattacaagaaccattaaccttagctggagatttagctaatgaagtggatattaacatccatgttgttggtggaggagtaatgggtcaagctgaagctgcacgtatggtaattgctaaaggacttgtacaatggtctcaagatatgaatttaaaagataaattcatacactacgacagaactatgttagtaggtgacccaagacgttcagaacctaaaaaatatggtggtcctggagcaagagcacgtaaacaaaaaagttacagataatttttctgtaattttataatttttatttaaaaaattaaaaagatgatataaatgattcctataagatgcttaagttgtggaaaaccagtatcagcttactttgatgaatataataaaagattagctgccggtgaaaaatcaaaagatatcttagatgacttaggcttaaacagatattgttgtagaagaatgttaatttctcatgttgaaacatgggaataggtttttacaagttgtagggatatatttttacttataaaattaatcttggtaaacggtaatacctaaaaaatggaagtaatattcatgactacagaaaatttaacaaggtttgaaagagctagacttcttggagctagagcaattcagatttcaatgggtgctaaaccattagtggagattggtgactcattggatcctattgatatagcttatgaagaactcaaagctggagttttaccattagatgtaataagatatgatgaataaatagtttattctatttatttcattattaaattatttaaaaaaaataaaaaataccaacataactctataaagaaatttactaattttttatgagtataggttatatggtaataaattaattgacactgaggtgttttttttggatagtataatagaagatgtccaggttcgtaagattttggacagcagaggaaacccaactgttgaagtagatgtaattacttggaacgggtttggtagagctgctgcaccaagtggggcaagtactggttcaagagaagtagtatcattccctgaaggtggagtggacgtaattgtaagtgaaattgaagacattatcgcttctgaacttattggaatggatgctgaagatatagctactattgatgaagttttaagagaagtcgatggaactgacaatctttcagctattggtggtaacactactgtagctgtttccatggctgtagctaaagcagctgctgcatcatataacatgccgttatacaaatttttaggaggaaacttagtaaatgaattacctttccctctcggaaatatgatgaatggtggagcacatgcaggagttaatgcaccagatattcaggaatttttagtagttcctgtcggtgcaaaaaatatggttgaagcagtatttgcaaattcaagtgttcacaaaagattaaaagaattaatccaaaccaaagactccaatttcactggtggaaaaggagacgaaggtggatgggtacctaacattactaatgatgctgctttggaaattcaagctcaggcatgtgaagaagttggtgatgaacttggtattgaaatcagaccttccttagatatggctgcttctgaattatggaatgcagatgaacagaaatatatttatgctcaagatggtatcaaaagagatactggagatcaaattgactttgtaaaagacattattgaaacttacaacatgttttatgtagaagacccatttgacgagtctgattttgacggatttgctcaattaacttctaaagttggagacaaatgtcttatttgtggtgacgatttattcgtaactaacaaagaaattttagctaaaggtattgaaatgaatgcggctaatgcaatcattattaaaccaaatcaaataggttctttatctgaaacttatgctactgtaaaattagctaaagaaaatgatattgtacctgttgtttcccacaggtctggtgaaactactgatgcaactattgctcatttggctgttggtttcggttctcctatgattaaaaccggagctatcggtggagaaagaatagctaaattaaacgagctcatccgtattgaagaagaacttcctaatccaaaaatgggtgaattttagacaagcttattggagatttggatatgcctattgtaactattaattatgataagtgtaaaggtattgattgtgcagaatgtgttgacgtttgcccaatggaagttttagttcttgaaggggacaaagttgaaattgtagatcctgaagactgcagtttctgtgaagtttgtatggatgtctgtcctgaagaatgtgtcaatgttgaagatgatgattaaatttatttaaaaaaaattattaaaatatattattaaattaaggtgattaattatgtccgaacttttaattgaattagataactacttagcagcaggtttacatatcggaacccaacaaaaaaccagcgatatggaaaaatacatattcagagtaagatctgatggtttatatgtattagatattcaaaaaactgatgaaagaattagacaaattgctaaactcttagcaagatacgacccagaagatattttagtagtagctaccagacaatacggtcaagctcctgttaaaaaattcggtgaagttaccggtgcaaaaaccattcctggcagattcattcctggaaccttaactaatccaacttatgcaaaattcattgaaccaaaaattattgtagtaactgacccaaggtccgatgcacaagcagttcttgaatctaaacaaaacggaattcctgtaattgcattatgtgatactgaaaacttactcagttttgttgatattgctattcctgtaaacaacaaaggtagaaaagctattgctttagtttactggttacttgctagacaaatcttaagggaaagaggtaccattcctgaagatggtgacttagatattgaagctactgactttgaacttaaattttaagtgagttttatgttaagaaaacctgcagttgctggaatgttttatccggatgattccgaagagcttgtaaaaactattgaagattgttttttacactctttcggcccaggtaaaatcccagacattgaatcttttgagggtaatgattatccagttaatgttatggttccgcatgcaggttttcaatattctggaacaatagctgctcatagctattgtgaattagctaaaaatggttttcctgaagtttttataataattggtccgaaccatactggtctgggcagtgaagtttcagttttcaacaaaggagaatggataactcctcttggaaacattcaggttgatgaagaatttgcagatactttaatttctttttcagattttgcatcagctgattttgcagcccatatgagagaacatagtatagaggttcagcttccgtttttacagtatttttccaatgatttcaaaatagttcctgttgtactgggttcacaaacaatttcagcagcaaatgatttggcggcagctattttaaaagctggtgaaaaattagataaatcctactgtgttatagctagcagtgatttatcccatttcaatactcaggagagagctaataaagttgatgggtttgttttggaagatattgaaaatatggatgaatttaaacttttagaagaaattattcagtataacattactatgtgcggttatggtccggttatgactacaatgatactttcaaagatgtgtgggaaaaacacatctgaaatactggcttataaaaccagtggagatatatctggtgatttaagttccgttgtaggttatgcttcaggtatttttaaataaggtgtgtttatatgagggctttagcttctgctccagcaaaaactattttgtttggtgaacattctgttgtttatgatgaacctgcgattgcaggagcagttaataaaagggcatatgttgaaattactgaatcaaagacggataaatctattttaaagtcttatgatttgaattttgaagctgagttagatactaaacataaaaaatataatttaaaaagaggaaagccaggtattattcgatatattttagaagctcttaataaagttcacgatcacagtccaattgtgatgaaattatcttcaaatattcctattggctctgggcttggttcatctgctgcagttacagtagctacacttgctgcactgtacagatttcacaatataagattcaacaagaaatctttagctcatgatgcacatatggttgaacaggcagttcagggaatagccagtccgttggatacattggtttccacttatggtgggcttgtttatttgtccagaaataagaaagtggagcatttcaaggttaacttcaatgcgccgtttgttgtaggatatacaaataaacatggcaatactggcaaaatggttaaggatgtcagactcttaaaaaacagaaatccgaaaattatcaatcctgttattagtgcaatgggacagttaactaactatgccaaacaagctatattgaaacgtgattttgataaaataggggagttaatgaacctgaatcatggatttttggatgttttaggagtaaatactttagaattgtcccgtatggtttatactgctagggaatgtggtgctattggttctaaaatcacaggagctggtggtggaggaagtattatagcactttgtccaaatagtgtagatgaagttgcccgcggaattgctgcagaagataatgttttaaaaataagatttaccagaaaaggtgtttcttcaagggtttacaagtgatttatatgattattttaaaaattggaggaagtatcttaacaaataaggatgctgctgaaagcgaaattgatgagaaaaacttgtcaaggattgcaaaggaaattaaatcctcacttgataatgattctaaggaaataataattgttcatggtgcaggatcatttggccaccctccagctaaagaatataaaattggagaaccttttgacaaagatgaatatcctcaaaaaagaataggattttctaaaacacaaaatgcagttaaaagattaaacatgcttatttgtgatgaatttataaaagaagatttgcctgttgtagctgttccggcttcaagttttatggtagctactaataaaagaataactgaaggcgatttagatagctttaaaagatatttaaataaaggatttattccagttatttatggggatgttgttttagataatgatttggaaatctgtgttatttctggtgatcagattattcaatatttagctaaaaatcttaatccggataaggttattttaggaactgatgttgacggagtttataataaaaatcctaaaacccatgatgatgcggttttctttgataaattttcttcacttgaagatttggataccttagaaggaactaccaatattgatgttactggcggaatggtcggtaagattaaagagcttttatatttggcagatttgggaatagaatctaaaataataaatgctgaaattgaaaataatattttcaaagctttaaataatgatcaagtaaagggaactgttatttcaaggggataataaaaacatgatttcagatagaaaattagagcatctattaatttgtaaaaattatgatgttgaatttaaaaataaaaaaactggtttcgaagatgttgaattaatccacaaagcacttccggaaattgataaaaacgaaattgatttatcaacttctgtttttggtaaaaaattagattctcctttatttataactgctattactggaggacatcctgctgcaaaagccattaacaaacaattggctattgccgcagaaagtaaaaatattgctttaggtgttggcagtcagagagctgctattgaacatcctgaacttgcagatacatatactgttgttagaaaaaatgctcctgattgtttgcttgttggtaatattggagcacctcaattggatttggctgataaagctgttgaaattttagatgcagatattttagctattcatttaaatcctcttcaggaatcaatacagcctgaaggagatttggatgcaagaggttatcttgattcaataaatcagataactaaaagagttgatattcctgttatggctaaagaaaccggctgcggaatatctgctgaaatggcaaaacaattggttgatgccggcgttagttatattgatattgaaggtgcaggaggaacaagctgggctgctgttgagacttacagagctgaagacaggtatttaggtgaaacattttgggactggggaattccaacagctatcagtacagtagaagttgctgatgcggtagatgttccggttgtttcatcaggaggtatcagatcaggtcttgaagctgcaaaagctattgctcttggagctgatagtgtaggtatggcattaccatttttaaaacactctgtttctgaagaacaattaactacattcattgacagattcaatgattctctaagaatagctatgtttttagttggcgcaaataatatcgaagaactcaaaaattcaaacttggttataagtggaaaaacaagagaatggcttaatgaaagaggaattaacacaaagaaatattcaaggagataaaaacatatgagtgttgaagtaatcgcaattggcggatatgaagaagtcgggaagaacatgactgctgtcaagattggcgaagatgttatcatttttgatatgggaatacacttggacaggatcaatattcacgaagatactgatattgataggatgcacagtctagatttaattgaaaggggaattattccggatgacactttaatgaaagatgttgacggtaaagtaaaaggaataatcttctctcacggtcacttggaccatattggtgcagtagctaaattggctcacagatatgatgctccattaattggaactccatatacaactgcacttgttgaaaaacaaattaaaggggaacgtaaatttaaagtaaataatccaatcagacctttaaaccccggaagtaaaatgaagctgtctaaaaatattactttggaatttgttcaatcaacacacagtattccgcaagcagtttttccggttttacatactcctgaaggaattattgtttatgcacttgattttaaatttgataatcatcaaaaagtatctccaccacctgattataaaagattaagggaattaggtaggaaaggagttcttactcttattgtagaaactactaatgcaaaaaatacagaggaagttaaaacttattctgaaagaattgcaagaaatattttggaagatgtaatgcacggaccgttatatgagaaaaaaggtatgattgttactacttttgcttctcatattgaaagggttcaggctattgcagacattgctaaaaaaagccacagggaaatttatttccttggaagatccatggaaaggttctgtggcattgcacaaaaacagggtattttaaaattacctaaaaatgcaagtatttatggaagcccaaaagcagttaataaagctttaatgagagctgatgaagacagagaaaaatatttgcttgtaactactggacaccaaggggaaccagatgcattgcttcctagaatagccagtaacagaactccattcaatattaaagagggagataatgttattatttctgcaccgattattccaaatccaacaaatgctgctaacaggcatattatggaaagtaaattaaggtcaaaaggtgcaagaatttattcaaatgcccatgtttcagggcatgctggaagagaagaccacagggaattcttacgtatgttaaaaccacagcatattattccggctcacggagatttatcaatgcttgctgcttacggagaattagctgaagaggaaggttacagaattggttataatgttcatatattaagaaattcacaagcacaagtttttgaaaatgaacgtgcacatggaggaaattagcatggatgtaatagaagaattgggaaattattccgttgatattagtaaaacaatagaagaagaattatcttgcatagttccaaacaatcttcaagaagcttcaatttatttaactaaagctggaggtaaaatgcttagaccagctttaactttaattacttctgaagcagttggcggatctagggataattcattgaaatctgctgcagctattgaacttatccatacattttcacttattcatgatgatatcatggatgacgatgatatgagaagaggaaaacctgcagtacataaagtttgggatgaaaatgtagctattttagctggagatactttattttcaaaagcttttgaaataattatgaattcagaccctgaaaaaaatacaccgactcagttaagccagacattagctactgtagctgatgcttgtgttaaaatttgtgaaggtcaggcttccgatatgagttttgaagataggtatgatgtatctgaagaagaatatttggacatgatctttaaaaagaccggtgcattaatagctgctgcttccaaagctggagccattatgggtggagccaatcaggaagtaatcgatgcaatgtatgattacggaagattaattggtcttgctttccaaattcaggatgattatttagatttagctagtgatgaagaaacattaggtaaacctattggaagtgacatagctaaaggtaaaatgaccattatagctattaaggctttagctgcttctgagggtgaagacaataaaaaattattagaaatcttaaaagatgataataattcacaggaagatatagatgtggctcttgatttattcaataaatatggggctattgaatatgctaaaaatgttgcattagaaaatgtaacttctgctaaaaaactactcgaaatattgcctgattctgaaagtaaacagatgctttttgaccttgcagattttgtacttgaaaggcattcttaaattcatttgggatttcaaatcctatttctttctttttttgattaactgatttattttatatatttaaatattttatgctgtttttttttaaataaaacaattttaaaatagttttaattctttttatattcaataaacatttaaacagatattcttaaatctctgatgggacttgggtggtatttctcttgacttttagtaaagtttgattaattaccgttaaactaacaatatttatactacatcatattaatattaatatatgaactttaattctgcacgagacattatttcagagtataaacaaaccctcacaaccaataaaaaatttattttaatttatttggcggggattttgttttttgtattttcaatgttttgccgggataacttcatttactttaaaggggagttaataggtttagctattcttttggtttttggaagttttggcatattgtatggtattaaacataaaaaagaacctcataaagttgcttttgtaattattattctttttgggttgctgatggtattttttgcacctccaatgtcatttccagatgaagctattcattttgcacgtgcagaatctataactgaaggtgttttataccctgtaaaaacccctaacggttattatattcaggattatttttttgaaatgaatcaggcaaaagcaggaacaacagttattatgtatgattttaataagcctataaatgattcatggggttattggccggcatctacaaacactccattttattcttatttattttcggctttgggaattttaatagctaaatgtctggatttgtctgttatatggacattatggttaggaagactggctaatttattattgtatggaggttttgtttattttgcaattaaaaaagctcctgtttataagatgccattgctgtttatggcttgtttgccgattgcagtttcccaagcttcatcatttagttatgatgcatttatatttggctgtgctatagtgatgtttgcttattttgtctacatgtataaaaataagtttgaaactaaagatttggccatatttttcatagcatgtttgctgatgagtttaataaagccaccttatgtctttttagctttgagtatatttgctgttcctaaggagaattttccatctgcaaaacttcagaaatattctgcaattgtcacatttgcagtttttgtaattgtaataatgtattttggaaatttttttaatcagtttattggtgctagtcaacacactacagattatgtattgaatagccgtaatgcatcatttaccgcccagatggaatatattatgggtaatcctacagctattggtactttgatgttgtttgcagtcaaatctgtatttgatgtatttgttgtcaattcaacattttatcattttgcagattttaaagggttgattttatttaatgcaatttatctggtcttttttgctgtattttctgttggatatcagtatgaattaaatctgtccagaaaaagaaggctaatattaactgctattgttttacttgtgtacttttcaatattcggtattttatactgtacatggactcctgttggtgcaagttacattgtcggaattcaaacaagatattttgttccaatgcttccgttaattcctttaatagtaaatataaaacatgagaaatttgaaaatagggatgatttatttttaactttaataatagtgtttttagcaggtttatttttacttactgtttcacattattattagctattttttttagctgattttcaaatctttcattatagttgtttgctatttcttcgtactggttccagattccgatagcagtatttggaagtatttcaccattttcctttgaaaattttgaatatatatgcatcatttcttttgaatcagatattaacagtttaacataaggaatatccgttgtatagacatttacatttttctgattaactaatttggaaatattaaattctttgtaggatatccggcagtaaggtgaaaccataaggtttattttaacattttcagattttaaaagaagttcataaactaatttggatccttcgtcctgaagtaaaaatcctattctcatatttattgtttttttagactgtctgatgatttccagttctttatcgattatattgtccaggccacttattctccaaattggagcttcaacttcagatattttcttttcatataatgtattcagattttcgccggttttattaattcttctgataaatttttctttttcccttttcaatacattaatcggaggatttacatgatatgttaagggccgtccactttctattttgatgtagtcttttgaatttaatctttttaagacatcatatattttggatcttggtatatctgatttgtcacttatttcatcagctgtggcctgaattagtgaacttaatgtaatatatgctttagcttcgtatgtggttagccccaattgttttaataagttgatgtcttcctgtttcatagtaattattttgttttatccattaatataacttacttttcacccttaacaagttacaaaatctttataatggattaaatcaactgttattataataaataatgaggtggttattatggtagatatgttttgttatcaatgttcacaaactgcaaaaggtaccggatgcactgtacgtggagtttgtggcaaagaaccaactgtagctagattacaggataatttgatttttgctttaaaaggaatgagtgcatacaattataatgcaaacgttttgggagttaaagactctgatgttgatgaattcttaactaaaggattgtattccacattaactaatgttaattttgatgctgaagacttgattaatttgggactggaagctggtgaagccaatgttaaagtaatgaaaatgcttaaacaagcacatattgaccattatggtgagccggaacctgcagaagtaaaagtaggtgcacaggaaggtccagcaataattgttacaggtcatgatttgaaagcattagatgaattgttaaaacagactgaaggaactgatgtaaaagtttatactcactctgaaatgttgcctgcacatggttatcctgaacttagaaaatatgaaaatttagcaggtcagcttggaggagcatggtttgaccaaaaagacatattctctaaatataatgcagctattgtagcaacaagcaactgtgtactgcttccaaaagatgaatatgcagacagaattttcactatggatgtagctaaattaccggatactccagtagtagaaaattacgacttcaaaccagttattgacaaggctattgaattaggtggtttagatgctgaagaattaacaacaatcactacaggatttggagcatctacagtgctttcacttgctgataagattaaagaattggttgaagcaggtaaaatcaaaagattcttcttagtaggaggatgtgatggaccattccctaaatctaactactacagagaatttgtacaaaacttacctgaagatgttgttgtactgacattagcctgtggtaaattcaaattcaatgatttggatttgggagatattgaaggagtaccaagacttatagatttaggtcaatgtaatgatgcaattgttgcagtagatattgcacttgcattatgtgacttatttggagttggattaaatgaattaccacttactattgttttaagttggatggaacaaaaagcagcagctattttatggagtttattatatctgggcaaaacagatatgcttattggacctgtgttacctgcatgggcaaatgaagacatacttaattacctagtaaatacatataatctaacaccaattggtgatccgattgaagatattaaaaaaataatgggcgaataaaatgagcgaagatattaaagctaaatctttaaacattgaaaatttggttgattatcaaaaagatacggtagttagtagggaagtaatcaaaaaagagcttggaacagtaacattttttgcatttgacaaaggtcaaggcttaagtgaacactctgcaccatttgatgctatggttcaagtaattgatggtgaagcagaaataactatttcaggtaataaaaatattgtaaaaaaaggtgaaatgattattatgccagctaatgagcctcatgctcttcaagctgttaatatgccatataaaatgattttaactatgattaaatctgattaaaatcatttattttacttttttgattgctgaaaagatttgtgtaattagggttatttataatgtgaaaattataaataactactttttccaccaaattaaaatccagtcagctttatcttttttattgtataattttcctgtttcagaatcttttttaagaatttcattaaggtattttctcaattgtgctttttcatcatcattaagtaaatccagcctaaatttaccgttgtccatagcttcttcaatgctgctgtattctctatatgctttaatgtccaggcgttctatattggcataaatccccatgttgtagagtatattaaacatataattatactctggaaacggcttattttcttttccgatgtattcattgaattctttttctattttccaattttcaggaccaaataaagtgataaaaacatatttgttagctatttcatttattgttttaagagtttcttcaattgggattattccatttaatgaccttgaagcaagtacgacatcataatctccaatttcttcataactaatatcctctaaggattttaaaatagtgtccacgtttttgatattttgttcttgagctctttggtttaatagttccaacattttagttgatgaatcaacacctgttacttttctaacttgtttagctataggtagggtaattgacccttcaccacagcctaaatctaaaagactgtcattttcatttaaaataagctttgagaataataaatcatgataatcatcttttttagctcttttatgaaaatggggagctgctttatcccagtctttgtttttgtctgtcttttgtttgagtgcttcttgccaatatttaagccagtcaacttcgttcggattggttatagtctgtttcattgcatttacttcctttttttaatttacctaaaaacgtgattcataaatctgtttagctagtgaagctacagcagtaattaaaaatattatatttgcagctaatttaactgtgccattaacaggcagaaaattaactaaaatagccagagctaaaaaaatataaactaatttgcttaaattaattgtgtgtttgctatatttaagatcagctatgcccatattaagtagttcctgcttttctttttcacaatctttcaataattttattccctcttcatttaaatcggcacgaatttctatagcaaggattatgtccattgttttatttaaacatttcattgcctcttcgtatttctgcaattgaattaatgatagagcttttttgtgataccattcaatacttaggtattctttacttccacttaatgattttattccaatatcgaagcatttaatagctttttcgtgttggtttaaattaatgtaaatgtctccttttataagaaccccttcaataaccctttcttttttcaggcatttgttaactagtttcaaagcttcctgattttcattatttttacataataatttggcttttattagcatggctaaaatgctgtcgggatattcgccaagcagtttatttgcataattcaggcaattttcgtctgattccttttcgaaagtgtaaattagtttaagttcgcaaagcttttcttttgactcacaggtgattagttcatcactgtatggactttcatgataattctcaataagattgtcaataatttgtttggattcttcttcatttccttttgcagatgatgcaatagctttttgaaaacgaatggatgttgagtctggccgttcttccaaatatttattgaagtatttttcaccataatcattgttgtcatgatatgcgtcttcaattaggtggtaataacctcttagaggaagtgcaggtatgtaatttttttccagaagcaaattattgatttctaaaaattctttcatgttctttttttgaaataatataaatgaaagctggtttgccttttcatattcttcgttgtttattagtttaatcgcttttttatttaccatatttaatttcacctatcaatctacgatggtttttccgtttaagatattttcataatcctgaatattttctttaagtaattgagggatatttaaactgtagggacattttttaatacattctctacattcatcacattttttggcctgtttcattttagattggaaatcttcacttaaactaggctgtgtaggcattcttctaatccataaagacattctggcacatgtattaatctcaatatcatttggacagggcatacaatagccgcatcctcgacagaagtcgtctcccagttcctgtttgtctttttttatagcggtttttaatttatcatctaaaaccggaggattttcctgataggatataaattcatccaattctgactctctttgaattccccagataggcaatacattatcataatttgccataaatgaatatgctgcttttgagtttgtgattaatcctccgcccatagctttcatggccaaaaatccgacatctaattttttacatttttcaaccagatttagttcctgagcatcggttaaatatgaaaacggaaattgcagtgtttcataaagtccgcttgaaagagcttgtttggctattgtaaatttatgtgaagtaattccgatatgttttattttcccttcgtctttagcttccagcattgcttcataaagtcctgatccgtcattaggttttggacaaaatggaagattatggaactggtaaatttccacataatctgtttgaagatttttaagggaagtttctaaatccttccagaaatcctctgcattttcagctccggtttttgttgcaataattacattttcccgtacttcattaagactggcacctaatttttcctcactgtctgtataaaaacgggcagtatcatagaaattgattccattattatatgccttttgtatgatttcgatggaatcctttttatttcttctttgtattggaagtgctccgaatccatttttgttaactttataatttgttttcccaagtctaatcattttcatttagtatcactagtatccaataatttttaagataatataagctattataataattataagggcaattattgatgtttttgtagataggaatttaaaattactgaagcgtttgtcttccacattatttttatacattaatctgtctttttcaaaggaacatttttgataaatatcttcaaggtttttatctaatctgcccttttcattcaacatgtcaatggttttgtttaaatgcttgaccgcttcatcatagtttccaagttcaacattacaaaatgcagccttataattgaaattagtaactaactccaagtcatctttaacatctttttcatgagtaatgcatgaattataggaatccaaagcttttttatattctcccaattcatataatgcatttccttttgaatttaaagctattattgtgtggtcttcatctaaacttttatccagatattccagtgccttttcatattcgccggttttttcaagaagctggcctttgtagaaaatttcttttttattttgaccgaatttcttttcatatttgtttatttcatttaatgcttttttattttgattgtcctgcattaaaagctcaattttacccattctaacttcttcatggctaattctaggctcttctttttgagaatatgcatcataatttttaaaagccttatccatatatccaatagcttctgttaatttatttttattggataaagacattgctttatcacataatccgttaattgactggggctctatttccaagtacatatcaaaatatttttcaccgtaatctccattgtcatgatttgggtcgtaatattggtgatagtgacccctttcttcaattgcaggcaaatatttttcttgaattaataagtctaaaataatcaagtattcatttattttatcgtttccatgtctttttttagctatatcgagagcttttttatattcttcattttttattaactcttttgcttgttcaagcttactgctcattatatcatacctaagtttttattcaactccgtaaaaataaataactactcttagtgaatatttatatattttcaagtaaataaattatattattaattactatttttatataaattgtgatgatgattttatgaatgatttagaagaaattgtctataaacatgctttattaaatgctgctaagcataaaggaagtgcaaatccgggggcagttattggttcaattatgagtcaggaaccggatttaagaagtagagcaaaagaaattggtccaattgcaggaaaaattgtagctcaggttaacaaattaagtgaagatgaacagtcagctcaaatggctaaatatcatgtggaagtaaaagaaaataaacagaaaaaagaagaaggtcttcaggagcttccaggttctcatgataatgtagtaatgagatttgctccaaacccaagcggacctctacacattggtcatgcccgtgcagcagttccaaatgcagaatatgttaaaagatatggcggtaaacttattttaagaatagaagatactgaccctaaaagagttttcgaacctgcatatgatttgattcctcaggatttggaatggctgggaataaaagcagatgaagtttactatcaaagtgacagatttgagatttattatgattatgctcgccaattgatagaaaaaggtgctgcttacatgtgtacatgtgacggtgctacatttaaggagcttaaagataactgtaaaccttgcccatgtagggacaacagtgttgagaaaaaccttgaattatgggataaatttgatcagatgcatgctggagaagctgttttaagagtaaaaacagatatcaatcataaaaatccggctattcgtgactgggtagctatgcgtattgtagaagaaacccacccacgtttagggaataaatacagagtttaccctatgatgaacttttcagtagctgtggacgatcatctaatgggtatgagtcatgtacttagaggaaaagaccatttggcaaacagtgaaaaacagaaatacctttatgaccatatgggatgggatgttcctgaatttatccattatggtaggttaaaaatggaagacattgcattaagtacttctaaagctctggaaggaatcagctcaggtaaatactcaggatgggatgatccgagattaggtaccttaaaagcaatagccagaaggggaatccagcctcagacaatatacaatttaattactgaaatcggagttaaaatgtctgattcagctattagctggaaaaagatttacggattgaatcgtaatttcttagaaccaatagctaaccgttatttctttgtagaaaatccggttgaaataactgttgacggatatgaagatggagctgttgatatcgaaaggccattacatgcagaccatgaagacaggggaaacagaatattgccctttgcaggaaaagcatatttggctagtgaagacgttaaagatggaatatctcggttgatggatgcagtaaatgttgatattgacggagataaaattacttataattcaacttcttttgaacaggcaagagatttgaaagctaaaatcattcaatgggttccggttgaagacaatgttaatgtaagtattgttatggatgatgcatctacaaaaacaggtcttggtgaaggagcactaaaagatttaaaagttggggatgtagtgcaatttgaaagagttggatttgcccgtttggatgaaattaaagataatgagttagtattttattatgctcataaataggtagaaatcatgacactgtttactaacggatatatcactctcccaattcctaaaggatttcaaagcataaacagcacagaggaatttgttgagttagttttagttgatccaacaaaacctatgactattaaggtatcagttactcctacactggctggattggttgatatcaaagaaagtattgaaaaaaactttgaaaatggtaatggagaattgattttctctgattttctccctattaatgaagatatttattactcagctatttcttctatagatgatggtgaagtatctgcccgttgcaatgaattcctatttgttaaagacaataatctgtattcttttgaatttgtatatccttatgcggatgcagaattggatgatttttatttaaatatgattcgttcattaaaaataggaaaagcaaaatatatagtagaaaaagaaagttacaggttaaatgaataaaaaaataagaaaaattttttcttattttaatatatttttttaatgtcttttgaattgatggtaatttttttacctctgtattttacagatatgtcattacctctgattccatagactttacttgaatatgattcaccgtcatgtttaaagatgatttcagcacctttacgaagaattacttcatcattgtttatttttattttaagattatttttttccggtttttcttttattttaatgtcgcttgcacctgaagattcattcattctaagtgtgttttctgtttcggaatttttagccatgttaaatactttacgggtattttcctgtcttagtaattgttccggactttgttcctgataatcatagtcactaggatagtcttcatgtctttcatttacaataggttcatattccggaaatgcaggttcttcattgtatgcgccaacatttcttaaatacatttcatctgcaatgtgtttttcttcagttattggggtttccggagcaagtttttcttttacttcattaaatattttggaatttttaatggagtttgttattttagccaaatcttttctgtaatctaaatcacctaattcattttcttctgtttcttcttcatctttaaataattcagattcttctaatggagctccaaattcataatcttcttcaacagctggaagaacacttaattcgttttcttttgaattgattttagttggagattttaaacttggtgtttttatttcatcattgttagctaaaacgtctgcaacatttccttcatcaggtgttttgtcttctttatcttcagttaaaagatctttaacattgtcttcttttgaaacgtcagcactttcttcttttttacctttgcctaaaacttctgcaacactttcatcttttggtgttttgtcctctttttcatcagctttgattgcattagttatatcttcagcacttggtttttcttcagtcttatctttagatgcatcattaataacatcataaagattagtttctttactttcagcaggtgtttcagtaatggactcacttttgatttcagttataggatcgtcttcttttttgcctgcttttctttgtttgatactttctttaatttctgtagtatcttctttttcttttttaatggttttagattctttttcccttttactatcttttctttttgattctttaatcaattcgtcgatactgaataaatcttttaattcatgttttggtttttcttccaatgaaatattattttcatttatttcttttttggtgtttttgttatttttactcataatatccatctgggtttcgtttattggttcttgaaacttttgaactttggtttcataattaaaatttatatgtttcgcaggatcttcttcattttctgatttatcggaaaatagatgttcgttggtttcaggaacaatataactattgaagttatcttccggtatttggccttgttttcttaaggaagtacctttaggctggtcttgtttagagaagtatgttgaaacaaaagatttattgggtgcggtttttgataaattattttcactggattgacttaatttgtttaaactgtcctttgacaataaaggagagtcgtctttttctaattcatcttttctaaaatacagttttacgataattatggcaattataccgactatcgcaatattaatccacactaatatggtagtttcattcattttttctccacttccttattaaaattttataacttataattatatatcagttatttataattatatatcagttatttataattatatagttttatattttttaaaatttttaaaaaacagttagtttatatattctgatagctaaaatataaattatattaataattatatgaggttcaatcatggttgttaaaattaatgaaaactatcttaaattaaaaagtagttatctttttgttgaagtagcaagaagagaagctgaattccaaaaaaataatcctgatgcggatattattaaaatgggtattggagatgttaccaaaccgttagctcctagtgttattaaagcattccagggtgctgtagatgaaatgggtaatgctgatacattcagaggttatggtcctgaacagggatatgattttttagctgaagaaattattaaaaatgattttgaaccgttcggagtttctcttgacactgatgaagtatttattagtgacggagctaaatgtgataccggtaatattcaagaaatttttgatttaggtaataaaatagctgttactgatccggtttatactgtatatgttgatactaatgtaatggctggaagaactggtgaaatgaaagatgacggtatgtatgaaggacttacatacttaaaatgcaatgcagaaaacggatttgttccggaacttccggaagaagatgtggatattatttacttatgttatccaaataatccgacaggtactactcttacttatgatcaattaaaagtctttgttgattatgcaattgaacataaagcaattattttatttgatgcagcatatgaatgtttcattcgtgaagatgatgtgcctcatactatttatgaaattgaaggtgctaaaaatgtagctattgaattcagaagcttttctaaaatggctggtttcacaggtacccgttgtgcttatactgttgttcctaaagaagtggcaggttatgacagtaaaggcaatgaagttcagttaaaccagttatggaacagaagacaaactacaaaattcaatggtgtttcatatcctgttcaggttgcagcagctgcagtttattctgatgatggtaaaaaagaaattaaagaaataattgattattatatggaaaatgcaaaagtaatcaaatctagcttggaaaaattaggtcttgaagtttatggtggagtcaattcaccttatatatgggttaaaactccaaataacatggattcctgggctttctttgatttattattaaatgaagctaatgtagttggaactccaggttcaggattcggaccaagtggtgaaggttatttgagacttactgcattcaatactttagaaaatactaaagaagcaatggacagaatttccaaattaaatttttaggtgttttttgtgaggaaaattgaaaaaccagttgaaattgaacagggtgactcatttaaagttatcttatctaaatacggtgctttaggtttagataaacaggaaaacttatcagaattaatcggagatttggaaggtcagttggatattgaaaaaggtgtcttaacatttagtgacgatatttcatttaatgttcagattttaggtttcttcaatgaagaagctaaaaaatggtcctgggcatgggataatgaaaatataggatttgatgaaagtctaattgaagctgcaaaagaaattcatgaaatcggtttaaaatatgaaatcggccaatttacaactcctgaatttgaaacaacttttgatgattgtcatatatgggcaatggtagctacttctattttaaaaatggacggatactatggagttaatatggaaggattggatatctttgtagctattaaatctgatttgatagttgaaaacaattcagttcttaaattcagagatacattctacactttccagaagaattttgaaattttcccaaaaatagcttttgaatcatatacaaaacttaagggttatcctttcaaacagaaagaagagtttgctgtcgctaaacttggtgaaagtcgtattattacaagttttactgaaagaggtaatgtaactcacattcaaatgcttttagaagatgagtgattttatgaatcaggaattagttgatgaaatagaatatacaaaagaattattagctaattctgggtttttcaacagggaagatattatagaaatattggaagagcagttcattgaagatgacattgatttttccaatattgaaatatcttttagtcagaaggataactctaactttaaagtattggaaaatgcctttatcaaattatccggtgaaaacattatagctatccataactgcggttatgatattgaagagggagtaactgatgcctttgagttatttgttcatctgaaaaacaataaatatgaccctgtgggtttttgtttttacacatttgaagatgttgaggaagctattgaaaacaataaactgaaaatcacttttggagattttgagaatagtcctgataaggctttggaaatcggaaaaattgttttcagcactttaaaagaatctaattttgatgttaattgggacgaaacagttaacaaccagattgaaatttccattgaatgggataaaatttttgatgaaaataaggaatatgaaatggaaggcgcttttgaagcatatataaataataattaggtgtttgaaaatgaattcaaaatcattaaatttaattgaggaagttataacttcttttggaatgtgggattctttagaaatagctcaagattcaatatatctggaatttagtgatgttgagttgggaaaccctaaatataatgatagtttaaatttatccttcagattttcagacaagtcatttattgtctttttttataataacatctgggatgctgagtttttagctaattttgattttaaaaaccatttcattaatgaagattttgttttaaaagtggaaaaaattaaatttttggattttgaatatctgaatacctttttttataattatgccaaagataaagtcctatctttagatggggagtttgatattcataatatcagaaatgatttctttgttttacttgaaactgaggaattagctattgctgttggcggaaatgaaatggatttctttttcaatgatttaaaattagatgacgatagcttaaaagaattatctaatcagtggattctttattttttgaaatatcgtttaaaaagaaatattatcatgaaagatccgatgtgtgaacataacacattaatttaaaataaaattaatagctgttttgttataaacagctatcttttaaactcttttttccaatttaaaaatacagtttgtccttggatttgtagcctatatggcagacaataaaacaaagagcactgattacggttataatcagtaatgttatttgggaacaggaaataagctgaggatagttagatggctgaattattacatttcccatcattattgcaaaaatcacagttaatattccagtacttaatgtttgaccaagtattctcattgtagctactgcacttgatgccattggagtatcttttggaggaacactgctcattatagtgttgatgtttggacttgcgaataatccgtagcctataccctgcaatgcaagtgatacaagtacaattacaattgatgtgtctttatcaagaggtacaagcaggattaaaccgacagttacaattatcattccgattgttgcaattttttgaggatcaattctatcagataattttccggctgctggagctacaatagccattaataatgggaatgtaattaaaatcagtcctgaaagctgtgaatcaaaaccgcgaacatactggaaattgtaattgacaattgtagttactacaaaggtagctatgtaacttaatatactggctatattgcttgataaaaatttcttatttttatataattttatgtcatatgcaggatatttggagtttaactcaattttaccaaataaaatcagtaaaagcactccagcaacagttattatgaatcctattgttgtattaaatattgaaaatccgtaaatcaataataagattccaattgcaaagactatagaacctttcaagtcgaatttttcattttggtatttgaaccattcctcttttattgtaaaaagtaatattaggtttaataatataaatggaatcattacccagaatatggattcccagccgaaattataggttagactgcctccaagtactggtgccagtgcaattccgatatatgtgcagcttacagttattcccagtgcctgacctcttttttcaggacttattgcctcagcaattattaacattgaatctacacaaagaccggcacctccgattccctgaattactctgaatattaataattccggaattgtgtgtgataggggagttccaatacttccgattaacattaaaattacagaataaataaatgttttcttaactccatatctgctgcagagctttcctaaaggaatagctaatactcccattgttaataaaaatatatttgtaacccaattttgcattatattacttaatccaaaaatttcagccattttaggcagtgcaacaggcgtaacatttcccatgtatgcgccgtaaaatgtggcaagagaggctacagttataacaataaaatctctttttttatttgcattcataaaaaacaactctcttttttatttattataatgtagtttgtattttttaagtaatatgcaattttctatttgatttatctgttataatcataaattcattagatgtaaaatagaattattaaatttatataaattgggagagatgtttttaataagagtaatataataaaattgaataggtttaaaataaaaaaagaataggtgtttaacacctatttgtaacttaaagctttttcaggacatgtttcgatacattgtccacataatgtacagaatcctgctattggaagtttaggattatctgttgtttttagcatattatatgggcagctgtttacacagtctccacattggtcacattttgatggattatattgtattcttggtctttttataagtgtgccatttttatttatttcaaattccgtatccagtgttaatgcattattcggacaagatgatgcacatgctccgcagcgtatacaacttttaaataaagggtcttcatcactttttatctgttccggaacggacattcctgtttttgtaaccacatgaatagcttgtgtaggacatttcattgcacatgctccgatatggtcacatttttctgcatcacaaactactccctcttcagtacatggtgttgcgtcatggagttttacatttaatgaaattgcatttactgaacacattttttcacataaaccgcatgctgcacacatttttggaagagttattgttagattgttggtattgaatttaataaagtctccgggacatatttcaacacatgttttacaacctatacatgaggattcatttagtttaaactcagtaatttcttttgttctttttgttggaattttttcagagataaatactgcattccatggacaggtttgagaacaaacaccgcatttaatgcaaatttcagaattaatttctattggttcgccaagttcatttaaactgattgcctgtacaggacattcttcaatacaggttccgcacccaacacagttttcaatataaatcggtccttcaatattgagttcacgatgatttggatctttaatgccttcaattcctacataatccaaaggacatatttcaacacattgctgacacatgacacaaaatccttcaagaggaattttaggattgttggttagtgttatagtgttttgagggcatgtttctacacattttccgcactgatcacattttaggccattaaaaattaatcttgcttgctgggcgccaccttcttcaagtgttaaaaagtctacttttaatgcatcattgggacatatttcagcacatttgggggaatcgccacaggtatcgcagtgaattatgttattaggttgtacttttatagcatttgaaggacatattccttcgcaggcttcacatttaatacaatcgtcagtattaaaaataatcatttcaaaacctcttttttattctaaattcaaaggacctaatttgctgactgttttttcaaattcttccattgttttttggaatttttcaccttctgaagcagatacccattcaaatttaaatctttctttttcaataccaaattcttctacaatgtcttgaaccataaatgctcttctgttccatttataatttcctgcatcatagtgacaatctccaagatgacatccccctacaaatactccgtcagcaccttctttaaatgctttaaaaactaaagacgggttaattctgccagaacacattactcttataattctaatgtttggaggatattgcattcttgcagtcccggcagtatctgcaccaccataacaacaccaattacataataatcctactattttaacatcactcatattatcaccttttattttataaaatctctttttttggactgtataatggaggtttctcttcggatattcctgcaatatatccagttctatttttatattttctttgtattttgtcgaatagtttatcaacaggtatttccataggacatacgtctccgcactgtccgcagtttacacaactaaatgccatgtgggataatcttacaccctggaatgaaatagcgcttggcggacagttttcgttttcattttcaaagtatgatttttctaattcacattcattacaccagcagattggacatatgtctctacatgcataacattgaatacatctgttccattcatcagagccaatggaaatatcttcgtctaaaagtgaggttttttctttttcacccatttttgtcatgagattttctattttgcttcttattccaatagctttttcactaggtgttttaccttcgatgtaaccttcagcttttgcctggtttactatttttgctcctttttctgaatttatttcaatgaatgtccagccgtcttcagcaccccagtttccacaggctatatctgcattacgtggaactttaaggtcacatctttggcagttatgtcttctaccatatccgttttcttccagttcatcgatactgactgctttttcgctgccgtcttctaattcaactatgaatttaccttttgcaatttcttctttaacaacagaacttggatcaatgtcatagtataatttaagcatttcacgtgctgttataggacttattgttcctccacagttcagtcctatagtgtaaatattgtcaggattgattctgtgtcttttaattaattcatttactgcttttgcatcacatggttttacagctattccgatttttttatcagataaatatttgctgatgaggtctgcagtcattgttggtgcacaatgaagtgaaccgcttgtttttaataattcttcactggttgttgcaatagttggaattccatcatagatatcatcttcaggttttaatgttaaaacaccgtctataatgttgttgtctaataaatattgtaaaattccggttacagctcctccaacagcagcttttttcaatatctcttcgtctttagaacgagctagaatataatttgaactcataaacataccttctataaatcaatatctaatttttcggaaattttcattaaaatttcaatttcagaaagattttcatttacaatgtctggaacagctattttaaagttttgatttgtatttacactgtttgtgtaagatccttctttaaaagcccaaggttttccaggaattacataatcgcttttatttacaatatcatttttaaaataagaaatggtaactatcttttttatgctgtttaaatcgtcttcagttatataatcgagaggattttcattgacaattaataaaacttcaatatttttcaattcttcttttaattcatttaaattaataggatctattttatttaatgctcctttactgttacattttttgtatataggtaaaattttagcattggtttttaatcctatttcagatattttttggcagttttcttcattgtctaccttattgaatattataattgcatcttcgtttaattcatctaaaatttcttcatctaaactatcgaggaattcacttacagagtcaaattgaatatatttatcggagtttatggaagtggtatttttattttcattatctgcacaaataacttttgcaccattttctttagccattattactcttctggcaactaaagggttttcatcatataagtctccgataatcaaaatggttttggaattgttgatgtcatcgtaacttgtagctgttttgtcaaggtttacaaatccattttcatataagaataatttgtttccatagttttcactgaatttttttatcaaatccaattcttcatttgttgaatttcctgaacataaaatcccgaactgttccggttctacattttttatatcttctataaactgttctataatgcttttaaaatcagattcatttaattttccgttatttactatggaaggttcatcgattttattaaatgaatattttgtaaaacagtatctgccatttttacagttttttccttcattaatttcatgtcttttgtagggataagttccaagtaattctttattatttgagattaaagttatgccacagccagtactacatgatgggcatattgtatgctttaaatttaacatatatatcactactctatcaatttatcaattgattttcaaaaaatgcttttgaaaatgttgtttcgttttcgttttttatttcataaacattctgtcttgtcagattaatcatttccattagaatatcactgctttttttaactaaaatttgagaaaataattctttttgaaatttttcgtattcctccagaattattctaccttcaacttttaattttatatcaaaagagccataattttttaaaatgcaatcataatttaatactttttgatcagtgttttcatagtctacagaccagtctaagtttaatgttaattgcttatttttagggttaggatttaatcttattaatccaaccttttctatatggatttccatttaatcaccaagctccaattaataaattatttttttaaattattcaatcaaatatttttagaaagaataatctatttaaagtttttagtaataattatataaattttattaattattttaagcttgtatgggatttatttttaatatttaacagtaataaaagtattttatagaaaattagttttaattaaatgggtgttggttaatttaatgatttagagcccagttaattttttgagtattattttagctttattttattttctttaatttcagtttaatttttgttatagtttgttaatatgatttattttttattttttcaatcatgattatttttttgtagtttttatagtttaatatgctttataatctggtttttattggattatatttgttttttaaaagtattactttttactaaattcttcctatttttattaacatttttttataaaaaagtattacttaaaaattttttatttatatatgtttttgttttttgtattatctggctaattgatttttattgtattttttgtctatattctgggggatttttaggctataaattgctgattattattttttttcattttttttcaaaaaaagtaatacttttttatcaaaaagtatttattatacttagtcactatatatgattgtttgaagatgattccgtaatttcgtaagaatcataattttgctcagctgtgttatcttgggagtggtttctattttcaaacaaagtcatctctttttaaaatagatgaacattacaatttttacaaaaaaataagaattagttttttaactaattcttatagcctttatgtactgatttttaaaagataatgtggtggttatctttgtgtggtgtttaatttatcatcagagttcattcctacaagtgatactaaaacacttatgactccaagtactgttgaacatattaaagctaaatgacagctttcactaagttgaggatatacgctaggggttatggccacattacccattacaaatgcaaaaataactgttaaaatgcctatacttaatgtctgaccgataactctcatggtagctactgcagctgatgccatggttgtttcatttggcggaacactgctcataattgtatttgtatttgggctgctgaacagtccatatccgacacctccaatcatcaatgcaataattatgatatatactgatgtggagtcatccattgttgtcagtattaatatggctattgttgcaagtcccattccaagtgctgagagcttttgaggatttatcaaatcagacaattttccggactgcggagttacaattgcctgcattataggcatgctgattaaaatcagtccggtcatttgtgcattccagcctaaaatatattggaaatggtaattgataattgtagatacactaaaaatggaaatataacttattacgctggctatgttgcttgataagaatttgtggttcttatataatcttacattaaatataggatatttctgttttaattcatagtaaatgaatattattagaaatattactccaactgctgtaattgcctgtccggttagtgtatgcagttctgtaaatccatacataaatgctgaaattccaattccataaaaaacacttccttttatatcaatcggatcatttgcatctaatttccattcctctttaatttttaaataagtaaggaccactacaataaaacttacaggaagtgttattgcaaagatactttcccagccaaagttatatgttaaacttcctcccagtactggagccagagacagtccgatataaactgaagctatgtttattcccaatgcacgtcctctttgattatttggaacagcttttacaatcatacttactgaagatacaaatattgcagcagatcctattgcctgaataaatctgaacagtaatagcatttcagtatttgctgccattattattccagcagttcctatgaaaaatacaagtgcaccatagaagaatgattttttaagtcctttttgggcacaaatttttccgaaggggacacttaatacagccattgttaataaatagaggtttattgtccagttttgcaaaatattgcttaggtgaaatactcttgcaagttccggcagagccattgttactgcatttgatgtgtaggcagccataaaactagccagtgatcctacaagcactacataaaatgctgttgtttttttaatcatttgtttttatttctccgttttattgtttttttaaaataagaatattaatatatttgttaagtatgtacaataaaactttgccagcaactataaaaaaattagtttgggaataaatagttataaattttatttattccagaaaaaaatccgttatattctttgttatgtatattacctatcatatcttcgatacggtcatctaactctttagtataagttttgttgttgtaatcataggttgtgaagtaatgaacttcaatactataatttgtatcctcttttgggaaaacatagtttactccgacatgatcccattgataatcattatctcttgaaggatttgaataatactgtttggaaacattaatgcctcctaaatcaatattttctttttttaatactttaaaacctccagattccatagaagcaaatttggcatttgaaatgtcggttatacttgattccggccaatcatcccatacatcaataatagtgtagttgtttgtaattccattatctgtttttgcttgactactaaggtttacttcatctgttgtgttccaggcttctggaactacaatatttgaatgtccaaattcaatggttttgtctgtatggacacttaaaaaattatttatggcacccatattagccacaaaaaatattattataatagcaataacaatgctcataaaaatatctcttttttgcatattattcctctattcctttatgtttggttttatcccattttctttcttttctaataatcattttaaacattgtttcgaaaaataatggtattaaatggaaacaataaatccaataaccgataatgtcttttataaatttgttttaattttcatatgatgttgatttttttgaaatttgattttgtatttattattataaaagaaaaatgcattgaaaatatattgataatggggtattttggaaaagtttttaaaagagtactaacaaagtattttagtgttgtgaaaatttttatttttcatgttttaatattatgaaaggagttattaaatgacttgtagtattttagtcggtggagcatggggtgacgaaggtaaaggtaaatgtatcacttatctttgcggtaatgataaaccggatatcattgctcgtgcaggtgtaggtccaaatgcaggccattctgtagagtttaatggtgaaaaatatggtttaaggctcatcccttctggttttgtacatactgatgctaaactcatgattggtgctggagtattagtagataaagatgttttatttaaagaatttgaagatttaaagaaatataatgtaaaagaaagaacttttgtggatcctagatgtgctattattactaaagatcacagagaaagggacaaaaaatcagaacatttagctaaaaaaataggaagtactggatccggctgcggaccagctaattctgatagggtattaagaacagttaaattagctaatgatgttcctgaacttgaggattatttagctgatgtttctttagaaactaatgatgttttggataatggaggggatgtatttattgaaggttctcaaggatttgcattatctctttactatggaacttatccatttgtaactagtaaagacactactgcaagtacatttgctgctgatgtaggtgtaggtccaactaaagtcgatgaagtaatcaatgtatttaaagcttatattacccgtgttggtgaaggacctttcccaactgaaatttcacaagaagaagctgaaagtaaaaatattgaagaatatggtgttgtaactggacgtaggcgtcgtgtaggtttatttgatatggaacttgcaaaagaatcctgcagaatcaatggtgcaactcaaatagctttaacctgtgtagacagattatatcccgactgtgctagaacacaaagttatgatgatttatctgctgagaccaaaaaattcgttgaagaaattcaatctgaaactggtgttccagtaactattatttcaacaggtccggatttaaaggacactattgatttgagaaaagaattattataattaattaattcctttcacttttttttaatttatttttgcttatttgttgatattttttaaaaaggttttgttcatggctttaattttaaattttaagaatgtttcagaaacttttatatattgctatttttaatacatattactgtaatttaattatggtgatgatatgaataaaaaatcaattataactattgttataatcgttgcagttatcattattgcagctggagcatatatgttttactccaatcaagatgatggtacagtaactatcggttatcttccaagtgatcatgatgcagctttattcattgctgatgctcaagacatgtatcaaaaagaaggtattaatactaaattagttcaattcaataatggtggagacttaatgactgctatggctagtggtgaagtggatgttggatatgtaggtatcactccagtattgtcttcaatagaaaaaggcgtaccagtaaaagttatttctggtgtacagactgaaggtagtggaattgttgtaagtaacagttcaggaattacttctgttcaggatttagaaggcaaatccattgctactcctggagaagcttccattcaatatatgttgcttaaatattatttaaatcagaataatattgatattaaagatttaaaagtttctgcaatgaaagttccttcaatgaatgatgctttaaaatctaatcagattgacggtatgttaacttatgaaccgtttgtaactactgcagttgaaaacggcaatactgaattggttgactcatctgaaatcatacctggacatccatgctgtgtagttgccgcatctgatgatttcttaaaagaacatcctgatgaagctaaaaaaattgtagaaatccatggtaatgctactaaatatgttcaagaaaatcctgatgattcagtatcccaattaccaaaagacatagtatctaatccggatattgagaaaaaatctttaagcggaatcaattttgtttcaggattggatgatgcatataaacaaaaagtattggacttcatgaatattgaagttgatttaggtgtcttaaaagaaaaaattcctgcagaaaaaatcttttatgatgtaactgcttaatttatcttttgaatgtaattttttataagttacattccccttatttttttttttaaattttgattctgttgctgctgaaagatacagcactttagtttgaagaattttaacaatagtttattgcaaaataaaaagaagtagctatggttatatttaaaagttttatttttactgtaatataatcaaagcaatttttaatttaaagtaggaactttaatgtttttttaaaatatcttttgtgctatctacataatcaatagctatttttaacaagtttgtaaatgtatttacgatttccataattgcattatccagatctgcaatagcttgatccaattcggaattgtctattccgatatttttcaaattgccaatactttttacaagactttcttggtattgtggaaatatctgatttatatatttaaaaaatggttcatattcattgtaattaacttctttttgatttaagctgtctacaatatccaaatacattctgttaaagtctttggcactatttttaaaagatggagttgtgtttttaatttcttcaattaatatttttatagcttcaggattgttattttgaagttcatctgcatttttctgaattatttcaccgatattttgaaatcctgtatttaatctggttatagctatggtatataattccaaatctatttcattagttatagtataacctccaactaatgtttaaaagaaaaaagagtaatttctcaaatgagaaattataatttgatttttatatcaagagcacttgatccgttttcgtatacgaaaattgggttaatatccaattcggatatttcagggaagtctaaggttaacctagctactcttttaatagcttcttttacagcatcaatatcgcatggtgcttctcctctgtaacctttaagcaattcgctaactttagtgtcattgatttgctcatcaatttcctgactgctgataccgttagctaatttaaaggatacatcttcaataaggttaacgtaaattccacccataccaaatgcaatcatcggtccgaattgtttgtctttaatcataccgacaattacttcctgaccggtttccatcattttttgcacttctacaccatccggcacaatgtcaggatgtgcttttttagcattagctatgatttcatcgaaagttgctttagcttcttcttcactttcaattcctacttttactccgccgatatctgatttgtgaagtattttgtcagaagctattttaagtacaacagggaattccatatctgctgctaattggcttgcttcatctgcattggtagctaatttaattggtgcagcttcaattccataagcttcagctactgcatatgcttcactaccaagtaaggtgtctctgccgtcagctttaactttagcaaatatttcttctacagcttttttatcgatgttgtctaaatcatcaatacatgaatcagcttctctgcgttccaattcagcataggttgtcatagctgcaagtgcatctactgcattttcagggaaaacataagtaggcacattgtgggaccttagtgcatggtttgctgcttcaaaggttggtccacccatgtttacaactaaaataggttttccgaatttttctctttcttctaagattgcagctgcaattccgtctgggtctgcagatgctgtaggacaaaccataatgattaaactgtctacttgatcatcttttaaaacaatatctaatgtttctttgtacctttgtactggagcgtctcctaaaacatcaatagggttgtttacactaccttcttcaggaatacctttccttaatttttctttggtttcttcatcaaattgaacaagtttcaatccctgtctttccatttcatctacagtaagtactcctccaccaccagcattggtaatgatagctacattgtttccttctggaagtggtgctttggaaaatgccaatccgatatcaaataattctgccatgctgcttacacgaagaattccggattgttcaaaagcagtatcaaatgccaagtcactaccggctaaagcaccagtgtgggaagatgcagcttctgcaccggcattacttgaaccggatttaagtacaacaattggttttttagcagtggtttgtctcattgctttaacaaaattatcatcgtcagatattgattctaaataacatataataactgcagtttcagggtcttcagctaagtaattcattaattcggtttcacttacacctgctttgtttccaagactgattactttactgaatccgattcctgaagtaagactccaatcaagaagtgctaccatcatagctccactttgggaaataaatgcaatatttccttttggcggcatcatttgtgcaaatgaagagtttaatggagtatgggaatctgtaattcctaaactgtttggtccaataatatttatcccatattctttactaagtgcaactaattcttcttctaattttgcaccttcttctccaatttctttgaaaccagcactaataactaccatgttttctacgccagcttcaccacagtcttttattgattcatttacaaaagctgcaggaatggacatgattactaagtccaccttttcaggaacatctttaatattttcatatgcttttaacccttggatttctccgctttttgggttaattgggtatacttttcctttatatcctccagagatgatattatctatgataatataacctactttacctggggtgtttgaagctccgattacagcaactgaatcaggtttaaacattttattgagatctttcataggttttttctcctagttctttaatttttaccattatttaaattataatttttatgacgttataatttgtaatgataaataattaaaaattattatactactattttatgctctattgttatataaagattgttattatgaacacttctataatctttttaattaattttaatgctatgttttaatactttagaaggagttataacgaatttctttgcttggttatatatgatacgattttttaatggaaattttttagggtcatatcaaaatttgatgaaaatatataacttataataaatataatatattattaacttaaattattaaattaatttttattcattgttaattttagaggttaggaaatgagtttgattattgcttatattggaaaaaaaggatgtgtaatggctagtgataaaagaagaattggttattttgggaataaagagcaattaaatgcattggaatctgaattatacagtggtaaaataaaaaccgatgaggaatttaaaaagaaagctgatgaatacggcatctcaattaagttaactgaagatgctactaaaataaccactgtgggaaattgcgtaaggggagaagtcacaaccaaaaaagtttttgaaacatacaggaaaagaatttacggaactacaatgggttaccagatagtggaattgtcaggttctgaaactgtttcaagggaagccggtgaaaaggcaattattgtatttggtaataaatttgccaaacaggaagcagaaaagctaataaacaaaaaatggaaaccttcattaagtttaaaatatatgggtgatatctttgaagagatacttaccgaaatttctagaaaaacaccaacaattggaaatacttttgatgttttaatcaaacagcctaaattcaacaaatcagaagctcaaagacatcttaatgtaagtattgataaggatattaaggttttatctaaatttagacaaaagcttcaggaagatttaatccaaaaaaataaggaaatagctttggctgataaaattattaataaaggagatgttggtgaagttgtttcagtagatgggaaaatgcttcatgtcaaattaaatagtaaaacacaggcttttgatggaaattggaaacagatagctaagccaaatgaaactgttttcatgttcagtgaccataaccatgtggaacttggagataaggtagttatccaggatgaaaagttatgtcttaaaaaggacaaatctaatcttaaatgtgatataattttatgcagtttataaaggagattttttaaaatgaaaataacatttttaggtactggaggtggaagattctcagccattagtcaaagaagaatgactggcggtttcagaattgataatttaaacgggaaaaattatcatgttgatccaggtcctggtgcacttgttagaacttaccagtttggatttgacccaagaaacttagacggtgtttttgtttctcatgcacatactgaccattacaatgatgcagaaattcttattgaagctatgaccagaggaatgaccaaagaatatggtgttgttttaggaaataaaagtgttcttgacggttatgaaaaatggggtccgggaatttcaaaatatcatcaaagccactctaaaaaatatgttttggagccaaatcaggttgaaaacattaacggatgttctgttaaaggtacaaaaacagtgcatggtgatcctgaaggtgtaggatttcagattgattataggggttttaaaatatcctatacttctgatactggatattttgaggatttgcataaatatcatgaaggggcggatattttaatagccagtgtgcttaggcctggaaataaatctattaggggtcatttatgttcacgtaacttcattgagttgttaaaagaagtaaaaccaaaactggctattatgactcatttcggtcttaaaatgttaagtatagatccgattgatgaagcaaaaagaataactaaggaaaccggtgtaaaaacactggcagcttttgacggaatgtcttttgaagtaaacactcaaaatcctgcaaggattagaattaaaaccttaaaggatgttaattctcaaatccacagttcaaacattgatttaaatagaatggagagaaaaaacacttatcaatcttcattaaaaaatggagaaaatgatgagcttactattggaaaaaactgattagatttccagattggaaggatggatgtatcctgatctaatcatatggtctgcaagaacaatagctacactggattgggctacaacagtagctcttggacagatgcaggggtcatgtcttccctgaatagttatgtcttctgcttccattttttctaaattaactgatttttgacattttgaaattgaaggggttggtttaactgcaatccttgaaattattggcatgccattgcttattccaccaataattcctcctgaactgttggttgaagtgtaaattttattatcttcaatataatattcatcattaatctctgatgcgcagctggtagctacatcaaaaccaaaaccgatttccactccttttacagcatttatattcattaaaattctagctaaatcaccatcaagtctttcaaatacaggttcgccaagtcctgcaggaactcctacagcgactgtttcaacgattcctccaattgaatcaccttcctgttttttagataaaattaattcttccatagctttagcagcttccagatcaccgcatcttacagaatttttctcaacattttcttttacagtatcaaaatcattgctgtgagccattatgtctccgatttgaataacttgtgaaacaatttcaatattttttgtttttaaaagctttttagctattgctcctgcaattacatggccgatagtgattcttccgcttcctcgacctcctccattgtagtcataattgccgtatttgctcatccagccataatctccatgagatgggcggggagtatttttaaacatggaataatctttggaatgctggttgttgttatagacaactcctgtaattggtgttccgtcagttttaccctcaaaaattcctgataaaatctgaactttatcttcttctttacgtggtgttgttactccgctggttccaggttttcgtttatccagttctttttgaatatcttcagtgtttaattcaagattggcaggacatccatcaataactgctcctacagcttttccgtggctggatccaaaactggttactgaaaacatttttccgatagtatttgccatagttgtttctccaataaaaatcttatattcatagtaatataatataaatctaataaatgttttgttgagtggtatgactgaaaataatattaatctgatttatgacaaattacttaagacatattcttatcaggggtggtggcctattataggttatgacggctcaaatcccactaagacaggggctgttaaaggttatcatccaaaagattatagctttccaagaaattcaaaagaacagtttgaaattataatggggtctgttttgactcagaacacttcatggccttcagtagaaaaagcattaaataatctaagtcttttatgtgatttttcagctgaaaatattcttgaactggctgattcgtgtgaagatgagtttaaacaggctattcgccctgcaggttattttaatcaaaaattcaattatcttaaaaatatagctgaattttatatttctttagatggtgaaattccctccagaaaagaagttttggctgttaagggaataggcaatgaaacagcagattccattttgctttttgcatataaacaaaagcaattcaaagtcgatgcttatactaaaaggatattttcctatttgggctattttgacgaaaaagaaaagtatatggatattaaaaaattatttgaagataattttagcggtgatgttaatgcatatcaggagtatcatgcattaattgttgagcatgggaagaactgctatttgaaaaagccttatggtgctgaagataggattttagatgaatttaaaatatgataaatattaagtgtaatattttactaataattatgtaggtgaaaacatggtatttccagttacaagaatgagaagatatagaaaaaactctaaaattagagatattgttcgtgaaactaaattagacaaagaagatttgatttatcctatttttttcaaagaagaacttcagggtgatgaaaaagaaccgattgaatctatgcctggtgaatacagatattcattaaatgcaggtattgaatttgcaaaacaactggaagaaaaaggtttaaaatcaatcattgtctttggggttccattgcctgaaagtaaagatgaggtggccagtccggattactcatctaccggaatagttcaaagagcaattcgtgaacttaaaaaacagactgatctggttgttattggtgatgtatgtttgtgccaatacacttctcatggacactgcggattaatcaaagaaaatgatgatactgacgatggagtggaaatattaaatgatgaatcattggaatatcttgctaaagtagctgtttcttatgctaaagcaggtgtagatattgtagctccttctgacatgatggatggcagggtagacgctattaggacagctctggatgaaaatggattttataatgttatgattatgtcatattcagcaaaatatgcatctgcattttatgaaccattcagggcagctgctgattcatcaccaactcacggaaaccgtaaaagttatcagatggatcccgccaatgctttagaagcaatcagagaatgtgaacttgatgtgattgaaggtgctgactttttaatggttaaaccggctttgccttatctggatattattaaaacaatcagggaagaatttaccttacctttagttagctataatgtaagtggagaatactcaatgattatggcggctattgaaaaaggatttttaactgaaaatgcaattttggaaagtttaatttctattaaaagagcaggatcagacttgataattactaactttgcatcatatgtgcttttaaacgatttgctttaagttgatattatggattcaaaaacaatagctaaaatagctcagatagcttcagcattggaagtaagcggatatccgaagccgggaaatgttcatagaactcgcgattttgaagatatggaatttgaagactttgtaataagcggaattgtaattggagatactattgaaaaagcaacttcaaaagtcgataaaaacagccttcaaaatgcaggattaggtaaatatatattggaggctgtaaaagaaacagacaaatggatagccaacaatacaaatcttggaattgtaatgatgattactccaatagcctgcggtgcagctatcagtgatgatttttctcaacttaggaaaaacacagctgaattaatgaaagcaactactgtggaagatgcagtggacttgtatgatgcaattaacattgcagatgccgggggaatgggagatcaggatgagtatgatgtagctagtgaaaatgcaaaagaagaattaaggacaaataaacaaaccatgtttgatgttttagagatttctgcaccatgggacagattagctaatgaaatgactactggaatgcctgttgtttttgaaaaaggttatcctacctatagcggtttaaaaaaaaccatgaaagctaatgatgcatgtgttttaacatttttaactatcttgtctgaaactccagacactttaatttcaagaaaatacggtgacaaaaaagcagatgaaatttcatctcaggccagagaattgctttcatttaaagatgatgagagtttttcagataaattaaatgaatttgataattatttatatgaaaataaattaaatcctggaactactgctgatttaactgcagcttccatttttgtcagctatttggaatcaaatttctaaatactttttttcttttttttattatcttcaaagctcatacttaaattaaaatatttctttttcaattcttctttttaaataaaagctatttttagctaacatttataaattctatttacatatattataatattatttattatttaaggtgtttaaatgagtggggatattaaaaaaaccattagtgaattacatatttatgagaaaaaacttttaaaagaattggaaactaatcctgatgcaactcctgaggaaatagctaaaaatacacaaatggatattaaatctgttatgagtgcagcaggttcccttgcttctaaggatattattgaagtggataaggatgttgaagaaattatttcattaactgataatggaagtgaatatgcagacgggggacttccagaacgtaaaatcctaagagttttatcttccaaaaaagaaatgaacatgggagatttagctaaagatgccgatattgataaaaaagaaaccaacatagctattggttggctggttcgtaaaaactgggctaaaatcaataaaggtattgtaactattactgaacatggtcaggaatcttttaaaatcttaggaactgatgaaaagttattaaaacatttgcaggaagctaaaaattccattaaaagcaatttgcctcctgaattgttagacggatttaaaaaacttaatgacaggaaaaatattttaaatattaaaaagaacacctcacactcttttaaaatattagataaaggtgaagctatattaaaagaaggtttcactattcaaaaacaagctactcaattaacacaccaacaattaaaagatggagaatggaaaaatttagaataccgtccttatgatattaatgctgaagctccaaaagttttccctggtaaaaaacatcctttaagggaaatcattgatgaaatcagagaaatctttttaaacatggggttcagtgaagaaaatggttctattgtagcttctgcattctggaactttgattcattgttccagcctcaagatcatgcagcccgtgaaatgcaggatactttttatgttaaaaatcctttaacctgtgatttgcctgaccagaaattagttgatgaaactgctgaagttcataatactggtggggacacaggttctacaggatggcaatatgaatgggatgaagatgttgcaaaacaaacagttttaagaacacatacaacaggaatctcaacaagatatttatatgagcatgaagctccgtttaaaatgttttctgtaggcagagtatttagaagagaaactattacttataaacatttgcctgagttccatcaggtggaaggacttgttggcggtgaaggtgttaactatcaaaacttaatgggctttttaaaagaattttataaaaaattaggttttgaagttagatttaggccggcttatttcccatacacttatttatctactgaatgtgaagtttatctggaagataaagaaagctggattgaacttggaggttctggaatgttcaggcctgaagttcttaaacctttaggtgtagatgttcctgttcttgcttttggtttaggtattgaaagattagctatgattagatacgatatttctgatatccgtatgctttacaaaagtgatatcaaatggcttcgtgaattgcctacaacaaatggagttagattataaatgtcagttaagctcgtttcctggaatgtaaatggtattagggcagccagtaaaaagccggagttttgggattggttcaacagtactaatgcagatattattaattttcaggaagttagagctactgaagattcaatacctgaaaaattaactgatgtcgcaggatttaactcttattttaatgaagccgaaaagaaaggatacagcggtgtcggcactttttctaaaatcaaacctgaaaatgttgttaggggtttgggagttgaagcactggacagggaaggtcgtgtactcagacttgaatatagtgatttcactcttttcaatatttatttcccaaatagtggaatgaatgctaaaaggttggattataaaatagacttctgtaatgctttgcttgatttgcttgaagatttgaaaaatcagggtcagaatttaatcattacaggtgatgtcaatatagctcataatcctattgatgtttacaatccggcaaattgtgaaggcaagtcaggttatcttattgaagaacgtgaatggttagatgatttactggctagtggttttgttgatacttttagaatgtttgatgattctggagataattttacctggtggagttacagaacccgtgcaagagaccgtaatgccggctggagactggattatttctttgtaaatgaagaatttaaaaataaagtaaaatcagcaaccataaaaaatgatgtttttggttctgatcattgtccggttactttggaactggatttataatattgtatttacatcaccaatattttcaataatggtgatatccaattgctcttttctgatgtatgctctgtcttcttctgtaacatcggaattaacaagtattgcactcattccggcatttactgctccaagtgcatcttctttaaatttatttccaatcattattgatttttcgggatcaccattcatttttcttaaagctacatcgtagattaatttatccggtttttttgctcccacttcttcagatgttattacttcatcaaaaaatgagtatacattgagtcttactaatttttcccattgtttaattgtaattccgttggaaataacacctaaacgatatccctgacttttaagatagattaatgtatcaatagtttcagcaaatggtcttaaaagagctattttaacattgtggtatgttatcatacctaacgcaacaagcatagggtcttcatggcctaaaaccacttctgttaaaatattaaagtgtttaccataatttgatcctttctgtcttatgatggtttttaaaacaccatatgcttcatctttgtctaaaggcaatccattgtctaccattaattcaatagctgcttttcttgcagtttctgcaaatgttgatgtgtcaagtaaagtatcgtctacatcaaaaaatacaacacggtcatcattagggttattacgcatcattatatctacatattattttagtcttatttaaagttttattagaaaaatgcatctaaacttgtttgtttttctccttgggctaagtcttccaaatcctgttttgtgtagcctaaggaatacattattcttccaatagccggaatcatctgattgtttatatagtaatctctatcatattctgctccttcactgtagtcataaggaactgctctctggctgatggaaccttttccttttacaatcacatattggataattgttcctttagttattttaattccgtgttcttccatttttttagctgcaaccacatgtggtccgatttgtttgtattcgcttaatggttttgtgatttgtgtgtggattatcaattcctttccttcaatttttccagtttttagcctttttaaaacttttttaactgtatttattgctttggttgtgtttccttcttttaggatgtcctttaggacgtctttttgtgtttgtttaacgattggtgcccagtctcttctgactaattccagaccttttgctatgatttcaccatcttcaataactgcatatctttttttacttacaaaaaagcctcttctgtagaatccttcatattccagttccataacttctggaagtgttgcattaaggtcggttatgaatttttgagcctgatttttaatttcagcttctaattccagttgttcttttgtttcttttggcaatttttttacaccaattttattttagttatttattattattgctttgataatttaaattgttattgttttgaaatatttaatcgggttaatactgtttattttagaaatattgctttaaaaattaactatttaattgaaaaatacttataatttcttttcaaatgctcttattggttaattatttattttataagattataacaatatgtgaggtgatatgtcatgaaaactcaaagattaatttctagctatgatgaaataaatgatattttctgtggaaaaatagacggtaaaaatggttattttgcaaattatgcaatgaatgaaggaatttttataaatattgataaaaatggatgtcctgtatctgtttttatagatagggcatctgatattttaaatgttaaaaaagaaattttggaagaatctgatattaaaatcgggcttggctgtgatgattgttcaatatattttgatatttttgtaaatggtgtaaaaatttataataacaaatttgagaataactgcggaattcctgaccttaattttcttttagacactgattattaaaaaggaaatattctttccttttttaattatcccatatatttataatttatttttgatatatcattaaatgggaaaacgaataaaaaaattatattttttgactttgtttttaactgattatactcagagtatcagttaacacatggtcaaattataggataaggttaaaataatgtctgaaactttaattgaactgcggaatgttgttaaaaaatatgatgatgttgcagttgtaaataatctgtctttggaaattaaaaaaggtgagatatttggatttttaggtccgaacggtgctggaaaaagtacttctattaatatgatggtcggattattaaaaccgacaagtggaaatatattattcaatggaaaggactcctcatatcttgatgaaaaggaaataggaatttgtccccaggatgttgtgctgtggaacaatctcacctgttttgaaaacttgtatatgataggaaaaatgtatgatattccaaaaaagcttttaaaagaaaggatattaaaaattcttgaaaaattacacttgactgataaaaaggatgagctgatatcctctttatccggagggatgaaacgcaggatgaatatagctatggctaccattcacaatccctctatcgttgttttagatgagccttcagaaggtttggatccgcagtctagaagactgctgtgggattatatccttcatcagaaggaactgggtcatactgttattttaaccacgcatctgatggatgaggcagatatgttaagtgacagggtagctattattgatcatggcaagttattaaaattagacactccaaagaaattaaagcagataatcggtaacggagatactgttcagcttgagctggataatcataaagacaatgaggggattatcagtgaacttaaaaccattggtgatttaaacaatatctttgaatctgatgaaaaaataattcttgttttgctggatgcagttaaaaaactgcctgatataattcatcttgttgaaagcaaaggttccaaaatagctgatatcagcatacgtcagaatactttggaagacgtgtttattgagctgacaggaagacaattaagagagtgagttaaaatgaaaatatttgatattgtccagttaaattttaaacagttaatcagagataagaaaaacctcttcttcctgttgctgtttcctgcagtattcatgctaatattcggtattggtttcggagataatgtggaaagtgatatagatatagctattgtaaatcatgatgatggggatgtgtccaatcagctagttagcataattgaagactttaattccagtgaggatgaaaaattatttacagttcataagattgatgatgaaactaaagcccaggaaatgctgaaaaacggctctgtttctacagttctgattattcctcaggattttaccagtgatatgggtaaaaatcagtccagtttaggtgaagttacagttaaaggaaatgcaattgatacagattatggtattgcaagcagtgttattgcaggaattctttctgaattttctaaagaaatcataaaggaagtttcaggacagacaattccggaaatagacttgaaatatgatgatctggatatttcttcatcatctctgtttgatatatatgctccggggctgattgtatttgctattcttatgactataactgtagttgcttccaatgtagccagtgaagaagaaagcggaatgattaaacgtttaaaactttctaaaatgaaaacaattgattatgtagttggaaatttaatttcctggtcttttgtcggtgtcattcaggtaatcataatgcttttagtagctgttttagttggatttaaatgggaaggaggaatttacacattggttctggcatgtattgtaggtattgtaaccacattttcttcagtggctgttgctttgataattgtggctttttcaaaaaatgcaaaacaggcttcaagtatttctccaattgttgctgttccattaagttttatagcaggagcatttatcccattacctgactgtgttatagctactataaataatcagcaaatacaaatttatgagattttaccttggaatcaagcaattactgccattcgtcaggttttaacttatggtcagggtctggatgcaatattcatgaacctaataattatattaataatgggaattatattattagctataagtgttctattgttcaatagaaaaatttcacgtgaaagctaatttaaggtttggtttgttatgaataaagagaatatatcttatgtttgtattattatatgtgcattagttgctttagctattgtttcaatttatgcgctggaatattctcaggaaaaaactaatctgaaaattataagtgattctaatttacataatggtgattcattcactttaaggttaagtgatgcttataacagaccaattgacaacaaatctgttgaaattactgtaactgatgcattaggcgaaaaaaactctttcaatgttacaactgatagctgcggagaaaatacctttggaatgcgtgttactccaggagtctattcatttgattgtgttttttcgggtgacggtaattataagggatctagtacttcacaaaatatttcagtttgtgattactagctattttcttttttaaatgaaattttattttttcttattttggaaggcaaataaaacatttatatataatgaaagagtaatattttattatcattattctttaagactctttattgctctcaagatttaaattgttatttatcttcttgtcacaacagtttaaatgaaagaggcttaatgacgcgattattatttaattatatttattaggtgaaataatggcaatttctcaaggaaaatcaactagattaccatccggtgcaaggaatgttgcaaaccgtggaaaaaggaaagctgaattaggtagagacccagctgaaactagagtagatgaaaaaagattgaaaaaaatcagaacccgtggcggaaacgaaaaactcagattagctactgctaataaaatgaatttaactgatcctgctactggtaaatcccaagttgtagatgttttaggtgtaattgaaaactctgcaaacccaaactacgtaagaaggaacatcattaccaaaggtgctattgtagaaactcctgaaggtaatgcaaaagtaacctccagacctggtcaggatggagtacttaacggaattttaatttaaataatttattttatttaaatttactttttttattaaaattagaaaattagctttttatatattgacttttttaagttatactttattttttaaaaaaaggagttaaaggaatttttattccttattttttcttttcattaaaagcactccaattggtgcaccaataagaatacctattattaatccaatgaataacggcacagcaaatgaactttgagactcttcattttgtgttggtgcattcattattttatttaatccgtcttctattgtatcattgttaacgtcgtcaactacaataaccctatcagatacttctgaatgtttctttaaaaattcatttccgctgtcctgataagctatcattagtatgcgtttgtttgtgttgtttacactgtgttctaaaatatgttccacatcagcctgtgaagtaaatttataaacactgatattcattccgtttgaatcagctatgtctttagctaactgtccgtttgtttcatctgcgataaccattgtatcagcagttacatcaactccatgtccgtatacagcagacatgattaaaggtattaataaaattataattaaatattttttattcatagtatcactcattaatctccattatttcaggtttcatagttttaattgcacttataataaccacatttgcagctccttcaattattgatataaataaataaaatgggagcaatgttgcaagtaatgcgtttaaactcatagttccagatattaataatataattatttgtccaagtgttgcgaatataattccaattactgttcctccaaatattgcaaacttttcatttaagtctttgaataaagtgtagaagaagtatgctgttatggatattataaatcctattactataaaattagctccaagagaagttagtccacccatattcaatgctaatgcctgtataattaaacttataaatgcaactatacttgaagaatatggccctaatataattgcaattaatggaattaaaaagaaatgaatcggaacacctaggggtgaaggaatagacagtgatgtaatgattactgtaaatacactaaaaatagccattgaaacaattttcttgtctttttgactgtctttttgaagtttatagaaacatattgccataattaatattgttaaaatccagtagataagtgcctggtctatagttattattccatcgggtatatgcattatatcactttttcatttatattcttatatatttaaatataatatgtatttaagtctttttattactttttttatatttttcattgaaaagtattactttttaaacatttttactaattgtatgtcgttaattggtactttgtcaatataataagtattacttttgattaaatgatatattaattaaattgccataggtttaacgaatattataaacattgttctgtttgtaggtctttgagactgatttggtgatacaggataacttggtattggtattggtgctttctatgaagggtgtttcatttttttttaaaaaaaaagtaataatatttttgctttttttccataatttgtaataatcatatttatatgggtattactttttatattagaatcgtattcatctttcgtgaatacgagtttaattaattaaaaaggaggtttgatttaatggttgttaaaaataacgggaagcgattcgtgtttatattattggtcgtgacattaattgctttaatgatgggtaatgtttgtgcagaagatgttaatggtacaaatgttgatacaataacaccaactaaatcaattaatgtagatgttaattacgaatacgcaaacgataataataatgtaattcctgatttttatatttattcaggtgaagataaaatagaatataacaaggagttggttagctcaaacagatttgttcttacatttaaggataattcttctaatgggtataatataactgctttgactgcagggtatatctctcaaagtcagattatcagtgattccattacttttaatttaaaagctagtgatgcatataaacttggtcgtgatgtaactgctgatgcagacagattattggactttaaaactgctgatgatattcttgttgtaacaacagcaggagttaccaagttaaatggtaaatcaactgaagatgcacttgaagctattttaaactacggaactaaaattaaatattcaaatgttttaatgttacgtgacactgctgttaatccaattgattttgcttttattgttaaaaaaggaaatgaattaaaagcagtaatttatgaaaacggttcaagatcttattcttacttaggtacaatttctgaaaacatgactagagaacaatggaacaactatatcaggtctattcatggccaaaatgcttggtcttttgcaagtttagctaatggatgggttgcaggtgtttctagagaagtacttcaggaagcagcattccacgggcatatttgtgaaggtacacttggtggttatagtattgttaaagctttaataaaatattaccctccagttcaagaaactttaactggcggaggatctccagctgatgttacttcctacaaagtattaggagttcctggaggctctgatgatgatgcagtactctttttcttagatgctacaattggtaaaacttcatatgttggaattgacaccactgcaactggtgctactgaaaatatgttaggttttattagatgggatgcaaaatcattatctggtgatttaattataatgagttttgattccaagaagataaaagctgattttaaagctgaaactggtattaatgctgatgctggaagcttagaagaattaaaatattgtacctggtggattaataaaattaataaaaatcctgaagaattagcaacatttttatatgaatttactaatttaactgaagaacaatactattatttgatgggaactgcaaaaagtgttgttcatggtaatgtatcaattgcacctgttgaatctcacggtttagatttaaaatatattttatcattaaatttaccaaaagcaacaagaactgttccttctggtgaatctggttcattatccgatgaagaaatgaaaaatattggttttgaagcatataataaagctagcgctatttttaaagatgaattaaatattaatttaggtaaagataatgtggatttaggtatatttacttctgcaggttatgtttatttaaatggtaaagaaactgttgcagtacgtgacggactttatgaaattgctggtgcaactttatacagtaaaaacttgttacaatatcaccaggcattatggaaaccgttatggtttacatttatattgcgtaatcctaattctgatgttttatactcagtttatttaaggtataatcctgatggaacatggtttgtcggtgaattaaatggaagtaatgttgttgatattggaattgaaactttaaacagttctgcaaaagtaaaagcaattcaaaaaacttttatgcctgaccaaaattggaatagtattcaatctattgcaaatgcatggaaatcaaatcctaattttgatcaaataatggcttttttataccataatcatgtttgtcctggtgtacaacctggatttttcataactgattatattcaacagaatcatccgttaggtgaaaatgaatcatataattacattgcatctagtacttattgtaaagatgacagtttgacttatctgttaggtgtatctccaggtatgggaacttattttgttcagaaattacctgattctgatgtaacttctacatatgtagatggggctactgatgaaggtgctttagttatttgggataataacttaaatattggtcgtgttgttattgtttcatttaaatggcctacaatagatactagtatgtatgctacttctgaagcaaaacgtgctgctcaaattcaagcattcattgatttatataagggaatcaataatccaaatgttttagaaaattttgttgttaaaaccagtgaggaaaaatggattactgctgagcaatttaatttattaaagtcaggatctggtgaattaaacactatggattatattaagagtcttgacggttcagtaactaaagaagatttgttaaaacaattagaaaagaataacaattcaaacactaatactaatactaacactaatactaactctaattccaactctaatgttaatgaaaactctcattcatcagcaagcagtgcaggtgtttctaataatcgtaacatgccacaaagcagcaattctaatgttggtgattcaaataatgcattagattcaagcagtgctgatttaggttctgatgatggtaaatcttacgaagtttctaaaaaatctccagctaaatccattaatccagattatatgccatatgtagtaattgtcatattaattgtcggaatattagttggtgtaggttatatgaaacatagaaaataggaatttttgtatttatggattgcatattaattttttagtatgcaattcttttaatattttttttgatttaaatgaattttaaaaatatattattgttaatctcaataatttctctaatatttgtttgtgtaggtggagtagctgcacatcctggacatggacatgagtatattgaagaggtttcttcatcttcagattctccccagtcagctccttcacattcaggttcatatcaacagtcacattcttcaggtggttcttctgcttctcacacttaccaatctaaaagttctcagggagtagctgaaaaaacacatagttctactggcgggaaatctgcaggatctggtgttgattcacagaatgatgtgtctgattctggagatatgaatgttgatgaggttaataattcaaatacaacagataacagtactgcagaggaggtagttgaagaaactaatcctttattcagcacatctaatatttttatttacatagtggtttttttagcaggtttgttcggttcaataattttaatgaagatattttctaaatgaaatgagattataaaataattatattgtttggatgtttgatattatttaaaataattgaatggattcttaaaaatcatttttttatttcttttttttctacatttgtcaaaactgattttttttattactttttattgaaatgtaatacttttaaaatattttaactaaatggcgtattaattaaattgcctttgttttaagtaattttttaaaatattgctttattgatatctatttaaaattaatttgctgtttttaaatagtttaatattgatattcagctattttgtgtagattatttttaaaattattttttagaaagtaataatatttttagttttttctcaaaattcgtaataattatgtttatatatgtattactttttataatgatatagtattcatttattatggatacgtgttttattaattaaaaggaggttgaatttaatggttgtcaaagatattgggaagcgattcgtgtttatagtgttggctgtgacattaattgctttaatggccggtaatgtttgtgcagaagaggttaataatacaaatgttgataccgtaacaccagttaaatcagtcaatgttgaagttaattatgagtatacaggcgataatgctaaggttatgcctgatttttatatttactcaggtgaagataaaattgaatataataaagagctgattaactcaaacagttatgttctcacatttaatgatactttttctaaggaatataatataactgctatgactgcaggttatgtttctcaaagtcaaatcattcttagtgattctattatttttaatttaaaggcaagtgatgcatataaacttggttatgatgtaactgccgatgcagataagatattggattttaaaactgctgatgatattcttgttataacatctgcaggtgttcctaaatataatagcaggacaagtgaagatgctgtagaagctatttataattatcagtataaatatgggcagtctattccgtataataatgttttaatgttacgtcagactgcagttgacaatattgattttgcatttattgttaaaagaggaaacgaattaaaagcagtaatttatgaaaaggcttctaaaactcctgtatatgtcggaactatttctgaaaacatgactagagttcaatggaacaattacttcaattcactttccggtgaaaatgcatgggcttttgctagtttaactaacgcatgggttgcaggtgcatcaaatattattcttcaggaagctgcattccacggacatgtctgtgaaggtactcttggaggatacagtattgtacaggctttattaaaatattattctcctgtcggggcttctgattactatgatattttaggagttcctggaggatctgacgacgatgcagttatatactttttagatgcaacacctggtaaaataggggatgttggaatcaatatgagattaaatggatatattggatttaacaccacttctactggagtgtctgaaaatatgattggatttatcagatggggtgcttcaagcggaactttaattattatggaatataataaaagtaaaatcactgccctttttgaaaaagaaacaggtattaatccgaaaagcggaagtttggaagagctgaaatacaatacctggtgggttaaaaatattaaaaataatcctgaaaaaatggcagatattatttatgaattcgataacttaaccagagctcagtattttgaacttattggtgacggtaaaactgttgaagctcgcggtttagatttggattatattctttatttaaatttacctaaagctacccgtaatagcgcaagtggtttggatattagcttgtctgataagcaaatagaacaaattggtgttgatgctacaaatttagctatttcaatttttaaaaatcaaaaaggaattgatattactaaagacatggtggatctttctgtattgacttctgcaggttatgtttatttgggatcttctgatactgttttagctagaaatggtattaataaggttttaggtgctactttaaccagtgctactttattgccaatacatactccggcatacaaaccgttatggtttgcttatgttttgcgttcacctgattctgatattttagatactgtatttatcaaatataatcctgacggaactttctttgttggcgaatttaacggcagcaatgtggcagatgttggtataaattcaattaacaattctgcaactgttaaagctttgtcttcaaaatttgcaattgatgaaagtttctttggtgtacaaagtattggaaatgtttggatgtctcatccggaatttgatcaattgctgtctttcctattccacagtcatgcatgtccaggtgtacagccaggtttctttataactgattttattcaggaaaatttcccgttaggtgaaaatgaatcttataaatatataggttcaagtatttactgtaaagacgacagtttaatttatttgttaggtatttctccaggtatgggtgattatttcctacaaaaattacctggtaatgaaactgattccacttatgcagacggtgcaaaagatgaaggagttcttattgtttgggacagtaatttaaatataggcagagcagttattattacttatacttctgccaaacttaaaaaagttgctgtaaatactcaagatgcaaacagacatgttcaaattcagacatatcttgatatttatgctaaaaaagataattcgttggttatttctaaacctacagttgaatctaacgaagaaaaatggattacttatgaacagtatttggaattgacttcaggttctaaagaccttaatgcattatcttatcttaagggccttcctagtgtatctaaagaagatttattaaactcaatgaaaaacaactcagaaagtaactctaattctaacactaacaccaattccaattcagattcaaatgctaatgaaaattctcattcatcagctaatgtgaataatgttggtgtttccagcaattataataatatgccgcaaagcagcagttatgatgtaggcaactcaaatgatgtgttaggatcagattctgaagtttctgaagatgagggtaaatcttacgaagtttctaaaaaatccccagctaaatccattaatccggattatatgccctatgtagtaattgtcatattaattgtcggaatattagttggtgcaggttatatgaaacacagaaaataggaatttttgtatttaagaattgtatattaattttttagtatgcaattcttttaatattcttttttttacaaatttgtcatttaaacagacatggttcaatattttaactggcataatatttcaaaaatatatttgtaatataacaactataattaaatagttgatattacagacaatataactataactttaattattttttaggagataaaatgtcagaagataaaattagtatgaatcatggtgctggtggagaagtaatggctaatttaatctccagtgctgttttggataatatcactaaaaaaagtgttaatggtggtattagcttagacgctttagatgatggtgcaactattccaataggtgactatgagattgttgtaactactgatggccatactatcgacccgttattcttccctggtggagatattggtaggatttccgcagcaggaactattaatgatgtttctgttatgggtgctaaaccgctagctatttctaatgcgattattatgcaagagggtttccctattgctgatttggacaggataatgaaatccttaaatgaaacttgtgaagaagttgatgttgctgttattactggtgataccaaggtaatggagcagggtaagattgacggtattgtaatggtaacaactggtattggaatagctaaaaaaggagaaattattcgcgattctactttggaagttggtgataaaataattgtcacaggttctttaggtgatcatggaatgagtctcatgtcttttagggaaggtttcggttttgaaactgatttgaaatctgatactgctccgatgtggaatgttgttaaaaaagcacttgatgtagggggagttactgctatgaaagaccctactcgtggtggttttgcaaatgcaattaatgaaatggcttcaaaatctggaaaaggtgttttacttcatcaggaagcaattccaattaaaaaagaagttcatgcagtttctgaaatgttaggtattgatccctttgaagtggctaacgaaggaaaagtcgttatgggtgttaaagctgataaggctgaagaagttcttgaagcaattaaaactgaagaatatggaaaagatgcagctattattggtgaagttattgaaggagattatgttgttgttgaaactccaattggtggggaaagaatacttgaagctccaatagctgatcctgttccaagagtatgttaattaggtgatattatggcaagtttatttacaaaaaggattgcagcatatcttgctgatttttttgtagtttcagcatttatgtggattgtatcttttgtattgtaccttctggcaaatccttacagtatgaattcgctttattcatatttcccgtatgtagtgcctgttttgataatggtttattttgttgtatgtgaaaagtataagggggctactgtcggtaaggctttattatatttgcaggtcaggtcaaacaacggagaatatgtttcatggcagcaggctattgtccgtaatttaactaaaatatattggttcccaataatatttgattgggcaattggtaaaatattaggtaaaaatgatagaattttaaattcaattactaaaacaagggtttttgatgaattaagataaaactcttttacttttctttttttggtgttttttatgattaatcgggtgcaggttttatggtatttaaataaagatgatctggaaaattattgcttggacttcaaaccttataaatcccacaagcttgaaggatatgaaatttgtgatgtggatgaagacctgatttttgatttatgtgatagggatcctgacagattgcagcctgttgattattttaaaaacagaacagaagttgagaattatctgactgattatattacaaatgaggaatatgaattggctgcggattctgttgaacttaaggataaaattaataaagctattgaaactgttgagttttcagatgaaggctattatatcagtgtcggctccggtgatgtaggaggcagtgaaaataagattgttcattggtatgaagctcttaaaaaagagtataacagttcttcaaaggataatatgtgggttttaatggttactggttatgacccttatgatttaaaaccgagcggtaaagttttaacctatgtactggctgatattttaaatttacatgaatcttattttgatgatattattcctgataaaggtcttttggaaatttccgagtggaatgatattttagatgaagtttacaagaaaaataaattgtatttgggcctttacagggcagtttaaaaaaataaaaagtgagaaattatacagtgcctttagcgaactcgcttggaggtatgtacataatttctgcaaggttttcatttaataattctctgtttatatccaaattttcagtataaacaatagctaatgttctgttgtatttgtcgtagtgttttttatcatcaatgtctaagtaaactgtttttccaaggcatttttctttaacatagtcttttgcttcgtggtatcctggttctcctctttcaggagtgtttacctgtacaaatctgatttttccaataccttctacccagattgtatctccgtctacgactttgtaacatttcccgctagcttcatagtgtacgcttcgtacttcatgagttttagaatcctcaatattaagtgttccttgtgaaggtgcagctgccacttcattatccatgaaattcacagcagttgaaactgcaagtactccaacaaataatattagcaatattaatgagatgtttctagatttcattgttttttatatggtattttaacttaaataaatgttgtgttttaatcgtgtatacagtagctttggaatctgcagcttttgcatttgttgggattttttgtttttataaatggtttttctcctttgaacaatccgtccattctgtcaatcaggaatttaattgatttttgagcatcttcgtcaaattcttcactccagaatatgttgtcagttcctctttgtcttagggcacctacaatttttcttttgtcattaatcatatttttaaatgcaagacaatatgctctgacctggtttattgttgagccgtatgcttggtttccgggtttgtcatcaattattacaaattcatcaggagtcatccatatttcatctataaatcctctgattccatattccggcgaaattacaaacatttctctggttactgttttttcagtttttgaaaattcaagtacttcgtcaaaggttgcaggtgttgcactttcctgaaacttctcttccagctggttgtgcactttggttcctgtagtcatggccggggtttctcctacttttactccctggaagtactgcagatatagctgatactcacaatatccctgttgatttaaccagctaatggggaaattgtttttaccttctataatttggacacctttaatatttggatggtatttaatgtccagatttttgtttaaatcagtgataattttgttttccatatgcagtattttgttgtttttaaaatataattctttagttaaatttaaatattattataacttaattttatcttgattaatgaaatttacattttggagagatgaaattgagttttaccaaaaataatgatgttgacagtgaagacattgcaaataaagtacagacttttgaaaatatagtaggtagttctcttgttcaaaaattaatcaaagcagcaactgtaaaatgtaaaaagtgtggaaaaaatcgtttggaagttgcaattgattattatttaggtaaaaggtcagatatctgtttaaaatgtagattgcttgttcctgtaattaaaacagttgtcggaaacagcatcagtatttttgggatgtcagaaaaagaattgattgatttgatgcaggattcatactggactaaaggactggtcagtgtaataaaagggcttggagaaacaggaattgaaaagccgtttgttcctgcagcacctcttcaggttcagtgggatttaacagacagtgaactgtgctttgagcagatacatgatgaaatagataaattagctgattttggagttgcacacattacatttatcggagaagttgattcaacattcattaaacatgcagatgatgttggaatgtatccctgcttaacaggcaatggatttaatctggaaaaaattgataaatatgttgatgcaggagttaaatttgtagacatttctctggaaagcgttaatccccaaactcataatgaaaaattgggaattgataatttatgggaaaatgcagttgaatccattaaaaagtacaatgaaaaggatgtttatgtggaggtttcaacagaagtgactcaggataatcttttggaaattcctcaaataatcgagcttttaaagcagttaggtgtcggatggtataaactggatgttgtcaatggagatttgactgataatcagagactggaactatttaagctaatttatatggaaaatattaacggggatatgcagatactaaccaatgatcctcagttgggggatgttgcctcaacaatcatgtgcaatggaatgaatatgattccaactcatttttttaatttggactatgacaaacaagcaatgaaagaacttggaaattatattggaagctgcggagctggaagattttacatggcaatagatggaaaagggaatatttatccatgcgaatatttccgtgatttgaaaatagccaatatccgtgatgatttggacactatgtggctaaataatgatatcttattgaagcttagaaatagaagccttttaaaaggaaagtgcggatgctgtgaatccaaatatatatgtgggggatgtcgtaaaagagcatttgcggaaaataatgattatttggctgaagataagaactgtttaaaagatattaaggaaaatcttttggattaaacaatttttatttaatcaatatattataaatagttagtttaacaaatactaactgtaatgagtgatataacatttgatgattttgaaattttagcagaaattaaaaaatcaataaaagaaatgggttttgaagagccaagtccaatacaagaattaactattcctgaggctcttaaaggaattgatataataggacaagcacaaacaggtactggaaagaccctggcatttactgttcctttgcttcaaaagatttttattcctgataattctccccaggctattgttttatgccctacaagggagttatgtattcaggtagctggtgaaattggtaaaataggttcacacatgaaaaaacttaaaattttgccggtttatggtggtcagcctattggaagacaaattagagtattaaataaaggtgttcatgtagttatcggaactccaggtcgtgttttggatcatattgaacgtaaaactttagacttaaaaggaatttcaactgtagtattggatgaagcagatgaaatgttggatatgggtttcagagaggatattgaaaaaatattaagacacactccaaagcaaaggcaaacactgcttttctcagctacaatgcctaaggaaattaaaagaattactaaattctatcagaaaaagcctaaacatttaaaggtagctcaaagccagatgactgttccggaaataactcagtactattttgaaacaaaggaaaaagacaaacttgaaaatttaactcgtttgattgatgtttatgatgttaatttaggtttggtattttgtaacactaaaaaaagagttgactgggttgctaaaaacttgagaaacagaggatatgcagctgagggaattcatggagacatgaatcagaaatcccgtgataaggttatgaacaaattccgtaacggaaatattgaaattctgatagctactgatgttgctgcacgtggaatcgatgtacctaatgttgaagtggttgttaactatgatgttcctcaaaatcctgaatactatgttcatagaatcggaaggacaggcagggcaggtaatatggggtatgcatttacctttgttgcaggtaaagaaatctatagtttaagaaccattaaaaaagtaaccaaatccaaaatcaaacaaagaaaaattccgtcatataaggaaatggaatctattaaaaatactcagctaatgaacagcgttaaaaactctattgaaaaggataatttggaaaaatacgtaaaattagttgaaggagctatggaagaagattttgattctgtagacatagctgctgcattattaaaaatggttaaggaaaattaattattttccaccatcaataatatcgaattttattttttgttcttcaagttcacgggtaaaagctttggtcatatctccgacacataatgccaaaacgtttaatcctttacgggcagcattagctgtagcttgaggagcggcatattcaatggtaaccgggagatttaacatattggctactgctctggaaacagttcctgcaatagctactctgtctatttttttacctgtagttgttccctgttcataaacacttttaattaattccaggttaactttatcggatccaccttctttaatggtaggcaaattaataacaacagcttctccaatggtcatgtcgattaaaccggtaagattacttaatgccacatcacagccttttgcagcatctcctaaaacaacaccagttgcatcttcttcttttttatgagcatataaaacaccagagtccatataaagaccaacaatttcatcttttttaagatcttcttttgcaatagccggccaaacagttttataatgattcatggtttccaaaacagaatcagagtattttctaagagaaatagcatctcttttaactttgtcaatacctttttgagtaattttatatggtgatctgccatctttagatgttatatactcttgttcaataagtgtcttaatattttctgaaacagcctgaatggtgatacctaaagtttcagccaaatccttttgtttgagatgtgggttttgctttgagatttcacttaaaatttgaaaatgtgttaaggcacctctttttttaaatgctttcattttttttcattcctcaatttttttcaatgataattaattttgatttaatgttatatttaatttgctatttttccttgtaattttctattaaatttatcaaggaattctgattttttttcatttggaatgtaagcaccgcaagctattgcatggcctcctccggtacctccaacttcttttgcgatttcacgcatcatgttaccgaaatgaattccgtcataggcaaggagtttggagcatctaagtgagactttgatttggttatttttaggtttgctaaatcctaaaataggttttttccaattacagtaacctaaaaccctacctgttattgtaccgatgatattggaagctatgtcttcatcaaagtcactgcagtcaaaatattgaaaattgtcaagttcaataatttcggaatgataattgtctgcaactttgctgatggaagtggccagattatacttgtgtgttttgctgacttcttctaaggcatcaagagcaacaagtcggtctcctttaataatatctactccaatagcttcttttcggtttctgccgcaggcattcatagctgttgaaaactcagaaccgtctcttaaaaagcttccttcctcttcatttaaaaaagtgtatgcatctcccacaatcaattttggaacatatttgaggtattttggaggaactcttttggaaatcattctgcttaaaaattttttgatttccattttatcctcttcagttacctcagataatgtttttctgttgtgtttttcatcaactcccaattcttccaaaacaactttagcttcctgctgattgttagttatcggtaacttgacatcactgaaataggatagtgcaacatatagcggtctggtactgcgtccgtagatgttcaaatcatttttagtcacttttagaagaccttcattaattgcatcttcctggataatttcatttaatccttcgaaatgtcctgttttattgttttgcatatctccgatagctgacagaacaccgatccagcttaaatccttaaagccaaatgttttagctaaaaaataacataatcctccaccgcagacataatatgatccgtcaataccgtagaacattggattgatttctaaataagtatatgctttgtcatttttatagttgatgtctcttaatggcgggtggtggtctaaaattaagattttctggtcgtcttttgcatttttgtcaactccctgacctgaacccaaatctgaaaaaattgtcagtttatggtctaaatctaggtcttctatttcatcaagattgacaaattcaatttcataatccttgtttaaacggtccaatattatagataggattgcaccggagcagattccgtcgcagtcagtgtgtgtataaattttaatgtcattgctggattcaattaactctttggcttcaagaaactgctcctgcattccgcatggtatttccatcattgttttatttcctgtagttttaaactaatttcctttaaaagctctaatttaggtttgtcactttcaactaagatacgtcctgatttttcataccatttgccaggatatgacctttctttttgagtgctgtaaggtaaattaagtctttttagagctttttcaatatcctgtaattttggttcttctacagctatttcttttgatacctttctgccctcatttaaagagaggtttttatccaagtactgtggccatactgtaatcatattaattcaccttcaaatttaatgattcttttttatttgtgtttcaaatatttctaaagcgtttttaacaactaaatccatattgtagtatttgtattgagctagacgtcctgcaaatattacattttcctcattatccatttcttttttgtattgctggaatttgtcaaggtattcttgggtaggatatgggtagcataattctccgttgaatccaggatattccttcataattgcagttttgccttcaacatcctgcattgttaattttttaaactctgtaatacgtgtaaagtatggatgatttggataattaacaacaccaacttcctgataggaatcttcgtctaaaacttcatatacaaagttcagacatctgtataataattccccgtatttgtaattgtagaaatagtcaataggtcctgtgtagattaatgtatcatattctatgtcttttaaataatccttatagtcagtattcagaaccaccttgattttatcattgtcaatcattttttcacacattttggtaaatccctctttcggcattccctgatatgtgtcttcaaagtatcttgtgtcgtgattgaacctgaaggggattcttgaaattactgaagggtcaagattggctgctgaagttccccactgtttttgagtgtagtttttaaaaagcttattgtaaatgtcacgacctgcattttttaaaacaacatcttcacttgatttgatttcatcaatatcttctttatgctcttcaatccattttttcatagattcttcatctaaatcaagaccatataaagcatttaaagtatcaatacaaataggcataggtactaattttccacctacattacttaaaacgtgatgttcatagtctaaccattcagtaaattcggacaggtattcgtaaacgattttttcattggtatggaagatatgaggtccgtatttttgtattaaaatgccgtcttcatagaaatcataaatatttcctccgatatgatttcttttttcaataatcagaacttcttcattaagctggttagctattctttcagcgattgttaaaccggaaaggccagctccaacaattacatatttcattaatatttactccttgtgtattttaattgcagattcaatagctgttgtcatggaagataataacattttggttttcagatcgcttttatgaatccttttaagtttttccactttgcttaacagtaatttgttttcacttttggtaaacggtgaatttttccatgtatgcatccagtaaattaagtgagggttaactgaaattgtttgaatatctttggaaaacctttcagtacactgtctggcataaatataggagtccattaaatcactgaggaatctgacatttacattattggtaatggacttgtcatcaggcaaatcacgtacataatagtcatagcacatgaaattattcaaatatacaattccgtcagctttaaggagagtttctaaggtaaatgctaaatcgtccccggaaacaaatggctgataacggatatttttatccataattagttctcttttaaatattttactccatacagaaggcgccattttcaataaatcaggttcttcctttatgcttttgacatggataacatcaacgggactgtttctttcatattttccctgaatctttttaccgtatagtgcatgttccagaatgtggtcccaaacataatcaggaacatttaaaggatttgctgtttcaaatgtttcatcaggatatgcactttttaaatcatccaaataaggggaatatgatttttgaatagtttcaccataagtatagattcttctgaatcttccaaaagccatatctgcatcatacttggttactgcattgtataatacttcacaggcatctaatgtgtatctgtcatctggatctaaaaacataatgtaatcgccgctgcactcttcaatacctctgttacggggaccattggctgcaccggtatttttttccaggtggatggctttgcagcagtcgtatttctcatcatattcatcaataatctttccactttcatcagtagaacagtcgtctaccataatgatttctaaattttcatttcctattgtttggttgattaaagaatcaattcctcctcttaaatgagggccgacattaaaaataggtagaataatacttattttatcttccatgtgaatttctccaggttttgaataataactccatcatatcacgaacagtgtaagtatcaggatatatataattaatattgtactggtctaaaattttaccggtaatgggaccaatacagacagttaataaattattggaaagtaaatcagctaatttttctttgtttttagatattttaaagaaattagtaacagttaaaggactggtaaaagtaattgcgtcaatttcattattttctattttagctatcaaatcattgattttatcttcatccattgggaataatgatttgtaagcttcagcaactataactttattgttaagtttttctaagccttcaggcagaacaggtcttgcagaagcagttcttggaattccaatggtctgatttgtaatatttcttttttcaaattcctctaaaagaccttctgctgtaaaatcttcaggtattaaatcaactttaacgccttgttcgccggctatttttccggttttatttccaattacagctactttgcaatctaaattttttaaaaaatcaggataaaaaagatttagggaagtaattgtagttggagaggtaaaaacaatccaatccagcaaatctttattagctattaaattctttaaagattcgctatttaccggttttaaatctaaagtaggagctagaacatattgacctcctaactcttcaacaatcttgcaggctgctttagatctgtcagcaggccttgtaattgcaacaatgggtcttgacatttaatttactccaaataatttaataatattataatttttgattttattagttaatattatttatgtattatttgttgttaataattaaaaattacaaaatagtaaagtgaattgctacaaagtagtaaagtaaactgctagaaaaaattcatagattagtctattgctgtagtaacatggggtttaacttcaaaattgttaataaatgttttaaacactttgaaaacttatgcataattgtcgttttatgtttagaattgagaaaatatatatgtatcagatttatatcaatagatgcatacaatcatgaaaaaacaataaattttaatactaaaaatttattcgaagttttacaatactctaaaaacaagaataaactaacattactcatgtatcgggatttatgccaaaaataattaaaaaaaattatcttttaaattcaatttgttcaaaagttttttttgctctttttaaagctttaatttcctcttcagttgaaggaatatttaatttttgaataaatctatctgcatcatcacctgttaatgttggagttggttctactttagttgccataattaaatctccttatgatatttttaataaatattatatagattattattttagataaactattttctaagtttttaaaagaatcttttaataagaattcattaagatcattatcaccacaatcaaactgtattgttgataaaatttgtttatttgcttttatcatctttaatttacttcaattaattctattcataattgtattattaagttagtaatttataatttttttctttacaattaaatcaatatttcgtaattactacaataattggaagtttttatctatttttttcattgattataataaaattaataagatacaaaaattaataataaattataaagatggggactggctatgtacaaaatatctatgattatacctgtttataatgcggaaaaatacctgaaaagaacaataaattcaattattaatcagagtataggttttgaaaatattgaacttattttggtagatgataattctcaggataactcaaaaagcattatagaagaatatgtagctaaatatgataatgtaattggcatttactctaatgaaaaccacggatttcctggatttggaagaaataagggtattgaaatagccagcgctcagtatatcatgttttcagacaatgatgatgaacatgacaaagatttatgtctgaaattgtacgaagccattgtttcagaagatgctgacattgcttcctgtgataaagttaaaagagataatattaaggatattccagtatctgaaaagtatgttggcggaaagttaagttccaatgggaatattatagtctcaaatgatgatctggcatattttgaagatataactatctggaataagatttttaaaaaagaaatcattgcagataataatataagatttgtagaaaacatgctggctgaagacttgcttttttgtctggaagtatttttcaactcatctaaattactttatttggaaaaatattacggatacttttgggatatgcatgaagaatcattatctcatgaatgcagtccgaaacatgtggaaaacttacttaattcaattcctgaaatgtttaaaattttaggtaagtataataaaaaagatttagctagtttttattttaaattctacttacgtaatttgctcagatttttcattgatgtaaatacaactgaaagtaatttgaaatcaatgattaaaaagttgtataattatgaaaaagaagctggatttggatgcaaggctaatgaaggatgggcaaatataattaacttttttatagttcacagattctttaatttagctattttaattattaagattatgaaagcttcaaagggatctgcttttttaagaaagattttcagatctgtttaattgttcatgttggatattgtgctaaataaggaatattgtttttattttgaataattgaagtgatgtgcaacattaattttttatattaacatttttaatatatttattgttcattataaggaggtaataaatgataaattttaatattgaagatgttcaaaatattttaagaaagtgtaatgttaatgatttggtggttcatccacacattttagataattggtttgaacgagattataatttaaattatgttgcaaattgtttagttaatgaagtgcctttaagtatttcaaaaacttgtgaaaatcgttttaaacttatttatccacatgaaaaataaaaatgatgagtttatggatttaagtaaaaaagcgattgttatagtttgtttggttatagctgttttatgcggaggaattattgcagctacattattcagtgaacctgaaagtattgatgaggtaaatattacaaataataacacaactgaagctgacaattatgttgctgaaagcagtgatggggccaaaacagaaaaatcatacggatactgtgcagtttgtggaaaagccctttcagctagtgaagctaataatgagtacactcagggaaaagtatgtcacagctgtgcaaacaaccctccaggaggacctgattatgccaatcagaaactaaaagaggcatatcctgatgaatattattggttagaaacaggttatgaggatagctacggggagtagctatttatacttataattaatttacagatttaattaaaaagtatttatatccagtttcagtgaaattttttaattcatcaaatatttcaccagtttcaatggttatatttccatcaattccttttataaagtctaaaaattcatcatcagttctgtaaattgcattataatcagcttccagattttcagaaaagaaatcctttaaagtaagtctggtttctaaaaatgaaagagtttctcttatgtaaattgttttattggaagcacataagctatttaaatctttaatcatttttttaatagtatcatcattaaaatagattaataccccagtaattataacgatatcaaaaggagcactaactagtaaatctgcagtatctaattgggaagcagataaaacctggaaatggcagttatcataattataattttccttagctatttcaattagatcttcagaataatcaatacctaaataactgtcgcacttgtcatggaaaacttcagcccatctgccaattcagcagccaatttctaaaatttttttattttcaaaatcaattttatttaatagtaattcactttcttctttgtgacgtttttcaacattttctttgtctgaaaattcagttttaacaagcagtgcttcttcatcttttttagcccgattattgaaaaattttttaattttctcagagtctacttcttcaatgtttccataaattctactcatgttgaccacttaatattgaattagttcaaatactttaaatatttttagtttatcagctttaaaaattaaagtttaattatacattttttaaaattttgatattaataaattatttatatttatattgacatagtgttaatttaattagtgtgtttttcaataaacattggatcgatttttatggattttgaaaaaatttatgcaaagttgcctgattctattaaatataataattatattctagatttctttttaaagattcctaaaaagttacaaaatttaaataaaaaatctaatcagttaaattcacaaaatcagttattggatttattgtttactagttgtgatataaaaataaaaggtaatttgagaaatgttcagttattgtatattgaattgcttcgttttgtagataatgtctgtaaaaagcatgatattgattattggcttgaaggaggcacattaattggcgcagttcgtcatggcggttttattccatgggatgatgacatagatttgtctattatgagaaaagactatgaaaaactaattaaagttcttccagaagaaatttctaaatatgaatacttcaaagaaaactgtggtttgtctttgctaattgaaaatcaaaaaaactattttgaaggatttagaagtgtttatgatgttgatgatgaaaatggttttttagatgataataaattttcatttttacaaattgcctggctaaaaccttatgttaagattgatctatttccgaaagattaccttttagaagaaaagttggaatctttcaaaaaagattatgtatcaactaaatataagtttaatcaggatgttaaaaatggtaaaaaagttttttggaacgaatttaatgtagtaaaaaaagaattggggttagttaatactaagacaaagtattttgcagattcaattgatgttttacagttaacttctgatttaatttatgaaactgataaaatatttccattgaaaacaataaaatttgagggatatgaatttaaatgtcctaaagatattgaacatacattggaagttcaatttggtaagaatttcatgcatattccaaatgttattgaaaatcatagtttagttccatttatagaacatcaatttagttcatttgaggaaatggataaatcattttcaaaatctattagttatttaaaagaaattaatgataattttgattttgaataaatgaagttattttgagttttattaataatgttaatttaatatttaataggtgatattgtgttgaattttgctttaggtccagttatgagtagtgatttagttttaaaaattggaagtgaacaaactccttattttagaactcctgaattttccaaaatcactcttgagaatgaaaaattaatgaaagaaatgctttttgcagatgaagattccaaagtcatatttttaacgggatctggaacttctggtatggaagctactgtaatgaatgtttttacagaaaatgataaagtattgattgtcaatggtggaggatttggtcaaagatttgtagatttatgtaaactccataatattgactgtgatgatattaaaatagattttggatcatgtcttacttctcaaatgttagaggagtatgataataagggatatactgcatttatggttaatatttgtgaaacaagttctggagttcattatgacattgatttaataagtgatttctgtagaaggaataatctatttttagttgtcgatgccgttagttcttttttagctgattatattaatatgagcgagcacggagtggatgttgtaataactggttctcaaaaagcattggcatgccctcctggaattgctattataactttatccggacgtgctgtggatagggtgaacaataattcatgtaaatcaatgtattttgatttaaaagatatgttgttaaatgctaagagaggtcaaacaccatatactccagctattactattttgttacagattaatgcgagattgaatcaaattaaaaatgatggtggagttaaagttgaaattgagcgaactacaaatttggctaatgattttagaaataaaattaaagaatttccatttgaagttagatgtaaatgtttatctaatgcagttactacagttcactctaaagaaattcttgatgtaaatcttgttgaaatattaaaaaatgaatatgatatatgggttagtacagcaagggatgatttatcaaaagacatgatttttagagttggacatatgggtgatttatctactgaagataatgataccttgattgatgcacttagagatattcaaaaaagaggattattctaatgattaaagttataacatatggtacatatgatttatttcattatggtcatcaaagattactggaaagggcaaaagcacttggagactatctgattgtaggggttactgctgatgactttgataaaaacaggggaaaaatcaatgtacagcagtcattaatggaaaggatagagtcagtaagagcaacagggctggctgatgaaatcattatagaagaatatgaaggtcaaaagatagatgatatcaaaagatatgatattgatatttttactgtaggatctgattgggttggtgaatttgattatcttagagagtactgtgatgttgtttatttggagagaactgaaggagtttcaagtactgatatacgatccaaagataggcaggttacattaggtttagttggtgaaggtttagttttaaacaaattttacaatgaaagccaatatgttaacggattgactgttggaggaatatgttcaggtgatgaaaaccaacttaaagactttgatgatgatttaattttgactcaggactttgatgaattactaaataatgttgatgcaatatttattgtatctcatccatcaaaacattacaaacaagcaaaaaaggcacttgaaaatggagtccatgttttatgtgaatcgccaattgctcttaaagaagaggaactctgtgaattattcaaactggctaaaaagaataatctgattttaatggattcaattaaaacagcatattcaactgcttataacagattgttgttactggctaaaaaaggaaaaattggagatgtaatatcagttgatgcaacatgtaccagtttagcagatgggtctggtgatgactggaacagtataactgcatggggtccaacagctttattgccggttttccaattgcttggaactgactataaagataaaaacattaattctcttttgttagacagtgcagagaattttgatttgtttacaaaaatagatttcacatatccaaatgcagtagcttctataaaagttggaaaaggagttaaatctgaaggggaattaataatctctggaacaaaaggatatatttatgttcctgctccgtggtggaaaacagactattttgaaatacgttttgaaaatcaaaatgaaaataagaaatatttctatcagttagatggtgaaggaataagatatgaacttgtagcatttataaaatcaattgaattaaataaaacaggttcatatattgatattaatatttctaaagaaatatcttcagtaatggaagattttaataataataaatttaataatttatgatgaacttattcataaggtccaaaatcgacagtattataaatatgattgtatctttcattttctgggggcaattccatataatttttatcatataataaagttaaatatgtgtcataatcatttggaacattaatttcaatattttcaaatttgacttttttagcaggtcttaatgaagatttaggtattattcttggggtattgtaagttgtactaagattgcatacgcagtcacatttttcattaagatatttatccacaaagttggttccatatttttttattttttgaaaatttattctaaataatttaaaaataattttaataacttttccaattctttctttatttttagatatgtatgcttcactgtttgttatttcataaatccaaattaattttcttaaaagtttccatttaaataagaatttttttcttttatttgtatcatcagggatgttgtctaatacgaatatatctaaacttaaacctagggtaaaatcagtattattgtcataatattcttcagtttttgttccttttaagttccattgtgaataaagtctacagtaaccttttttatttctaggacttaataattcatatttatcttgaggtgatttctccaatatgtccaataatttttcgtactgatcccttaatagaattaaatcaacatcatcatcccaaggaataaatccattatgtcttatagctccaattagtgtacctgaatctgcaaagtattctatatcattttcttcacatattttaataaaatcagttaacatcattaaatttaaatcttgaacgtgttttaagatttgggggtcatatttattgaatttttcaggtatttttataatcgccattgtttccctctaattattaattttaatttatatataattaattacataaatattatggtatttaattaatggatttaaaattgattatttattttataaaattattaacataatattcatggggatagtagtaatgcaagcaattattttagcagcaggaatgggaaaacgtttaaaagagttaacaaatgatgttactaaatgtatggttaaaataaatgatgttactatgattgaaagaatgttatcacaattagataacttaaatttaaataaaattattatagtaattggatataaaggaaataaattaaaagatttcattaaaacattaaatgttaatactccgattgattttgttgaaaataaaatttatgataaaacaaataatatttattctctttttttagctaaagattatttattaaatgaagattctttaattttagagtcagatttaatttttgaaaatggaatattagaagatttggttaatgacccatatcctaatttagcattagtagctaaatttgaaagttggatggatggaacagttgttacaattgataatcaaaataatattatgaattttttatctaaaaatcaattttcatttgaaaatattcctaattattataaaacagttaatatttataagtttagcaaagatttttcaaatcattattatgtcccctttttggaagcatatattcaggctttaggtactaatgaatattatgaacaagttttaaaagtaattagtaatttagatgaatctcacattaaagttaaaaaacttgttaataaaaattggtatgaaatagatgatattcaagatttgaatattgcagaatcaatttttgcgtcagatgatgaaaaattatctaattttaactctagatatggaggatattggagatatccacatatgcttgatttttgttatttagtgaatccatatttccctccacaatctttaatcgatgaattaaaatctaattttgagattttacttgaaagttatccttcaggaattgaaattaatagtttacttgctgctaaatattttggtgttcatcaaaatcaaatctgtgtaggtaatggtgcttcagaattaattaaatcattaattgaaaaagtttctaatccaaatgataatttaggaattgtaattccaacatttgaggaatattctcacagaaaaaatccagataatattattgcatttacaccaactaataataattttaaatatggtgttaatgaccttatctcatttttttcagataaaaacattggaatgttaattttaataaatccagataatccttcaggtaattatatttgtaaaaatgatgttttaagattggcaaaatgggcggataataatgatattactttaatcgttgatgaatcctttgttgattttgaagatatagaagaaaatccttcgtttttaaatcaagaaattttaactaattatcctaatttaatcattgttaaaagtatttcaaaatcatttggggttccaggtttaagattaggtattttggcatcaaataatttaaaattagtggattatattaaaaaagatgtagctatttggaatattaactcatttggagagttttatttacagatatttgaaaaatataaatcagattatgaaaatggaattgttaaatttaaacggagtagggacaagttagaaaaagaattaaattctattaaaaatttacgggtaattccatctcaagctaattattttatgtgtgaagtttttggagaaattaacagtagtaaactatctgaaatactattgaatgagtatgatattttaataaaagatttatcttctaaaattggatgtgatggtaaatcttatattagattagcagttcatgatgaaaaagataattctgttttaattaatgcattaaaagaaattttaggttgaagatattgacaactttttaatagttttaaaagaagcattaaaaagtaataatgtcacaattccagttcaatattaagttatattaaatttaaagattttagaggtgtttaaatgaaaataataacatttgaagatattaaaaaattaaatatgtctccattagattgttatgaatgggcaaaggaagtagttcaaaataaaaatactacattgctgcctcctaaaattagtatgaaaccagatattgatggtgttttttataatattatgccgtcagttattccaacacttaatagggcaggagttaaaattgtaacaagatatcctaaaagaaaaccaagtttagatagtaatttgttattgtatgatttaacagatggatctacattagcattgatggatgcaaatttcatcactgctgtaagaactggtgcagttgcagctctttcaataaaattattagctactgatgattttaaagagataggaataattgggcttggaaatacagcaagagcaacattaaaaattttacttgctttgtttcctgaaagaaattttaaaataaaattattaaaatacaaaaatcagcatcaacttttcaaagaagattttaatcaatttaacaatattgatttctgttatgaagataatgctgatgaggtagttaaaaatagtgatgtaataatttcggcagttaccacaattaaagaagatgtttgttctgatgactgctttaaagaaggttgtttagttgtacctatacatactttaggctttacaaattgtgatttattttttgataaagtatttgttgatgacataggccatgtaaaacattttaaatattttgataaattcaaagaatgtcatgaagtcacagatattttaactggtgaatctaaaggtagaacaaacgataaacaaagaattattgcatataatattggtatttccatacatgatatttattttgcaagtaaaatctatgaaatggctgaaactactgaagaaatagatttaaaagctcctagtgaaaagttttggtttgatttttagtatttatataatattattgggaataatctgttttttctacaaattcttttttttaaaacaaaacaggatttttcagactttttttagctttcagttgataaagtatagaaatcttcaattaaagagtctgtaaaattttataggtttatttgattttaatgtgttttttagtccaattttgcatttgatagtctaaaaatgttggaattccatttttggttttgtatattttctttattttttctggattggtttgtctgtagtaattttcaattttatttgatgttttttctttattttcatcatcaagatgttctatgtatatgtggaagtgatttatgatgtgttttattatgaaatcttttaaaacaactggtatggctgtatatttttgtaaatattgtttaaattgttctattgcttctttttttgagttttatctgaaacagttttttaattcttgtgtattttcgtaaaatatggtatatttgtttttatattaatcttgtttcttctacaatatacttttaatttatgattcattgtttaaaacaaatgaaatatgcacaattgatgttttactcctattttcatctgctacattacgatacattgggaataaatcggttgttaggcaaatgaatggtttattttctgttgaatctaagataaattttttcgtattttttggtattctgcgacatattattcgttctgagacgggaatattgagtattgcatcaaataaagttaatctatagtgtctagttctattaagtcttaaaaattgctcatcatacaaataataactggaatattcaaattttttttttattgttgattgttttttcgtgatttttgttggaatcagttcttgtttgatgatatattttgattctaaggaatatttcaaagtatttacttatttttacgaagtgattgatatcctatttttattattcctgaaattttatccattatttcttgtaagaattgtttatttttaccaattaatggattattgtatattccaaattttttcccacatttttgcattgatattgttgttctttgaattctgttgtttttttattgtgccttttttgattattttatggcttccacaaactggataaatatgattatcatatttaaaagtattattttcatctaaaaatagtttatgattagtattttcaaaattaggtgttttattcaatctttttgaaatgattttttctggattaattttttcatcagaaaaatcataaagtttaagttgtatgaagcctatattactattgaggacagatttgttttgtttggttataaaacattatttgtactcacttattaaagtaatttactatttttaaatcatttatattaaaattgaagaaaagttagagtgaaatttcatctgtataaaaattcaaaatcaaataaacctataaaattttacggactcaaaaaaattaaagaaataaataaagatataaaaccaaataactgttaaaatttattaaataggtgtttaaatactcaaaaattgtgttaaataaatattcaagcgatttttcaaagcataattttacacaactagcattattcacacttttagtcatgaaattctacacacgaatcacacatggccaaataattgatttattagaattatctgataaaatacagaaatatttgcacttaaaaaagattctacattacataacactccagaaattctttcaaagactaccaacatcaatattacatgaattaaatgatgaaatattaaatgataataaaattaatggaaaaataattgttttagatggcagtggattcattaacgattataaagacaaatattacacaataataagacataaacaacgaaaaaatcatgtaaaaaaccatatttcattgatgtagaaacaagattaatatttcattttacagcttaaagaaatccaaaattcgacacaaaatttgtaatacctgtataagacatataaagaaatataacacaaattcaataaaaatcatgatttctacaaagccaaaaattaaacatctattatagagcactcccctttaaataattttatttatatatgataacataaagtatggtgataataataaaaatatagttggataagattattgttttgccattaatgaaaatttaattaatttgtaggtattgatttagtattaattctgatattatgaagttaaatgaaattaaaaatattataaaaaattttcatgaaaattgcaatttagctgatgaatattgttttgaagatattttggaatttttaataaattctcaatttgaatcagttccaataattttatatgatgatggcatttttttaaattcattaattgtttcaaaagattttttggaaaatgattttgttgaggagttattggattggaattttagagtatcttcttatggttattctgtgtcttctaaggaagagtataaactatctaatccgtgtgattcatatagtcctagaaaaattttgaaagatgcaacaccattatttcttgagaggtatgtttttaatgatacgaagtccataattgagtttaatcaaaaaatttcacatagattaggtgttgcagagttaaataataaaaatcaattttacagaatggatgaatatggtgacataatggaagtagcttcagggtgtccgccaaaattaaattttggttgacttgttgatttttttaaaatattgttacatcgagttttaattgatttttaatggatgtgctttcgcagaaatcttctaaatcttcggttgtgttttctatttcttgtttaatattatataatcgtattaaattgtatgctagtgcgtctaagtttattctttcttctgtttttaccattccgatgactacttctttttctatttggaattgttctttgaatattccaaatggtccttcaacacttgatcttttggcatattcgtctttatattcttgtttttccattttttggttcattgctttttgcatttctgaaccgtattctgtgatggttttgtgtgtttgtgaggatgaacagcatttatttcttgcaggacagtgtttacatgcttcataattattgtagagtctttttattttgtctggtttttctgggtctttgtgtggttctatatattttgcaaaaaagtgtaagtagtttccttctgggcatttgaatgcgtctaattcataatcatattcaaaatggtctttatgatatggatttgggtttaattttcctattttttctttggattgttttctatttggtattaatccatctatttttttatccgccaagtatgatagacttatttggtttaagtagattgtgtctgcacttatgtattttggtttggtgttaatgtttcgtattgctctttctgcgatatttggtagttcataatggtctgtaggattttgtgtgacgtttattgcacagattaatttggtatcgtaatcgaatgcagattggatattataggcaaccatgtagtttcctttctttcctttcataaatcttgcttcaatatcgtttactggtattctgtcttgtcctgtgaatgtgaattgtgtttctattccatataatagttctaatttgtcttcgtcatccatgtctttcttttcgagtaatctttgggctggtttatggagtttttcaagagattctgggtcaattggtcgtccttcgtagtaatcgaccaatatttgtgtttcttttttggtgatggtgttgttgttggaattgtatgcttttttgatggttccatcaatggcaacgtgattaaattcagtgaatccttcatcaaaggccttttttaaggtcatttgcaataatacttcaaaataatgaccgtattctcttctgtatctttgtattgatctttcagaaggtcgaatatcatcacacacgtatttaaatatgtcatggtatcttgccatgtctgcgattattgatgttcggtcgatatgttgtattttagcataaataagtaattttagcattgaatctactggaagggagcctcttcctttctttttcttaggctctttgatatttaaaagtggaaaaacttcttcaacaaattctacgacaaaacgagaaatatgattggctggaacattccaatcaagtgtctttatacctagttttgcttgattcttatcaaactttcttttaaccataaataacaacaccaaaataacttatacttaatataaaatatgtacaatcaagtatataaatttaactatcttaaaatcatttaaaacaaaaaataaaaatcaaataaacttaaatatcaatttataaaataattaaatagaataaaatgaaataaataaaaatttacaataatataagaaaaataataaaaattaggctaaaaaattatttgacgaaaaatcaaaaatcaattttggcgaacactcttcaataataaaaaaagataatcttacattatgtttattagataagaaggaattagataaatatttacatatttctaattctgttttagtgagattttttgatatctatattttagataaagcaaatccatggaattcttcagaagaaattattcgattagatgataaagatatttattataaaaatgttgttcaacattctaaggatgatatgattactcttaaagaaattaggggatttcagattataaagcctatttctgaatttaagaataattatgatgaggttaattaccaagaatttaaagtattagatttaagattaggcagtgtagtaactaattcatgtgaccctagtaaattgggcaatattgttaataaatttgatggagttcctgagattagtccagtattttttagaacggaagtttttaataaatataatgatagtgaaaaatatgatgtggataatagatatattgagtgtaaaggtatttggtcattaagatattcgatgtctgatgataaaactcaagttattgtatatattagggatttgggaaaattacctgagtttgagcagatatattggaagtcttttaatgtggaacctaaatctaatattgcagagcatatatttaaaactgattttttaggggaatgggatgatgttttagacccattaatttcacttaaacagtgtttatcagattttccttcatgttatataggtgaagttgaaataaaaatttgggttgaaaaaaataaaggaaatatacgaaaattgggcaatttacactatattaaacatcctactaaagaaaattgggattttgaagttaaaaaattacatcaaattgttgttgagggattttgtgggaaaaatattgataaaattgcaaaaaacttagattgttatgatgagaaattaagatcattaaaacaactaaaaaaatgtataataaaattatatgatgagaatactgctaatgttattattgatccattattgcagttaaatgatgatagaaatagtagtgggcatgctaaaaatggtgaaatttatcctaaagatgtaattcaagattataatagcaaaattaaggcatgttttttatcaatgaagtggttgtcagataagataaatgagggtaaatttaattttaagtaatttttttagttgataatgaaagttatatagtacttggtgagaatatggttgataatttaaaattatgttctattgatattggaagaataattgtagataatgaaagtaataatgaaaataatattagttggacaaatattttagaagcatttgattttgaatgtttgttagaagagaacaggttagtaagaagtcaatattggggggatagtgattatgaattttgtgttatagaaactctttcagatgctcttcatgttgataaaaatgaagcttgtaaaatgattgagtatattttaactaattttactgatgtatctaaagaagaaataaataatattatgagcaatcttaatgataataattatattgttaataatacatcagataataatattgatgatttaataaatgatataaataattctatatctgaaggaaaacctgtttttgcattagatagattacacacactaatgattaaatatataaaagagctatgtttaagacatggcgtggaaattgaagaaaaaattaaattagatgctgtattaaagaaatatttaaagtgtattgatgaatttatagattcggagatgactaaatctatattgaagtcaaatatatcattattttctaaatttaatcatgttaggaataattatacttatacgcatgataataatattttaaatgatattgagggtaaattaatatttaaaaatattgtcaatgttaaagaatttatcgatgatattgaattaaaaatagttaatcagggataaaaatagttaaagatattatttaattaattttttaattttcataaaaataaaattggttaacaagtgttaaaaatgaaatttcggcaaaaattaaaaataaacatttatgaataagtataaataaaataaagaactgtttagtattaaaataagaaaaataaaattatttattaaattatatatttattggcaataatattaaacaaaacaggatttttcagacttttttttagctttcagttgataaattatataaattctcaaataagtaaaaaaactcactatcaattagctgatccataaaaaaagaataagtggatggggctacacaacctatcatttttacaaaaccccatccaacatggaaaaagtggaagaattttcctgcacaattatccacctaatcaatacaaagcttttataaaatatttttttgaagcagttcagaatttaacttcaattgtatatattttactattacttaatatattttacctttttattttcataaaatcctttaatatgcaatacattataaaaaatcagtaaatttttctggtgatttcataaattaggtaatttggatgttttggtgcagtaatgttgtataataatttataatttattttgtgctttttttttgtttgttaacgataaccacacagattaatagtttattctatttaattttcttttgttataatgctatttttccaaaacagatatttttctatgtgcagatatcagaattttacattatctaatcatatgcaggtttggtaatatgttgatgaactaaaactacattaacaccaccaaataaatatcataatatgaacagatatttttcaatagctaaaagggaagttaaaagttccattgcagataataggcgtctgatttgtttgatgttttcattatatgttatttcagcggttctggcctggatttttcatgctcagttacttgaaattttaaatccgtttttaggtgaaattaaagcagagatgtcaagggagtttacaatggatcctgctttggaactgtttattaacaatgaaactgcaggtcttacaacatatttttcatctgttttctttggaataatgtcatttgtcagtgttattgttaatggaatggctataggtattgttggcggaaaagtagtaagtatggatccttttcgcatgagtctgatgtttattgctttaattgttcctcatggaatatttgaaattcctgctttgatttttgaatcagtagcaggtgttttgctgtttttgtttatctggagatttttaaaaacaattgacactaccagaaatgatgttcccggttttaaattaagggctaaaaattcatggaagttaaataggatttatttaaaacagtccattgttcttatggtattttcctgttttctgctgattattgcagcacttattgaaggccatgttaccgaacatgtaggtatgtgggttgattcatttttctgattgattctatcttttaaattagctaaaaacttttatatagccttatattttgccgaaaatgattttattgggcaaattgcttattttaaatcgtcataagtttcacagttttaatgtgtattgatgaaaagtataaaataaatctaatgaaaagtataaaataaattagatgaaaagtataaaaaagggattgtcatgaaaaaatatctgccgagatacactgattacgaattaaaagaatcgttagaatacatgggtgcagtattaataactggtccaaagtggtgtggaaagactacaacagctaaacagcaatgtaatagcttaaaagagttacagcatcctgtttatggaaaatcttatttaaaacttgcagacacaaatcctatagaattattaaaaggtgaaaaaccgatgctaattgatgaatggcaaatggcaccggaactgtgggatgcagtaagatatttggtagatgaatcagatgaagacggactttatattctaacaggttcaacaatagttgatgaaagtaaaattatgcattcaggagcaggcagaataaaaagaatcgtaatgcgaccaatgagtttatatgaaagcggcgaatctacgggagcaatatcactgatggatttatttaatgatgaagatttaaacatcgacggcataacttcaaatttatcaatatctgatttgatatttgctgcctgcagaggtggctggccggagtcactaaacaaaaaaacaaaaaaacagcaattagctattgtagcaaattatattgatataatatgcaatagtgatgtttccaagatagacggagttagacgaaatcctcaaaaggtaaaagctattttaaaatcttattccagaaatatttcaacactggcaactaaaaaaacacttatgaaagatataaaaacagagtatggggatatatcagcacctacatataattcgtatattgatgctcttgaaagattatatattattcaaaatattcatggatggtcaccaaatatcagaccagcaaataccattagaaaatcctgcaaaaaggaattcatagatccatcaatagctgtagcaagtcttaatttaactcctgaaaaattattaaaggactttgaaacctttggattcatatttgaaaacttatgcatacgtgatttattggtttattcaagttcagttaatggagaagtattgtattacaatgatgacagcggtcttgaagcgaattgtgtagtatatttaagtgatggaagatatgcattaatagaatttaaattaggaaacagggaaattgataagggagcagaaaatttacttaaattaaaaaaattaattaaaaatagtgttaaaaacaaaaaaattgatttggaagaaccaagttttttagctgttataactggtggtgaaatggcatacactagagatgacggtgtaaaagttataccgattggatgtttgcgataaatgtttttctggattaattggtgagatatattatttgaatatgcttttgttaattattgcagcggttacgaatgtctattagggcatggttttttgattaacctatctttttttttaaatcactacaattttattatttcgtatcaatttttcaaaatcacttaaacaaactatatatacttattgaacttaatattaaaatgtttagtgtgatgatatatattttaaaaataaatcttgaggaatgtttagatggaaatttagataggtttaactgcaaataaaattatttaagttaggataatgaattttgagtaatattttattatttattcagcaatatctttatcaaaaatatatttttgattttaattaaatattataggtattatttataaatttagtttaatttaaatttgttatctgtaatttaactattttttattctttttaatattttttgcaataaaaaataaaaaaatttatattatttttattacaaaatattattagatatttataggaggcataaatatggtggttgataataaaattgttggagaaaggatggaatttttaagggagaatatgggagtaagtcaaaaaaatttagcagaatatttagacatatctcaaccatatttatctcaaatagctgctggaaaaagaccaatgtctttaacaattttagataaactttgtgcattatttggatgtagtgaacagtatcttttgggtttagatgatagctttcatccaaagtcttatgcatttcgtagtaaaaagattgatgttgcggatttaaaatgtattgcatcaataaataagctatataaaaatttgaaatatttacataaaaaacaaaaagaattggggggttaacttgaaatctgatttggaattaaattctttggctgttgatttaagaaaagattgggaaattgatgcttatgggcctttagatattttttcaattgttttgtctaaattttctaaattatcaatattgatttatcctatgtctaaaaatacgagtggtttgtgtattaatgaagaaaatatacctattattggaattaattcaaatcattctaaaggtagacaaaagtttacattagctcatgaattatatcatttattatttgaggatattaaggatattattatttgtaatgatgataaaaatgattctgaagttgaagcagattcttttgcatcatttttattaatgactgatgaaggattaaggagatacatgaaaatcaatgagattaatcattggaatttgaataatattattgctgctgaacaatattttcaaattagtcatcaagcatttttatttcgcattaataaattaggattttcagtagatgaatataataacataaatttaagtaatgaatctaaaaaaagaggttttttgaatgatttatataaacctgcttttaaagaggatattccttttgttttaggcaattatcttaagatgattaatcatgttgatgaattaggtggactttctgatggtaaaaagagggaattattacttgatggttgcaggggtgatctggtttttaacaaatgtgggagacaagatttaaatgaataataaaccagttttttatgatactgattgtttgtcttcttttttagtagtagatagaattgatttattaaaaaaggaattttccagcataattgtttcagcacaagtaaatatagaatttttaaatgataaaactccaaagtgtatatatgaaagatttagtaatttggtagatgaaggttttgtcattgttaaagatattgatgtggatgatgaagttatggaatattatattacatttatcactgaagatgatgatggaggtaaaggtgaactaagttctatagcatttgcaatagttaataatggaattcttgcaagtaataattttagagatatttgtaaatatgtaaagaagtataatttgcaccatattacaactgcaactattttattggattgttttaaaaaagaatatgtttctagtgatgaagttgaaaaaatttggcaggacatgttaaaaaaatatgttaaacttccaaaaaaatcatttatagagtattacaaatgggacgatccattatgcagttaatcattaacttaaactttttttattaaaatttccagaatcatatttttccaaattctttttatataatctgttattttttcataaaattttattcaacttattttaaattttaactaatttttattcacttaatctctgaattaaatgtatataattaatattgtattttttactaaagtaataatgttgaattaataacaataaatttaattttatcgcagttgattttttatggcgaaaacgaaagataaaaacgaatggggaagtaacctgtcatttctgttggctatgataggttcggcagttggacttggaaatatttggcgatatccttatgttttgtacagtaatggtggtggagcatttttcataccatatattgttgcaattttgattatggggattccctttttaattttggaatatggtgtcggatataattttaaatcttcttttccaaaagcggttaaaagcatttcaaagaaatgggagtatttaggttggtttttaccagtagctgttttcatgattcttatttattattcagctattcttggttgggacggattttatgtaattatctcagcatttaaaggctggggagctgatccaaatgcctatttcacaggcagtttccttcaggcaaatgatactttaggtggtcttggtacttttgtgccttttgtagctattgcaatgcttgtaggatgggttataatgtgggtcatttcccatactgacttggaaaaaggtttaggtagggtttctaaagttttagtacctttattatttgctataatgatttttattgtacttttctctttaacattacctggagcaggtatcggacttgcagagctgtacaatcctgactggagtctgttgcttaacttcaatatttggatggctgcatttggtcagatgatattttcattaagtttaggtatgtctattgcatttacctatgcaagctataccaaggatgattcagatttggtttccaatgcattatgggtaactgtagctaactgcggttttgaaaactttgcagctattggtgtgttttcaattctcggatatatgtcacttcaaagcggtgtggcagtgcctgatttggtaactcagggaactggattggtatttattgtatatcctactgtatttaatgttcttggtgattgggcttctgtaattggaccgctattcttctttacagtatatttggccggtctgacaagtattttatcaacaattgaacctttatcattttccatccaaaacaaattcggatggtcacgtaataaaaccatgactattttatgcgtcttcggtgcagctgtttcaatgatttatgcaacggctatgggttcatatattctgggaatagccgatacatttgttaatcagatagctattttaattggtgttatatttgaatgtattatatttgcctggatatttaaagcagaaaacattattcctaaactcaatgcaaaaagcaaatcaattaaattaggtaaatggtggcttgttgtagttaaatatgtattgccgattttcattgcaattgtatgggttggaggaattttggaagttatctcctcaggatccatgttggaattggctattctggctattttaacagtaatattacttggtgccacatttatatttactaaactgcctgcaaaatcaggggaatgggatgaagtcaaacagagactttaatcctattttaattttttattgaatgtgatattatggcaaatgaaaaaaatgaatggggaagcaatatctcatttctgctggctatgataggttctgcagttggacttggtaatatctggagatttccttatgttctctatagcaatggtggaggagcattttacattccatatattacagcagtactgattttaggtattccgtttctgattttggaatatggcgtaggatataattttaaatcttcttttccaaaggcaattagaagcatttcaaagaaatgggaatatttaggctggtttttacctgtagctatttttatgattctggtttactatatttcaattctcggatgggacggattttatgtaatcctgtctgcatttaagggatggggagcagatccgaacaattactttacaaatacctttttgcaatcaacagaatctgtcagcggtattgcaacgattgtgccgataatagctatatcaattcttgcaggatggtttatattgtggtttatttcacacagaaacctggaagacggaataggcagggtttcaaaagcattagtgccattgttatttatcataatgattggtattgtaatattttctctaacattacctggagcaggtatcggactttcacagctctttaatcctgactggagtttgttaggtgacttcaatatttggatggctgcatttggtcagattatattctccctaagtttgggaatgtgtattgcatttacctatgccagctatgctcaggatgactctgatctggtttcaaatgttttgtatgttgcagtggcaaactgcggttttgaaaactttgcagctattggtgtgttttcaattctcggatatatgtcacttcaaagcggtgtggcagtgcctgatttggtaactcagggaaccggtttggtatttattgtatatcctgaagtatttaatgtgcttggtggcatagctaatattatcggaccgttattcttctttacagtatatttagctggtataacaagtgttttagcattgcttgaaccggtatccgtatctattcagaataagtttgattggacccgtaataaaacagtaactgttttatgtattgttggaggagcctgttcaatgatttatgcaacggctatgggttcatatattctgggaatagccgatacatttttaaatcagatagctctgctgattggggttatatgtgaatgtatactatttgcatggatatttgatgcaggtaaaatcatcccgtcacttaataagaatagtaaaaccttaaaaattggcaaatggtggatagttgcagttaaatatattattccgattgttttaggatttgtatggattggaggactgtttggagttatatcttccggttcatttgtggaattaagtattttagctattttgactgttattctaattggctttactgttatacttaagaaattacctgcaaaatccaaagattgggatgaaacacagcaaagactttaatgtctttcttttttattttatttttttaaactttctgttttatagtttgaagcattattttttggctttacataatttttaataattaataattctgatttttcaaaattagctaattcagctttgttttataagttattgtaactgacttattgttttggcattttaaacttccgggattttctgttccggataaaatgaatgaataactaaaatgttaattttaatatgtaaaataatgaacattaattaaaattaactttaatttttgtacagttaactataaataaaaaaagttattaaataattactgtgaaactgcagcggcagtttggctgtaagtttcacaaaaatctaaacatttaaaaaaatctattatatggaggcaaattcaatggatatagaatttgaatttagctttgaagaggatggatttatgatttatgttaaaaaaatcaattaatttaatttaatggctgtttaaaataattaaatatcaaattcacctgttgtatttaattggatgatggtaatatctctttaccattattatcttctcttttcatcacttattgctattatttatatactacttgtttaatgttttaagtaattgttaaacgaatttctttttttatatgcaagttattataaaattatatatactataaagatgtaatatataattcgtaattatcaaaacaaaattttatattggtgtaattaatgaattatttgaaagtattagcaatacttagtttattgtttatattttgtggttcagtttatggtgcaggtgaagctgattctccagatattaacggagttaatgcagttattgacgatacaattactgttgaaaacgctagcttaacctatgataaacttatcacaagcaataactgtgaggaagttgttattggagataattctatttgggatgttccgattagggaaggtcctattgtagaaaatgataacacgtctattccggatattactttaaaaggcgaaaatggcaataatatgtcttttaataatcctgcagatgtttttatcaatgaatcattcaacttccaaatggtatttaagaatttgggggacgctactggattccaaccttatattcagttaatagctcctaaagaactaacacattttactgtttcatattctaataggaagatagtcccgataaaagttggaatatttaatgaaagtacttatgacaatacaacgggtttatacaccttaagggatccatttactaaaaaagaagtgcatggtccggcaaacagtactttttatattcttcagtatcctttaggtagttttactgttaatgctcctgatgcggttttaaatattacttcaggtatcggagtattgaaaataggaaaattacttaattttactgttactcctgtttttagatatgggaacagtcctattgatgatccggtgaattatcctccaatttatggagaaactgttacaggatgggtaaatcctgttgttgttaaaatagataaaagttcaagtcttaatgaacatgaaactgctacaggttcaaatttcccatttagctattctgtaaatattaacatagctaatggtgcaaaaattgaaaatattactattacagatgtaattccgtctgatgtaatgtatttgggaagtccggttttatatgattctaaaggaagagttatagactctggtttatatactattgaagaacctgctggtaataaaacaggcggaaaactaattttaaaattaaaggaagctgttggagatttaagcaccacaagtatcactttaaagtataaggcttatgctccggaatttgataacagtactggtgacaacataaccattatcaattctgaaactggtgaatgtgttgctgctgcaagtactgtggatatgaattatacttatgttaatgatacttacaatgcttcaaatagttatagcatatatttaaaatcattagctactcaaaaatattcagaaattttaacaggatcaggtaagttacatcctgttgttcctcataatttaattgtgtataaaattgattttgagatttctgattactttgcttttgatgatttggtaatttatgataaatttgacacccataaagtaggttcagctcaaaaattcttaactgaatatgaacctgtcctatcaatttatggaaaaacatatgaattaaatgaaagttattacagtgttgtttctttaggagatattgatgaatcagttacattttatatttcaaaattcttaaaggataacaatataagtacaagcttaaaaggcggatattatacaaatagaagcgttaatcagggtgcaatggtagggtctttaaattttgttgcaaaagttattattcattattcaaacggatcttctgttgtatcaaatgatttggttattaattatattaaaacatcagctactgttttaaatacatttaatacggtttctgataacagttacacacaattaagagttccaagtgttacacttaagaaagatattattgcagttgatggtgaaatcataaatgatactgacttttataaagtttatcctggtcagaatataacttttgtattggatattcattttcctacaggttctgtaaacgattttattgtcactgactttttaccaattccattatttaacttaaaaggatttaatctggttaattccactactggagtaattcctaaatgcggatattgggcttatgcaaatgacagcggatttttatatgatgaaaatacaggtaaggttattgttcctaaaattggtatagatacttttaataatgcactttcatttaattttggaaatacattagataacctggctcatcctgttgatgttagattgtggtttacatttcaggtatcttcagaacctatggcagaccagcttaatttggctaatcttgctgaaatgaagtttaaggattccattgatgttgtatatgcaagctcaaatattgtactgatgcttactaatgaacctgaattaaaaattacaaaatatgtaaatgacacaaaaattttagaaaatattgaaaatgcaactgaagttgaatataatataactataactaacacaggtcattctgctgcttatgatataattgtagctgatgattttgttaacagaacaacttcaaatggaattacaaaagctgatgttaaatctgttagtttggtttactcaaacggaactgttgttgatattactgcatttaaagatgacttatttacaaaaggatatatgatagctcagttagctcaaaacacttcctgcagtattatatatactgtcaggtttagtgaatatttaatcccaaaggaaagtattgttaacaatgtatggattacaaactttgcagcatatcctaatagtacaaactttgcaaccaacaaagataagtatagggataatgcaactattatagctaaagggttaaacattacaaaagagttcattggatctaatgttactgacaatactgaaatactgtttgttggtgaagtggggatttataaaataactgtaaacttcccagacttaagagttccaaacttagttattaaagatgagtcatatggaattaagtatactaactttacaataactaccagtgatggtgttactgttcctgaatatgcatatacagtaacttatacttcaagtgctactcatcctgaaaaaagttatttgactattgactttaatggtgaccttgtacctgcttatgctaagaataaccaattaattgttaatgcatattatactgttgttaataatgaaaatgttattccaactggtgcagacagtgcaacaaccagtaatcatgcaagtattagttggactaataataccttaaattctgatactgtttatgttgatatatatcagcctaaaatagacataaataaggtatttggacctaatatagttcagggtaatgatgaggctagtttcacaattactgtaactaacagcggtaaaggtactgcttataatactactattacggatgatttaacagaatttatcaaaacctttgtaaatagtaggagtgatataggtgtaactatactaaaaggtaatgaaacaggtaaagttatttttaattgaaataatgatgtagctactttgaatgttggtgaacttttagccggtcaaagtgtcagtgctaaatttacattcaatgtaaaaaatgatgttgttattggaaaagaatttaagaatatagctaaagtagattattattctatttttaatgaaacaaaattcgatgaaaaaagaaattactctaaccaggcaagcagtaccctacacacttacgatgctaaagtaaataaaactgtatttaacacaactattgtaaatggtaaggataaggtaactgttggtgaaaatgtaacctacaatataactgtaatattgcctgttggaaaatacaatattttaaaagttacagacactcttccggaaggtttaaaatacattgacggttcaattgtagtttacaaaggaaatactcaaaataaagctgttgaaggtaaggattatactgtaactgtaaatggcaatattgtagaattaacatttgcttctgaatttgcagatgaaattattaaggaatatggcggtaaattccaggcatttttaaatgctacagtattaaatgttaacaataacaaagcaggtgctgttaaaactaataaagcagtacttacctggaatactcatgaatccacatctgatgcagctgtcggcattgttgaaccggccatagatattactaaaaacttcaatgtagacaatgttatcggtggggatgtaatatactttgatattactgtaactaacagaggtcagtctccattatttaatgtaacacttagtgacgatttaagtgatttaattagtaaatttgtcagtggaggcattaatattacatctggtggtgctgttgtaactccgacatgggataacaatattgtaagcataaatattgctgaacttggtataggcaaatcattaacttacagatttacatttaaaataagagaagatgtagttataagtagtagttatactaacacagctaatgcaataggttactctgcaccgtctaacggtagaaattacactgatgctgcaaaagacagttttaccaccaaacttccggtaattactaaatgggttgttgattcagagattgataatggtagggataaggtaactattggtgaaaaggtaatttatggtgttaatgtaactttgcctgttggtaattatactaaattggtgattaaggatactttgcctcagggatttgagtatattggtgcagatgcattttatgcaaatggtacaaaattagtaaatggcaaagattggactgtaaatgtaaataattatgatataactattacagtcaataatgttcattctagtaactttgcaaatggtgttttgtctattaatttgactgccagacctacaatatttgatccgtccaataaggaaggtgcggttaaagttaataatgtggaattgttcttaaatgatgaaactatgggtaagtctagtgcaaaggttacaattgtagaacctacggcagacattactaaaaaattcaatgtaactgaagttgaaggcttagatcatgtttcatttgatgtaattgttaaaaacaacggtaaaaccccattatttgaagtgactattattgatgatttggaagaccttgcttcatttattggtcaaacacctggtgaagataatgtggttattaaagtaactggtgctgatggaaatccaattgatgctaaaatcaaatggattggttctcatgttgaaattgatgtggctcagttaaatcctggagatataattcatgcaaaatattcatttgttataaggtcagatatccaaattggaagccaatatgtaaatatggctaatgttgtcggatattccgcacctgatcatggtagaaattactataattatgatgaggacactttaaaaactaaacttcctgcaattactaagtgggttgttgattcagagattgataatggtagggataaggtaactattggtgaaaaggtaatttatggtgttaatgtaactttgcctgttggtaattatactaaattggtgattaaggatactttgcctcagggatttgagtatattggtgcaggtgcattttatgcaaatggtacaaaattagtaaatggcaaagattggactgtaaatgtaaataattatgatataactattacaattaataatgttcattctagtagctttgcaaacggtattttgtctattaatttgactgccagacctacaatatttgatccgtccaataaggaaggtgcggttaaagttaataatgtggaattgttcttaaatgataagactatgggcaggtctagtgcaaaggttacaattgtagaacctacggcagacattactaaaaaattcaatgtaactgaagttgaaggcttagatcatgtttcatttgatgtaattgttaaaaacaacggtaaaaccccattatttgaagtgactattattgatgatttggaagaccttgcttcatttattggtcaaacacctggtgaagataatgtggttgtcaaagtaactggtgctgatggaaatccaattgatgctaaaatcaaatggattggttctcatgttgaaattgatgtggctcagttaaatcctggagatataattcatgcaaaatattcatttgttataaggtcagatatccaaattggaagccaatatgtaaatatggctaatgttgtcggatattccgcacctgattacggtagaaattactataatgaaagtaaggatactttaaaaactaaaatgccaagtattactaaattagtaattggaactacacttggcaataaagaaggcaacatttttacaccaaatattggtgaaaatgtaacttatcaaattatggtaaagttacctaaaggtaattacactaatttgcaggttaaagatatccttccacaaggatttgaatatcttgaaaattcagttattttatcaaatggtactttaatcagtgatgtcagtgtaaatggaaaccttgtaactataaactttggaaatactacatcttacaaatattctgacaacattatatttaatttatctgctgttgtcttaaatgatcaatctaacaaagcacaatctattaaatctaataatgttgaattatatttaaatgatgataaaatagataattctaatgcacaagttaaaatagctgaacctaatataagtgttgttaaaacatcagataaacaaaaatatgaatattatgaaaatgcaacttattcaattgtaattacaaataatggaaacggaatagcatataatatcacaattaaagatgtgctgccattaggtttaaaatacactggtattaattcaacttccaagtcaaatggatgggttgttgaatttgatgaaaatacacgaacatttacagttaatggtcttaatttaactgttggtgacaaattcacattcacatataaagtttcatttgatgaatgggaaatagatggtgtaaaatactcaccaattggccaaaactttataaactcagttaatgtagcttatgtttcaattaatggaacaaatccaaataataggacatacactactcaaacaaccaaagaagttcatgttactgaagctgatcttaatgtagttaaaaactgtaataatgaagtagttatagctggtgaagatatttactacacaattataattacaaataacggactagatactgctcaaaatgttaaattaaatgaatattatcattcagaatatttaactaatttagaatactctttagacggtaaaacatggaatgtttacaataagcctattgatttaggaaatatcaattctaaagcttctaaaactgtctatatcagaggacatttggatgcaggtattgttgatgatacaatattaaacaatactgtcagagtcaacaccactacaggagaattaaaacttgaggataatgaagctacaaacattaaaaatgttactacattagctgaattgcatgttactaaagttaatattactgaagcaattgcaggtaaaattattaaatacgaaatagtaattaccaataatggaccttcatatgcacgtgatattattttaaaagatatttataatgattctgaattaacaaatatgttgtattctttagatggtcaatcatggactcgttatgatgcttctattaatattggaacattagctaatggtcaaaataaaacaatattatttgaaggattcattaaaacaactgttcgtggaaatgtaataaataaagcggttattggctcttcaacaaaattaagagaaaatagtactttagaagatgatgttgctgtaaatgttaaaggagatactacattggacattacaaaagtagctaataccactcttgtaaatcctggagatgtaattaagtatactgttcaaataactgcaggaggattgtcagattctttagatgttattttaactgataatttaagtgaaatgttctttgatgttagtaaggcaacttattctgtaaacggaatagacaaaggtgtttggataggaaatgcaaaccttggaaccatttcttcaggaatgactgttaatgtagtaattacagttccagttaaagcatatgttgatgttggaaaattaaacagcattacaaactttgcatctgtaattaattcagataaaaaagcagctaatgatacaaacattgttccaattaatgtaattgatttggcagttaacaaaacagctaatcatcaaaataaaacatataattatggagataatgttgagtatgttattgaaattgttaacaatggtcctggaatagctactgatattatagctactgacaacttaccagaaggattgaaatttattaatgctaatgttccgggtggttggactcttagtatatccaataataaaatcacaataaatggtgaaaaattagctaatggtgaaaaagttttaattactattatagcaaaagctgcaaaatcaaatacaacccttataaataatattaaagttaatggtactggatttgattcaaacatctcaaataataatgattctgaaacaattaaaataactcctttagttgatttggctattacaaaagtagttgataatgcaaatccattatttgactcaataataacttacacaatcactgttgttaataatggtcctgataagtcatttaatgttactgttggtgatttattgcctgatggtgttaaattcatcagctctgatggccgatacgatccagttactggtgtttggtttgttggtgatttagatgctaatgaaagtgtaactttaaagattgttgttcaggttattaaggttggaaatattactaataatgttaatgttactggtactggtcatgatactaatttaactaataataatgattctgttagtgttagtgttcctgattgtgttattttggatatttctaaagtagctaattctactgttattgtagctggtgaaaatgtaggttatactgttgttataaacaattacggtccttctgtagctaatgatgttgttctaaaagatgtttataatgttaaagagttatttggattacaatattcattaaacggtaaagattggttcaattacaatgaagctattaatttaggtaatattgatgttggtgctagtgtaactgtttactttagggctaaagttaatgcttctgttcgtggtgatgttttaaacattgttaatattattaccagtgttgatgatgctagaggtaactttacagataatgaaacagttaatgtaattgctaacactactttggttgtaattaaggatgctgaaattaaggagttaaatcctggtgatacagttcatttcattgttactgttattgctggtggatcttcagattcattgaatgtaaacttaaatgatattttggataataagttgttagatattaattcagctaaatactctattaacggtggtattttaagtgactttaatggaaatatttatttaggcaatatgcttacaggtactactgtgactgttgatatttgggctaaagtattggatattgctgatagggacattttcaatttagttaatgttactagtgatgagcatcctgagggtaatacttctaatgtcagtgttcatgttaggattgttgatttggctgttgataagctggtaaataattctgttcctaagtatttggatatgattgagtatactattgttgttgttaataatggtcctgataagtcatttaatgttactgttggtgatttattgcctgatggtgttaaattcattagttctaatggtcagtacaacccagttactggtgtttggtttgttggtgatttagatgctaatgaaagtgtaactttaaagattgttgttcaggttattaaggttggaaatattactaataatgttaatgttactggtactggtcatgatactaatttaactaataataatgattctgttagtgttagtgttcctgaatcagtattgttaaacattacaaaagttgcaaattcaacaataattgttgctggtgaaaatgtaggttatacagttgttataaacaattacggcccttctgttgctagtgatgttgttctaaaagatatattcagcagtaatgaattgcttaacttacaatattcattaaatggtgtagattggttagattacaatgaggctattaatttaggtaatattgatgttggtgctagtgtaacggtttactttagagctaaggttaatggttctgttcgtggtgatgttttaaacattgttaatattactactggtgttgatgatgctagaggtaactttacagataatgaaacagttaatgtaattgctaacactactttggttgtaattaaggatgctgaaatcaaagcacttaaccctggagacacagcacactttgtcattactgttattgctggcgggtcttcagattcattaaatgttaaattggaagatattttagatgctggattgttggatgttaaatctgcaacctacagaataaatggaggtaatttaactgattacactcaaattatttcattaggaaatatgcatactggcagtaagatagttgtagatatttatgctgcaatattaggtacaaccggtcaggatatcttcaattgtgtaaatgtcactagtgatgagcatcctgaaggaaacacttcaaatactacaatacatgtaaatattgctgatttagaaattattaaaatagtaaataatgctactccaaattacggagacgaaataacttacacaataactgtaagaaacaacggtccggataactcaaccaatattaaagtatctgaagtattggcagataatttcaaattcatttcagctaatgcttctaaaggatattatgatttaacaaatggtgtttgggcagtcggtaatttaactaataatgaaacagctaaattagttattactgtaaaaatagttaaaacaggatttattcaaaacaatgtaagtgtaaatggaacaggttttgatcctaacgtaactaacaacaatgctactgtgaatattactgttcctcaaacagcagatttgtctgttgtaaaaatagttaatgttgatagggtaagtgttggaaatagaatcacatacactattgttgttaaaaataatggtcctgacacagcattagatgtttatgcagtagataaattatcagatgctcttaaatttgtttcatataaagcaagtgtaggagtatatgatccggcaactggtatttggacaatcggtaatttaactaacaaaagcaatgctacattggaaattacatgtattgttttaaaaaccggcgtaatatctaatgaagtatttgtaaatggaagtacagttgacttgaatatgactaacaattatggtaatgtttcagttactgtaattccggctcctgctccagtacatcctgctgataaagatattatggattctgatgaagttgcaatgggtgttgatgcaatggcaaaaacaggaaatccaatacttgctttattggttgttttaatcttcggaatatttggatttggagtttccagaaggaaaaaataaatttaagggatttttataaatccttcttttttctttttttattttaaactaattttaaatagttatttttttattttaaattaattttgtcatcaaataaaaaattaacaattatataatcttctatttatcaaatacaattttcctgtaaagatataaacttgcttctaacaatatttatatattttcaaaaataaatttataaataatttaatatcggagttttgtttatgttaaatgataaaactattttaattactggaggaacaggttcttttggtaaaaagtttacaaaaagagtattggaacagtacaatcctaaaaaaattattatatattcaagagatgaatacaagcaatatttaatgcaaagacaatttgcccaacataaaaaagtaatgcgttactttattggggacgttagagacaaagaaagatttgcacgtgcttgtgatggtgtagatattattgttcatgcagctgcattaaaacaagttccggctgctgaatacaatccgttggaagctattaaaaccaatattgatggtgctagaaacattgtggatgttgctattgacaagcatgttgaaaaggtagtggcattatccactgacaaggcagttaatccggttaacttgtatggtgctactaaaatggtttcagataaattgttcatagcagcaaatgcttatgtgggtgctaaaaacactcagttttcagtagttcgttatggtaatgtttcaggcagtcgtggatctgtaattccatttttcaaaactttaattgatgaaggtcaaactaaaataccaattactgacatgagaatgacaagattttggattactcttgatgaggctgttgatttggtaattaaggctattggtgatgctaaaggtggggaattatttatccataaatgtccttcatttaaagtaactgatttggcaaaagccatgcttccggattgtgaatttgaagatgtgggtatcaggccaggtgaaaagctccatgaagtaatgataaccaaagaagattcaaggtcagcttatgaatatgatgattattatataatttaccctgatttggaatggtgggaagatgttaatataaaagaaggtggaaaaaaggtagaagacagattctactatgcatctgacaataatccggtttggttatctgttgaagagattagggaagctttaaaagatatagatattgtatactaggtgatttttatttctaaatttttaccctatggaaaacaatgtatagatcaggaagatattgatgcagttgctgatgttttaagtgaggattttattactcaggggccaaaaataacagaatttgaagaagaaatagctaaatatgttggggctaaatatggagttgccttcaattccggaacttcagctctgcatggtgcttattttgcattaggtcttgataagggagatgaaatgattacaactcctaatacttttgtagctactgctaacgctgggctatatttgggagctaaagttaatttctgtgatgtggaaaaacaaaccggaaatattgatgcatccaaattggaggctaatgaaaatactaagttaataactcctgtacattatagcggaaatcctgttaacttaaaggaaatagctgatattgctgaggataatgatgccagaattattgaagacggagcacatgcacttggtgcaaagtataacggcaaaaaaataggctctttaaaatactctgaaatggcaatgtttagttttcatcctgttaaacatattacaacaggtgaaggtggaattattgttacaaatgatgaggagtactatgaaagacttcagttattcagatcccatggaattactaaaaataacttggtaaatcctcgtgacggcgactggtattatgaaatgcagcatttaggatttaattacagaataactgatattcaatgtgctttaggtttatcacagcttaaaaaattagattcctttgttgaaaacagaagaaaaatagctgaaaaatataatggaatgtttgaagacaatccatattttgatgttgttaaagaaaatccggacggtgagtctgcatatcatttatatccgattttgttaaaagaaaaatatgcaaatcataaaaaggaaatattttcaaaattacgctctgaaggattaggtgttcaggtgcattatatacctgtttatttacaaccttactatcaaaaccttggatttaataaaggactttgtccagtagatgaagagttttacaaaagagaacttagtataccaatgtatcctacattaactgatgaagatttagagtttgtacaagaaaaactttacaaagtgtttagtgagtattaggaaaatgaaaattggagcaattattcaggccagaacctcttcaacaagacttccgcaaaaagttttaaaaccactacctttcaatagcaaaaccaatgtattgcagcaggttataagaagagtatccaaatctgaacttattgatgaaataataatagctacaacaatacatgatgaagatgaaaaaatagttgaagtagctaaaaaagaaaacattaagttttacaaaggcagtctggaaaatgttctggaacgatattataatgctgctttggaaaacagtttggatgttgttgtcaggataaccagtgactgtccatgtgccgatgcaaatataattgatgaaattattaaaaaacatatagactccgatgcagattatacttccaatacattaactagaggatttccaagaggaatcgatgctgaagtaattaatttcagtgttttggaaaaggcatatgaaaatgccactgacaaatttgaaaaggaacatgtaactccatttatctacaaaacacatcctgaagactttaaaatagtgcaatatgaaacaaaaaacgacaactctgatattaggattactttagatactcctcaggattatgctctgctctgcagtgtttatgataatttatatgataaaaatgaattcttctctctggaggatattatagaattatttaacaataaaccttatttaaaagatataaactccgaaattactcaaaaaaaggtttgcaatagtttggaagaggaattggctgaagttataaatttatgcaaaaaacaggatttggacagagccaaacaatacattgaaaagataatatgaatgtaataatattaactgaaggtggaaaagactacggttttggtcatgtagcaagatgcagctcaatatatcaggcttttagaaaattctgcataacacctcaatttattgttaatggagacaaatcaattgatgcgattttgcaaaatattgattatactatttatgactggcagaatatggaatttgctgatgatgatattgttattatagattcatatcatgcaccactcgaattttaccagaaaatagctaaaacaactgcactggctatttatattgatgacaataatcgtatagattatcctgacggaacagttgtaaacggaacaatccttgcaacaaccaaaagaaaagatgcactgtacggttcaaaatacattccgcttagacaggatttctggaacacaaaaataattgatgttaatgatgaaataagaaatgttttaattactttaggtggaaatgatttaagaaatctgactccgaaaatcctaaatttgctgaaaaatgaggattttacaaaaaaggtcattataggaaatagctttgataatgttggtgaaatcgaggagtttgatgatgaactgatttattctccagacagcaggcaaatgcttgaggctatggaaagcacagatttggctatttcatcagcaggtcagacattatatgaacttgcaagagtaggtgttccgacaattgctgtcggggttgttgataatcagataaacaatattaaaaactggcagaagcagggtttcattgagtttgcaggattttgggatgatgaagatttgggggaaaatattttagccaaactcgagttgcttaaagattttgatttaagaaaagaaaaacagaatagagcaataagtgccgttgatggtaaaggttcactgagaatagctaaaactgctctaaacaagtattacaggaaaaattctgtttttagagaaattaaaaaagaggattgtcttaaaatatttgaaatagctaatgatgaggaagtaagaaaaagctcatttaattgtgataaaatagatttggaaactcataaaaaatggttcaataggatattaaatgatgatacaacaggatttatggttttggaatacggtcaggatattataggtcagctgagatttgattttgatgaaaagtatcctgttatcagcatcagcctaaataaaaaatatagaggcttgggattatccaaatatctgttgaataatggaataaattatattaaagagaattataatcagaatactttaattgctgacattaaaaaaagcaatgcaaggtcaatttcattttttgaggctatgggatttaaaaaagaatatgaaatcagaaacggcagtgctttaagatttatttacagaggctaaattatggaatttaaaattgaagacagattaattggtgatggacatcctgcatttataatagctgagctttcagcaaaccatatgaatgattatgacatagctgttaaaactatagaagcaatggcaaaatctggtgcagatgcagttaaatttcagacctacactccggataccataactttagactgtgacaatgagtattttcagataaaacagggaacaatatgggacggtcaggtattgtataacctctatgaggatgcatttatgccatgggattggcagcctaaactgaaaaaggtagctgaagatttggggttaattgtattttcttcaccctttgatgaaacttcagttgattttttagaagatatggatatgggagcatataaaattgcatcttttgaaattacagatattccattaattgaatatgtagcaagcaaaaacaaaccggttataatctcaacaggaatagcttcaaaagaagacattgatttggccattaaaacatgtaaggatgcaggtaatgataaaatagctgttttaaaatgcacttcatcttatcctgctccattggaagaaataaatcttaagacaattcctgatttaaaagaaaacttcaaaacagttgtcggactttcagaccatactttaggcagtgatgtagctgttgcatctgtagctatgggagttaaaataattgaaaaacactttattttagacagaactatggaaggtcctgattcagacttttcaatggaacctgatgaatttaagcagatggttgattcaataagaaatgttgaaaaagctctgggcaaagttagctatgaattgtctgataaaatgaaggcaaacagggagttttcaagatcattatttgcagttaaagacattaaaaaaggagaactcataacaaaagacaatgtcaaatcaatcaggccaggctttggattgcatcctaaatatctctcagaaattatcggatgcagggcttctgaagatattgacagaggaactccttttaaactggaatttgtaaacaaataaatttaaattaaaaaagggttaatatataattttaagaggtgcttaatgtcattgaatgttggagttataggtgctggagcaatgggaacagctatttctcagtgtattgcaccaaatactaataaattgttattgtatgccagaagaaaagaaatctgtgatgatataaatgaaggacatattaactgcgagtatcatccaagtgttaaactgcatgaaaatattagggctgtcaatgatttatgtgatctgaaggatgttgatgttatatttttatgtattccttcatcagttatgcgccagacaatggttcagttaaatgaaatagtttcagataagtgtatttttgtaagcacagctaaaggaattgaaaacaagacaaataaaagaatgagtgaagttattaaagaggaaaccggaagatctgcagtagtgttatccggaccgaacatagcttctgaaatgatgaaaaacctgccttctgcaactacaatagccagtataaagaaaaaagatctggaaatagtcaaaagtgtattgtcaacttccaaacttaaagttaacactaatcatgatgttatcggaactgaattttgcggtatcattaaaaatattttagctatttctcagggaatctgtaaaggaatgggcattaatgacaatgctaaatttgcagttttcaccaaaagttataatgaaactaaatgtattattgagaaattaggtggaaacagatcaacagtagatgattactgtggatttggagatattataacagcatctacattaaatgtaagtagaaatcatactttaggtatctggtacggtcagggtgtatatctggatgagcagacaggagttctttttgaagggaaaaacacagctattgttcttaaggaaatctgtgataagttaaatattgaatgtttaactgttaattttgtttatgatgttattattttgaaaaaaagtcctaaaaaagcattttatgcattatgggaaaaattataattaatctcataatatgtctattttatatttattttttcagttttaaagcaatttttctattttaagtcaatttaagattaaactgttttttatagctatttttaatgtgtaatcaacagatttatatattttaaacatatattgctggttgtagaatatgtttttatatgtgttcgtcagtgttaaataggatatgttattattttatttctaaattaatggcagtaaaatagtttttcaatagctaatgggtgatgttaatgtaaaaaaagagttaatattaactgctgtacaaatctgtgaatatccaattgttaatcgtaggctatgagatatccgtcttcacaatcgatggatcagatattgtctgaagttgtatctgctactgtagcagatttttctgttaatttggagttataattctaaaatctttatatagtatattttaatggctacaattttttaaaatgtcttcaacaagctttaaataatatttaaacaatattttccaagtaaaagcctcaattctaatcaataagggaggtggataaacatgaaattattatttttaagtagtgtttatttaattatcagttcagttttttccgcatactgcattggtgttctttccatttttccttgggaggtgagatggtggagttaattatcttcataattggaacatattggtttaatattgattcatttattaaatcattaatgattctgattaatggtgaaagataatagctcaattttcacttccatttaacgggtaattaaatataaacaattcaatgatgggctttgaaaatttagttttcgtgaggtcttttccttgagatggaaactgtttaattacctatttttttaaattaatagttaagtttatataatattttaataatatgataaatacaagagaattacttttgaagtaagtctctatgggaaaataaatttgattagaattttaatgtctaatgcggaatattgtggagatttttctctgcaataagacattaaatttgatttttttttatcattgatttttactaatttttgaatatttttatttaaataataataaataatggatgtcatgtttttcagtaatttttaaattttatttcttaataactcattattatctttattttttcagtttcaatgcaatttttctattttaaatcaattttaagattagacattgattttcagatgtaatttatagttttgcatattttaaagcttgatcttgttaattttagaatgaatgtttagaaatacattattataaatataaaaaataacaaaatctaactttaatgatatgtgctgcactacttgctggaggtataggaacccgtttggatgttggaatgcctaagcaattttatttaatagctggtaaaccgattttaatacattctctggaagctttcttaaaagttgaagaaatggatgaaattatagtatcttcaccgaaagaatgtgttaataaaactaaagatgtaataaaagaatatgacttaacagacccaagaatcactgttatagaaggtggaaaaagacgtagtgatacaattttaaattccattaactacactcttgaaaatgattatcctaaagattcaataatggttactcatgatgctgcaaggatatttgtaactccaaaattaattaaagacagtataagatatgcaaaacagtatggtgcagccagtgcagttattccggctacagatgtcatatttgaatctaaaaaagacggaatattaactgacgttccagacagacagtatttgctgcagtctcaaacaccccaatcatttaacataaatcattacattgaaatttacagtgatttgtccgatgaggaaattgacaaattagatgaagctatgattttgtttcacatgaggggtcatgaaattggtttatttgaaggagatagaactaattttaaagttacaagaccatcagatattaaaatagctaatgcgatgttaaggggataaataatggctgatattgtaatcttttatgaacttccggaaagggaattaaataatgctaatcttttaaaagcagaatttgaaaaaagaggatattctgttgatatattaggttattataattacagggaacttatttttccaagaaaatataaacctaaattattgattggtcaggcaggttataacaataatgacattgaaagatatactgtcagattcaaacctaaaatcgataagatacttaatttaagatatgaacaggtaatagctaaaagaattcttgattctaaagctcattatccaaaagagtatatgaaaaaagccagtcatgtttgctggagtgaaaatataaaacaggatatgatggctgaaggaattgatgaaaaaaatttacctgttactggtgatattaaaacagatttctcaaatcaccgctttgattcatttttcaaaactaaagatcagctggcaagtgaatttaatttggattcatccaaggaatggattttatttatttcaagtttcacatttaatgaaaaagattctaaacgtttaatgagtatgaatcataatctggatgatggtaaatatatgcaaaaatggaatgttgaatcaaaagctatcgtaatggaatggtttgagaaattcctaaaaacacatcctgaaaaggaatttatttaccgtccacatcctgttgaattcaatgtccttgatgaagactctacaatcagtattttagatgaaaaatatcctaatttccattatatcaataaatatgcaattcaggaatggatcaggccatgcgattatttaaacactgttataagtacttctattattgatgtttacttgctggaaaaacagtgcaatattttaagacctgttgaattaaatcctgactttgataatccgttgcttgttggagctaaaactatctgcacttatgatgaatttgaaaagttaaacacggataaaaacactgatgaattcccggtttctcgtgaaatgattggtcagtattatgattttggagataagttggcttatgagagaatttgtgattatgcagaaaagatgattaatgatgattcgtttaagcatgatttctatccgaatccgtcaagattccacagattgaagtttattattaaaaggtctcttgatgtaccgaaattaattcctgctgttatcaagtcagctattaaaaacaagtcatccacatccaaaaccaaagacaacaggtcaatttatgaaaaaaatgctaaaaaaataagggaaattgtaaatcagtcttcataagggccaaaatctattttttgagttatatgattatatctttcagattctggaggtaatttcatataatctccatagatttgtgtaaggatgctgtcaagattattcgggcagtgaacttcaacatcttcaaacattattgtttttcccggtttgaaatcacttattttataaatttggggatggtgaagagctgaaatatcacagacacattcacagtctttatcattgtatttgtccagtaatttatgggttttatcaaataatgattctcttgaaatattaaacagctttaaaaatgcatgtcctgtattggctaatgcctgaactaatgaaggatatcctttaaattttataacagacattgcaagtaatctgtctaagacacggcaacgttttacatggaagaatcgttttagtttattgtccggaactttgtccaatacaaatatgtcaatgtcaattcctaaatcaaaatctacctgattgacccaccattcttcaaaaatagtgtttttgagcatgatttttgaaaataaaaagaagtaatcctttgttttgcttgttaaaaaattatatttattgttgggtttggataatgcgacttttttaaacttttcatagtcttttctaaacataataatgtctatgtcatcatcccatggaataaaaccgccatgtctgacggcacctaatgcactgcctccgtaaataaaatactcaatgttgttttcttcacaaatagctataaaatcctttagaatcataagctccaattcctgcagtttgtgaatagtttcatcagaataatcagtataatgcatcattttccctttttaaaaaacttgttaaattattatttataattaatatacatatataacttttctaatggaaatttttattaattatgtttggtataatttatagttatacaattggataggaaaaatatgacttttaaaattagtgtagtaatgcctgtttataatgctgaaaaggaattgaatgcagctattgattcaataatcaaccagtctttaggttttgaaaatattgagctgataatagttgatgactgttcaactgataattccagaaacattataagtgattatgctaatgaatatgataatattgttcctgtttttttagatgaaaactcagggcttccaggtaagccacgcagtttaggtattaaatatgccagtgccgattacatttcctttttagattctgatgatgaatatcttaaggaaggtcttgaaaatttgtacaatactattttaactcaagactctgattttgtaatcggatcacatatcattaatctggatggagataaggttaaggttaaattcctccaaagtgatgaaagattagtgaatttaaatcctttggaatctcaggaaatatttgacagcttaagtttgaattattttgtagctccatggggtaaaatctttaaaaaagaattaattttagataacaatatctcattcccggaagatactctgtgtgaagacacttatttttattttaaggcactgataaattcaaacaagatttctgttttaccaaatactcaagtttatatgtataacacatttgaacataaaaaaacagccattcatggtcatgatattaaaaaattcaacagatttctaaagggtatgtataatgtcaatgatcttctggaaccggttaaattgtctcagcatgtaacaatcggggaaaatatcggaagtttgcttttaatattttctaatttggataaaagtcataagatgtatgcggttaaagaaatttacaagtttgaaaagcatttaaactgcaaaatagatattcatagaagagaaattgctgttttaaacaataaagttttaaataaacagtttaaacaggctattttcatttccaaactttatacttcactttacaataatcagacaataaaaaatctttacaggaagttcaatattcggaaaaataactaagttttgttttattggtgtgtttgtaaatgggtaaaaaaaccaaaaagaagttttggactatgccaaaaaccaggaagttcaaatcttttaaaaaaagacaggataatgaatattacttaactgaagttagactcaataaggaaattaaggaatttcgggaaatgttcaacagtctgtcatatcctttgtctgttgatgaatatgatgatatggattcccgcagactgaaaattaagtttttattttctaaacaggagaaaaaagtctggaataaatccgataatcgccgccgcatttatctggaacagttagctttttttaaacatgtttatgttaaatggaaacatataacttatccgatttatctggaaagacactatggggttcctcaccatactacattttttgttccgtggtttttgaaaaagaaagataaaaagaaatttatttctgttgtagctaatggtttagtttaatttatatagtattttaatcagaattatacataatataaatttaaaaattacttgttgatatcatggataaaaaagagttaattaataatggtaaagtaaagagtgtatatactactgatgatgaaaatgcagttatcattgagtttagagatgatatgactgcaggtgacggtgcaagaaaagaagtgatgaataaaaaaggttcttataatgcacttatttccactaaactttttaaagtattggaggaaaacggtattaaaacacagtttattgatttgcctgaaactaatgttatggtagctaaaaaattggaaatgatacctattgaggttattgttagaaatatagctacaggcagtttaattcgtaaatatccaatagctgacggtactaaattagatcctcctattgttcaaatggattttaaagcagatgaattccatgaccctatgcttaatgattccattattaaagctttaggattagctactcaggaagaaattgatgaattaaccgaaaaagcattaaaaattaatgaagttttatctgaattccttttagaagctggaattatcttggttgatttcaaagttgaattcggtaaagataaaaacggcgaaattattttaggtgatgaaattagcccagacggatgcaggttatgggatagtgaaaccttggatatgttggataaggaattgttcagaaaaggtaaagacaatgaagttatggacgcttatgtggaagtttataacagaattatccctgatgacgagaaaatagaattgtaaggagtttttagaaatgatttttgatattgaagttaaagtatctcttaaagaaggtatgttaaacccggaagctacaactattgaaaggtctcttgctttacttggttatgatgttaaaaatgctaaaactgtagacatcatcaaattccaaatggaaggagaagacagggaagctataagggaagacgttgtagacatgtgtgaaagattactttgtaatcctgtaattcataattataaaattactgttattccacaaaactctgcttgtggggcttaaggggtttttataatgaaaattggagtaattagatttccgggaaccaactgtgatagggatgtggccagagctattgaacttgcaggtttaactcctgaatatatctggtggaatcaggaagatttaacagattttgacggtattgtaattcctgggggattttcttatggtgattatttaagagcaggtgctatggcttccatcactcctgttattgatggtattaaagcattggttaaagaggaaaaacctgttttaggaatatgtaacggagctcaaattcttggtgaaataggtcttgttccaggtgttttcataactaatgaaaatcctaaatttaactgtgaatgggttgatttgaaagtcggaactgcaagaacaccttttacaaaatcatttaaaaaaggtcagactttacagattccaatagctcatgcagaaggaaggttttacacagaggatattgatttattaaaagatcaagatcagatagttttacaatttaaagataaaaatcctaatggttctatggaagctattaccagtgtttgtgatgagtcaggtcttgtttgtgcaatgatgcctcatcctgaacgtgcttgtgaagaaatattaggttctagtgacgggttaaacttttttaaaggatttttataagtgatttagatggtagtttatttagtgggtgcaggtcctggagatgctgatttaataactcttaaagctataaaagctctaaataaagcagatgttgttttatatgattatctggctaatgatgaaattttagagcatgctccaaaggatgccaaaaagatatatgttggtaagaaagctggagaacattataaaacacaagaccaaattaatgaattgattgtcgagcaggctaaggaaaatgacactgttgttcgtcttaaaggaggggatccttttgtttttggtcgtggaggagaagaaatattagctttaatggaaaatgatatcaaatttgaagtaattcctggtgtaacatcagctattggagcgccaacatcacttgggctacctgtaactcatagagctatagctacctctgtaacattggtaactggtcatgaagatcctactaaaaaggaaagtcaggttaagtgggattatactgcagatacattagttatattaatgggtataggcaatattaaagagaacacaagtgaaattatgaagtaccgttcaggagatacacctgtttgtgttatagaaagcggtactcttccagatgaaaatgtgattttcggaactcttgagaatatagctgataaggaaattaacactcctgctattttgattattggagatgtagtaagtctttataaagacatttataattattgaggtgtaacaatgtgtgggattgtaggttgcatattaaaaaacaataaaaatgcagctcctgttcttttagattgtatatctaaattggaatatagaggttatgattcaataggtatcgctacagttagtgatggtattaacattaaaaaagataagggggaaattaaagaggttgattctaaattagatttggctgatatgcctggtcattatggtattgcacatgttcgctgggctactcatggtgatccaaataaaattaatgctcatcctcatactgatgaaaatgaatcagtagctgtagttcacaatggtattattgaaaattatttggatattaaatctcagcttgaagaagaaggccatgtatttaaatcagatactgatactgaggttattcctcatttaatagaaaaatatatggacaaaggatttgatttggaagatgctgtacgtgaaacaatcggaataattcacggagcttatgcaatagctgctgttagtaaaaatgaacctgataaaataatagctacccgtaaagacagtcctttaattgtcggtattggtgaagacggatattacctagcttctgattctccggctatactggaatatgcaagagacataatctatcctgaaaaaggggaactggtcattattgatgaaaatgaaatagtggtcaaggatgaatttgacaatgttatagaaaaagaaattgaaactattgactggactcctgaaatggctgaaaaggaaggttatgactatttcatgattaaagaaatcaatgaacaggctacagcagttagaaacactttaactgaaagggataatattcaggaaattattgatgatttgggagatatttcaagaatctgttttgtagcatgtggtacatctttccatgcttctataactggtaaatatcttttagaatctttggcaggtattccgactgatgttattttagcttctgaatttaaatactctgcaaatacattaaacgaagatactttagttattttcatatcccaatcaggtgaaacagcagacagtcttaaggcactggatttagctaatgaaacatccaaaactttaggtgtagttaatgtagcaggttcagctattacaaggcgtgctgattatgtgatacaaactcaggcaggtcctgagattggagttgctgcaaccaaaacttatgtaagtcaattgactgctatttatttatttgcagcattaatagctaaagatgaaaaattgcttgaagatatctacaaggtccctgatttcattgaggagctactgaaagaagttgattcaattaagacaatgtctaaaaaatataagtttgcccgtgactttttctttattggaagaggatattcttatcctatagctttggaaggagctttaaaacttaaagaaattacctatattcatggtgaaggttatgctgcaggtgaacttaaacatgggccacttgcacttattgatgagggaattcctgttgttgtaatactgcctcctggagaaaaccacagaaaaacaatgagtaatttggaagaagttaaatcccgtggtgcagatattttagctatcggttctaagaatgatgaaagactaaaactaaagtctgatgatttgtttactatagacagtgatgttaatgaagttattgcacctttagtttatatagtgccattacaattgctggcatattatgtggctgttgaaaaaggtttggatcctgataagcctaaaaacttagctaaatgtgtaacagtggagtgagatttatgatttcaatttttaaacttgatggagaagaatctaaagctatttttgctttggaatttaacgaaactccatatttatttttatatttcaatcaggaatgggttaatgaaaccgaccctgaagttaaagctctaaaagaagaatattctaaagcaatggatttaaacgatttaagagatttggagttaggtgaaagtattgattttgatgatggtgtcatactttgcttatctaaatttgaaaatccgaactccggagttaaagatattttatattcctattcagaacttctacttgtagatgattaaaaaatatgtttttgaattagctattaattatattaattaaatagctattattttactatttattttgcaatactcttatttaattgactttcttttgcattattctaatacttccttgaaaagcagtttttccaaaatctgtttttgaaacttaatttaactattttgtttggtttaattaatttaaatatttgggataatctaattttgcagtttatttgtgtgttttttataatttggattgcagtattttggaatctgatttaaacataataattcattgttttttagataattttaagtttaatttttatcatattttaatttagatagttaattaattgctgtttattaaaataatggattaactattgttgattattaaaataagccttcagattaattttactttaagcttattaatttatttggctctcgtagctttatttgactaaataccttaggaaaattctcctgtgatttttaattataacttattaacaatttttaaatacttacaattatctatattttttttaagctttaaattgcttattttagctattttaactttatttgagcttattttgaaattcaaaagctttttataagaaaagataaaaacaatatacacacaagaaaaaaatatttcttgattcataagaggtggacttatgtttggcaataaaatgaagatatttttaataacactttgtttcatgttgtctgtatctgcagttggtgcggcttcagatgttggtaatgtggtgtcatttgatgacgatgttgaaacaagtgatttggatgttgatcctccatcggggattgatgatataaataatgtaacttattctaaatccgaatatactcgagaaccggttatttatggtgaagacctttcaatgtattataaaaacggaagccggtatgaagtatctatatatcaggatggtaaacttataaattctcaaaataatgattctaaagtaattttcaatgttaatggtgtgaattacacaaaagaattggtaaacggtaaagctttcatagggattaacttaaatcctggaaattacacaataactacattttatcattatacagacggattagctaccaagaccaataatattgaagtattgtctactattcaggctaatgatgttgttaagttttttaggaatggtactcagtattgtgctaagtttttggatggttgtggcagtcctttggttaatgccagtgttatttttaatattaatggtgttttttataaaaagcagactgatgataatggtatggccaaattgaatattaatttgcgccctggtgtgtatattttaactgctatgcatcctgacgctttgatgtatggaagtaatatcactgtactgtctactattctggctaatgatgttgttaagttttttaggaatggtactcagtattgtgctaagtttttggatggttgtggcagtcctttggttaatgccagtgttacttttaatattaacggtgtgctttacaaaaaacagactgattatgaaggtgtagctaggctgaatatcaacctctttccgggaaagtatattttaactgctatgcatcctgacggtttgatgtatggatataatattactgtactgtctactattcatggagacgacattgttaagttttttaggaatggtactcagtattgtgctaagtttttggatggttgtggcagtcctttggttaatgccagtgttatttttaatattaatggtgttttttataaaaagcagactgatgataatggtatggccagattgaatattgacctatttcctggagagtatattttaactgcaattcatttaaacggtgaagaaaaagcaaatattattaaagtattgactactatttcagcagaggatatttcattaattgagaataaaagtggagtatttgtacttaaaactcatgacggtgcaagaaatgtatcaataacaattgatggtgttgaatacattgttcaaactgatgatggaggtgttgctactttgaatgtttctttatcaaagggtaatcatgcagtactttccaagaacttgaattcaggagaggaaatattcaatacgatttatgtaatggaagatcctgcttttattaaatactacagcatttacggtgtatctcctgatggaaaatatattatggctatcggaagaccttcagctgctggtgaattaagcaaatatggttatacattatacaaatcagtatttgaaagaatatgtccatgctgcagaagtgacagactttactggggaatattttgggcaggcagtgaaacagcaaactggggtgttttcccagctactggtttaaaagagtcaggaagtgcagaaggtcatatattctgtgctaaatgtgatgcagatttctctgttattgatggtaaaaaccatggtggcggttctaaaaatctgataaaagttatttctactgtcagttcatcgaaggatgaagcatacatattaaaaaatggacaaatgccttattcggcattataatctccattttttactttttctaatttttcagtcatgtctagtattctagttcttgaattgtttttcaagtcttgtttttcagtataattttcctcacattctaaaatataaaaggcttctttggaagtagttgatggaatgttcattttagctaaattacgctcaacacgtctttttaatttttcatcttccatatttttagttagaaaaatcggtgttttgacagcagaggatattttggtgttgtgtcttgcatcatgtctgacttctgcccgtttatctaaaataaaatcactgctgttgtttagattagggtctctaaatggaatgcctacatcagataaagctattctgatttcatcgttttttggaagggatttatcaagaacttctggatttggactggctagggttcctccctgttttcttccgaaaataggtccctgaccaacataaaatccagcttctataaaacctgccctgactggtgcagaagaagtataagtagctatgatacctctgtctttaattacacgtctgaactccctgaagaaatccagagaaaataattcaggagccatattttgactgaatgggtctaaaaatattgcatcataatagttgtcttccaaattttgaacagtttgtcttgcatcttcaatataaacattgatgtcaatattttcaggaattttgcatttttcatagctaatgccggcataatcctgttttattaattcattttcaatagcttttttggtaatgtcatgttccggaattggtgagggaactaaaagaccgcatgcaagagtagcttttgaaatttcaaccatatcaatttgtaaactggaatctgagctatttttaataaaatcggctattgcagcagatgaattgtatccaagtcctgcacagatatctaaaatagctagatcttcatcgtagttgaatttcataggtttgataaatttctcaaatgattcacttattgcacctgtagatgtatgaagtgtttcaactttgtgatttatttcctttgaattaatggaatatgatccgtcatcagttaaaacaaaataatccttgtttccatcaaaaaaattacatcttgaattaatatttccactacttctttctttttcaaaacagctgttgactaaatcaaaaatatcatcattgattactctggcatttttttcataactcattttaatctatttaaataattaatttttgactaatataaatctattagaaaaagtaaaaatcggttttataaatcattacaagaatatgatactttaaaaaagataattattactgatattatttatgatatgtcaggtttgatataatttaaattcagattactataattttaaatactgtcatgatacaatattatgtggtgactttttttggaatttttcaattttgatgttggtaaaaatcgtatatataatgtggattggcttaagactattgcaatacttgcggtattgttattgcactgttcttcgaaatatttgatgccggattttgtgtttcagccaaattggtactgtggagtattttttgaatcactttccagattcggtgttcctttatttatcatggtttcaggatttcttattttaagaaaagaccaaccaatttcatctgttcctagaagaattaaaagggttttaattccttttattttttggctagtagtctatgtaattgctaaatttgcaatgatttatcattcatttgatttaattcaatttggatactttttaattcaggcatttttagacccaactattgtttcaatcgagttttggtttgtttacatgattgtagggttgtatatattttcaccgattattactacatggctgcataatgccgaaatttatgaaattgagtattttttaattgtatgggctttgatttcctttgtaggattttcaaatgttgattttttattatatgattatttaaaatatttcacaggaagtatcggttattttatattgggatattatttatacattaaacaaaaatctgttttaaaaaataaaaacttcggactggtactgtttgtagcaggaacattgttgtcatttttaggaacagtattgtcttctatggcgattggtggacagtctttattattttttaatttaggtgatgtaactccaaatgcctgtcttcaagctattggaatgtttataatagtattaaacacagattgtgaaaaatattctaaatcagttaataatgcttttgttttttgcagtattggaagttatggagtttatttagctaatgttttatttattaacattttcgataaaattctttcatttaatgttatgggaaatgctgcactgactatagttttagaatgtattgctgtttttataatctgtaatatttttattagactgatgagtaaagttccggttttagagaaattttccggaatttaatcttttttatttttttacttcaatttttattttaaaaatgaggaaaatttatataatttctaatttaaattttattttaactaataaaataaggttaattaaatgtttgagattaaagctaaagataatagaggcagagttggtgttttgaaaactaactctggtgatgtaaaaacccctaatttaatgccagttatccatcctcgtaaacaaactattgatgttaaaaaatatggggcagatatagttattaccaatgcttatttaatttacaaagatgaggatttaaaaaagaaagctgcagaaatagggcttcataagttaattaattttgacggtccgattatgacggattcaggttcgttccaactgtctgtttacggtgatgttgatattacaaataaagaggttattgagtttcaggaattgattaaaacagacattggaactagtttggatattccaacagcaccttttgtaacccgtgaaaaggctgaagcagatttggaagttactttggaaagggctaaggaagctgttgattacagaaattcccaaaatatggaaatgaaattgaattctgtagttcaaggttcaacttttcctgatttaagaagaaaatgtgcagatgaactgactaaattagatgcggatttgtatcctataggtgcagtagttccgttaatggaatcatatcattataaggagcttgttgatgttgtaatgaacagtgtagcacatcttccggacagtaagccccgtcacttgatgggtgcaggccatccgatgatttttgccttggctgtagctatgggatgtgatttgtttgattcagcagcttatatattatatgctgaagatgaccgtttattgtctgtaagaggaacttacaaacttgaaaacttacaggaaatgccatgttcatgtgaagtttgctgcaactacactccggatgacttaagggctatgcctaaagaaaaaagaagagatttaatagctcagcataacttaaatgtttcatttgctgagttaagattaattaggcaggctatttatgaaggttcattaatggaacttgttgaagaacgctgcagagcacaccctaatctgcttgaagctcttcgccaattaggcaactacagcaaagatttggaaaaatatgatccgagaagtaaaaaatcagcatttttctacacaggttcagaatcattatacagaagtgaagttttaaggcatattcaaaagctaagggcaatgcccagaaaacgtgatttggtaatattgcctccttcacgtaaaccttacagcaaatatgtttcaagtaagcttggaaacttttatgtttatggaagtgaacaggaattggatttgaacaatactgattttatggtattggatattccgttcggtcttattcctcttgaaattgatgaaatatatccattaagtcaaaatgaatctccaagaacctgggatgtaagcagtctggaatttattgaggactttatctcagaatttgtagaatactatgatcaggtcttaattcactccaatgttattaaaaaattggatattggattatataatattcattcacagtctgatgaaatcagatatgcaaaagatgaccttaaaaaggttaaggcaatagctgactatcagtttggtgtcggagcaggtgatgctttatttgcaggtaatataaaaattgaaaaaagtaaaaaaacaggtaagataagacatatttatgacggaaaaacattaattgtaaatatgagagcttctgacagctttttaatcctttcaaaagaaggtgcaaaaagactccatgcagctacacaatatcctaaaaacagagttgtagtaaataaggactcagaaccattttcacttgaaggaaaaagcgtttttgccaaattcgtcgtggaatgtgatgaggatataagagctaaggatgaagttttaattgtaaatgaagaggacaagttgcttgcttatggtaaggcattacttggggcctgtgaaatcaacgatttccaaacaggacaggctattaaaacacgtaaaggaatgaaaaaataaggaggaaaacataatatgtctgataaagtaaatactggcaacaatatggaagataaaaaacttattaaaaatgcaagaaaacctgaaggaaaattaggtcatgaaatacttgacaggatgaataaatctcatgaaacaatggccagatggggagtcagtcattttaacattgatgaaacagataaaatccttgatatcggatgtggcggagggaaaaatcttgaacgcttcgctaaacaaataggtaaagacggatgtgttgttggaattgattactctgaagtaagtgttgaaaaatccactgatttaaataaacaggccatagatgatggcaaagttaaagtcttacagggatctgtatctgaaatgccctttgaagatgaaagctttgacattgtaacaggttttgaaacaatttatttctggccggattttataaatgacttaaaagaagtaaacagggttcttaaaaaagacggtttggtatttttctgtaacgaagcagtttacagagaaggtaaaatggataaatatgaagatttaatagaattgttggatatgaaaatttattctgaagatgttttgaaatcagcacttgaaaaagcaggttttaaagattttcaggcatttattcaggatgaaaatgagtggatttgtgtaactgcaagaaaagcttaactattaaaaacaatataatatcatttttcaaatactcctaaggtttaaaattatgaataaggttcgaacaatatttgcaaatatgagctggctgatgatttcccaaatcattaccagtgtttgtgcttttgtttggactattttaactgcacgttaccttggggtatctgactatggtattttaggaacagcaacttctttttctgttattgtaattgttgttgctgatttgggagtcactacatatattacaagatccatttcggtggattataatgtagaggcggagtatttgggaaatgcactgtcccttaaattaatactgtctgtactctatttggcagtggttatttttatttcctatttgctgggatgggataattttactattttaataactttcctatttgcaattgaaagtttaattaaatcattttataatttgctttttgcttcatttcaggctcacgaacagatgaaatatcaggcaattaccaataccttacttaatgttttgactttggtatttattgtaatgatttgctttactgatttcggtttgcttggaatcacctttgcatacattgcagctaatttaatcggtttgatttattgtatagctgccctgacaaagcatattatagttccgaaattattgtttgatttgaaattttttaagaaactgataattgcgggaattccttttgctttaactacactgttttatacattgtattattcaattgacatggttatgattactcagttttcaactacctatgcaacagggctttataattctacctacaagctaattaatgttttaacattgttttatacaatttattcagctgttattttcccggttatgagcaagctgtttaaacagggaaaagacatgttgcgccttagctttgtcaaatcaattaaatatttgtctatgattactattccaatagctgtagctacctttttctatgcgggggatgtgatttatctttgttatggtaatcagtatgctgatgcagacagtgttttaaaaatattggtgtggactgtctgtttcttattcgttaacggtgcatgttccatgattttaaatgcatctcataaggaaacttccgttacaaagatttattctttagctgcagtgttcaatgcaggattaaatttatgtttaataccttatttctcagcacacggagcagcatttgcaacagtaatgactgatgttttaattttaattttagaaatgtatatgattagtaaaataaatcagcttcctgacaggcatttgatttttgatttgattaagataattattgcgtctgctgtcatgggcggagtattttacctggttaacatgtcattatggttagctattcctgttggtgttatagtttacttaatagttattactcttataaaattctttgataacgaggataaacttataattaaacagattttaggtaaagcttaatatagaaaactgatatatattaatcctagtaatttgtgagtttagtattatgagtagggtaagaactgtttttgcaaatatgagttggttaatgttttctcaaatcataactagtgtctgtgcttttgtttggactattttaactgctcgttatttaggtgtatctgattatggtcttttaggtacagctacttcttttgcaactatttttggtgtttgtgccgatttgggagttactacctatattgtcagatccatttctacagattttgactctgaaaagaaatatttgggaaatgctattggtattaaattaatattggcggtattttacctggcagtggtatcactggctttatttatattgggctgggataattatactgttgtaatctgtttcttgtttgctgtggaaaatgtaattaagtcatttcaaactgcaatgtattcttcattccaggctcacgaaatgatgaagtatcaggctattacaaatactttgcttaatgttttaacatttatattcattgtagctgttacatttacaaattatgggttatggggaattactttagcatatattgcagctaatttaatcggtttagtttatgcgactttggctttatctaaaaagattattgttccaaaaccgttgtttgataaggctttttgtaaaaagttagttattggaggccttccttttgcattgactagcttattttatatgatttattattcaattgacatggttatgattacccagtttgcaaatacctatgcaacagggctttataattcatcttataagttaatcaatgttttaactctgttttatacaatttacacttctgttattttcccggttatgagcaaactgtttaaacaggacggaaatttactgcagtttagttttgtcaaatccatcaagtatctgtctatggttactattcctatagctattgctacttttttctatgggggagatgtaatttcattatgttatggtaatcagtatgcggaagcaggagaagttttaaaaatccttatttggactgtttgcttcttatttattaatggagcatgttccatgattttaaatgcatcccacagagaaactgcagttactaaaatttattgtttggctgctttgtttaatgttgccttgaattttattttaatacctcatttctcagtttacggtgcttcagtagctactgtaattagtgagattttaattttagctttggaattatacaccatttataaaattaatcagcttcctgacagacatcttctggttgatattttaaaagttgtactttgtgcaagtgttatgggtgttgttttacatattcttaatcttaatttatggttagctattcctgtaggagttgtagtttatttaatagctattattcttactaaaacatttgatgatcaggataaactgatttttaaacgaattgttggaaaatagttttaccaaaaactttatatactatcaaaacaaaagtataattgttgtctgttatgcggtgttagtccagcctggttaagactctagcctgccacgttagagacccgggttcaaatcccggacgccgcatttatgcagttgtggtatagtctggttattacttgggccttccaagcctacaacccgggttcgaatcccggcaactgcatttgttttatctaattttcttatttttttcttaattcttattatactgattagtttttttagttacttttatataatactttttataaagattaaattactaaagttagttttctaactaatttataaattaaaaaaatcttggtgattctatggtaggaattgttggatatggggcatatgtgccgtcatatagaataaaagtggaagaaattgctaaagtgtggggagatgatcctgttgctttatcaaggggtttagttgtaaacgaaaaatccgtaccttctgctgatgaagatactgctactattgcagtaactgctgctagatatgctctagcaagagctcagattgacccacaaaaaataggggcgatttatgttggttctgaatcacatccttatgcagtaaaaccatctgcaactattgttgcagaagctataaatgctactcctgatttgactgctgctgatttagaatttgcttgtaaagctggaactgctggaattcaaatgactatggggcttgtggattccgatatgattgagtatggattagctattggtgctgatacttctcaaggtgcacctggagatgcattggaatatactgcatctgctggaggtgcagcatatattattggtaaagataacactcttgctgatattgaagaaacatacagttttactactgatactcctgatttttatagaagagaaggacaagactatccatctcatggtggccgtttcactggagaacctgcatacttcaaacatgtgttaagtgctgcaaaaggtttatttgaaaaaactgattcaaaacctgaagattatgattatgcttgtttccaccagcctaacggtaaattttacttaagggcaggtaaaaaacttggatttactagtgaacaaatcaaacaaggtcttttaactccaaatattggaaacacctattctggtgcagttccattagctttatctaatattttagatgttgcagaaccgggagataaaatatttgttgtttcatacggatcaggtgcaggtagtgacggatttaccttaacagttaatgaagaaattaaagaaaaaagagatttagctccaaaaacacaagacatcattgatagaaaacaatatgttgattatgctgtttatgctaaatttaaaggcaaaattaaaatgtaggtgtaattatgagagatgttgcaattataggagtttcacaaactaaattcggtgaattgtgggattcatcttttagagatttaatcgctgaagcaggtgtaaaagctgttatggatgctgaagttgaaggagacgatattgaagcaatgtatgttggaaatatgtcttcaggtttatttgtagaccaagaacatattgctgcacttatttctgatcacatgggtcttaatccaatcccaactacaagggtagaagcagcatgtgcatctggggggcttgctttaagacagggaattatggcagttgcatcaggtttccatgatgttgtaatttctgcaggtgttgaaaaaatgactgatgttgtagatgctactccagctattgctactgcatctgatcaagaatgggaagcacaacaaggggctactttcccgtcattatatgcgatgattgcaaaaagacacatgtatgaatatggaactacaagggaacaattagctcaattttcagtagtaaaccataaaaatgctaaaaacaatccaaatgcacaattcccatttgaaattagtgtggataaagtaattaactctactatggtagctgatcctttaacacttttagactgttctccagtttctgacggagcagcagctgttgttatggttcctgcagaagatgctaaaaaatacactgacactccaatttatgtaagagcatctgcacaggcttccggaactattgcattacataacagaaaagacttaaccactattgattcaactaaagtagcttccagaaaagcatatgaaatggcaggagttactactaaagacattgaccttgcagaagttcacgactgtttctcaattaacggtcttttagctgtagaagacttaggatttgctgaaaaaggtaaaggtggaatagctattgaagaaggtcaaacagaaatcgacggtgatttcccaattaacccatctggaggtttaaaagctcgtggacaccctcttggagcaacaggtattgctcaagctgctgaagttgtatggcaacttagaggagacgcaggcaaacgtcaagttgatggtgcagaaataggtatgactcacaatataggtggtactggaggtactgcagcagtacatatatttggaagagatcttgagtagacagtcatcttctctttttaaatactttaaagtacaatatattaattagacatatttttggagagagtataaaaatgaaatttaaaataacagcagtaaatactaaaaacccaagtgaaaaattcgaatatgaattagaaggagaatctgttgacagtttcaaatactttgacgaagctgaaggtaaattcttccatcctaaagaagtattaaacaacaaaatgagagaaattaacaacaatttaatgttaaatgactcaccaatatttaccattaaaaaagctggtgaaaaagctaatataaaagctatgacttttgacattgaaattgaatcaatctaatagatttaatttcacttttttttatttaaaagagactcatttctcttttattgatttttatggatattccactttatttttatgctgcttttaaggatatggacagattagctcctggaagtgataagtctactttaaaagctattggctatattgattttaataaagattcgcaattaactattttggatattggctgtggtgtgggagcttcaactttattattggctgattattttaaaaattcaacaattgaggctattgatttatttccacattatctgaaagttttggatgaaaaaatagctgacaatgatttggataacagggtttacacctgtcagatggatatgaatgacctggattatccgaactgcgaatttgacattgtttttagtgaagcttcagcatatatcatgggtcttgctaaagcacttaaaagttggaaacgtgttttaaagcaaaatggttatctggttgtttctgagctatcatggattcaaaagccttcaaaagaatctaaaaagttttggaaaacacattattcggaaatagacattattgaaaataaaatagctctaataaaagatgaaggttatgagtttatagattattttattttaccgaaaagtgattttgaagattattatgctaatttagaaagcaatcttcgaacattagatgataatgactttaaaaaagattttaaaaaggaaattgaagtttatggaaataatagtggtgattatagctatgtttattatattatgaaaaaagaagttcgtcaataatttccatatctatattttcttcaacaatttgtgctaatttatttaatgagtaatctttttgtgtttcgtaagggtcttcaccatattttgcttcaagaccttttttgactcttagataatttaaaaattcacgtctgaaattgtaattgtggaatattccatggaagtatgttccaaagacatttccattacatgctccgtcaaagtcaccttcatcattatttccctgtcctttttgaacatttaataatgggcatacatctttacttgaattcaggtgtgatgtaccttcatggatttcataaccggttactttctctccagcaatctttgcaaatatttcaccagctattccggacaaatcctctttttgaggtataactgcttcagactgtgttacaattttttcggtatgctggaattttgactcaatatccaataattttaacccttcaatagttccaacatcagattcttttttattttcatcataaattatatttccaaggatttgatatcctccacagattccaacaactgggatttcatcggatttggctattattttacttgcaagtccgctgtcaaagagttcttttgcatctttggttgaattacgtgttccgggaatgattatagcatcaacatttccaatttcatcattgggattaatcattttaattccaacatcctcttcaaactcaaaaggatcaatgtctgtaaaattggagattttaggaagccttataactccaataataatatccttattttcatcaaatatgtgggttgttagggatgctgagtcttcttcaggcagttttaatgtttcatcataaggaagaacacctaaaaccggagcttcggtgatttcttcaattctgtcaagtccaggtttcaaaatatccaaatttcctctaaacttattgatgacagtagctttcagtctggatctgtcatagtcatctaaaagcacatatgttccggcaatagctgcaaaaacaccacccatttcaatatcagctattaaaataacatttgcatcagccatatgtgcaatttccatattggcaaggtcttctttacgcatattaatttctgcaggtgatcctgctccttcaatgattataatatcgtatttttcttttaaaatattgaaactttcctgaatagcttcaaaagccgtgttgtgatagtcatgctgatactggtagaaattcatatctccgatggattttccctgaataattacattggatgtaaaatcaccttttggttttaaaagaatagggttcatatgtacacttggttcaaccattgcagcttctgcttgcaacatttgagctattcctatttctccgttttctttagttgtatatgaatttaaagacatattttgagatttaaaaggagctacgttatagcctctgtttttatatattctacataatgcagctacaagcatactttttcctgcatttgatgatgttccctgaaccattaaacatttaaccattaaaatcacttttttatttgctttaaaaatatttgtcatttatattttataaatgttaatcggttaattatgtcggctctttcaaaaacttgtgtgatttttttctttttcattgtttaaattccaataatttagttttagcatgaatctggctagaagtccttgttctattttcattgttctttttatgtgttttgggaatactttttggaagatattttcgattttattgtttgttgatgggatgttcgtgttttccaggtgtgtcgttaattttttgaagtaaggaatgatgaatttccaaagaattttgtttgtgaacttgttttttgtatattttttgtttattaattcgtttctaagttctttagcagtatttaagtcttttgcatccaatattttataaatgtcctgttttaaacaatttaatatgtctttttcgtcttcagataatggatttttgtcaaagtaatctttaaatcttttgtttactgcttgtttcacgtgaaatttgcagaaatggtgttttacttttaatttatcgatggcttcacgatattcgtgttttaagtctgtgcctattgatatttttttctgatttcttagagattcgtttaaaaattgataaatggtcttagaatcttctgattcgaccaatttgacggaaacgagagtattcaatttaacgtcgaataaggctaaaatatagttccattcaccattaattttaacccaaagactatcaaataagtaatatccagaataagtccaattatcatagttaaattgataattagagttcaataagatgttttcaatgctttgatgtgagatttcaatgttatgttgttgttttaaatcaaatcgtattttatggagccctgctccataaatttgatataaattctcaatacattcaataacaggcaatgtaatatttgaattagaataaacaagagataataaatcagtataaaagactttaccgcattttatgcacttatatttttgaatagtgcaaatttgttctccaattcttaaaaaaataagtttacgttcataagtaccatttttaacagcattatgtgatttacaagatggacaaattgcaactctattctcaaaatgtattttacctcttttttccaatctgataagattattctcaatattttcgcaaccaaatcgagaaagatcatcaaattgacggaattcagaaaactcaggaacaaaatcgaaaagtttaaattgttttgactccataaattcatatggagcttttattttgatactagacatattaatatattagctccacttaatatattaattttactgcttttaaattaaaaataaagaaaaaatagaacgaaaaaaattcgtgactcaaaaactagtgaaaattcaaatcacacaagtttttgaaagtgacattatgtctataatattatatattatttcaactaaaatttataaatgtaaaaaaaattttattaaatataaaatatattttaatttaataaaaaggttgattatttatgaaatttaataaacaattctttttaggcattatgttgcttgttctccttttgggagtaagcagtgtaagtgcgaacgatttgaatgaggataattcatcttatattagattagatgactcttcaatggtaattatggaggattctgctcaggcaggcagcgatgttaatgctcagacaggcaatccttctgatgatgtgattattgtaaataattggggtgaactaaaaacatactgtgaaaaaacagataaaaactatgtgcttcagttaaaagaaaatactaatttttacccggaaaatggagatgacatttccaatcagattactgttagaaataatgtaactatcctgggaaatacaggagcatatattggtgatgtatctcctaaggcatcaacacttttttatactccaatttcaactccggaaaattcaggaattagtttaaaattagttaatttgacatttaaatttatatctgtttcaaaactttcatctctggatagtggaatggttgtggagttggctggtgattgtactggcaacttgcttgaaaattgtacttttgacaatataactgctttgtcaggtcattcctgtgtttattatattaaaaaaggttatacaactgttagaaattgtaattttacaaacatcaatacatgttttggtgttttaagtatttatgatcctgatgctggcttaaactgtaatacttcacatatgttagttgaaaactcttattttgaaaataattatgctacaacagaacctggatgtattaacaattgcggtcagttaattgttaaaaattctacattttataaaaacagtgcattttggtgggctggagcaatacacactcacagtggagcaaatacaacaatatatgattctaatttcacagataatgtagctggatggaatggtggagcattgtatacctacagttacctgcaaatatacaacaccacttttacaagtaataactgtacaaccaacaatggtgggggagctattggtgcatgtttctatggaaccaatcctcatatttatattgaaaactcattattccagtataatacaaacaactgctggtctcttactaatgaatctacaacaggtactggtcgtggaggagctatttcaataatggatgcaggtgatttggatgtatataatactactttcatagctaattctgcatctataggtactgcaatttgtgcaaatcaggcacagggttacggatctccaaatgtcagattaataggcaataaatttattaatcacacagtggttggcgatgtattgataattgatctttccaaatctgaactggaattatctgataattattattataacaattctttagtattttctaaaaccaaacttagtgaagaggaaagaattggcaacacaacagtattgaatattcagtttaaattaaaaaacgacaaatattatgattctgatattttatccaaatcaggttattttgtttatgtagatggtgtttatttaaaaacagtctacagtgagtcttttaatttgacttttaatgacggtaaggaacataaggtatatgtacgttcagttgcaggtgtcagtaactcaaataatctcactgtaaatggtgtacctgttcagtatatctatgtttctgtaaacggtaatgacaacaataacggaagtaaaaacgcacctgtacgtacaatagctaaagctatttctttaaatactaatggaatttatattttagagggaaattacagggaatatggattaaatattaacagtgatttaaaaattgttggtgatggaaaagttattattggcggaattagttcagctgatccggtatttaaaatttcaaacagtgcaaatgtatcatttaataatttaaaatttgctgatatatccaacggtgaaattattaatggattagctgctggagaagttgaaataagtggttgtgagttttattcaaacaatcagaaaggaattcttgttaatgtagctaatttgcttatttcagattctaaatttgaaaataataatgttttcaaatgcatttatactaattatttggaaatgagaaactgtgaatttgtaaacaatactgcaaacgagaaaaaatccacttctgaggtaggcaatttaatttatctggaccttaaagaccagcaaggaataatttcaggcactttctttgaaaataataatgtttatcagggatgtatttttgtaaaaagtagtgattttaatcaaggattggagattgcgagttctgttttcataaataatactggagtatttagaggaggctgtctgtatgctgattcaagttccagcagcaactatcctattacaatttcatcttctgtatttattgataattttgcacagtctggaagtgttgcttttgttatgaaaaaatgtgtacttacagctacaaattcaatctttttaggcaataaagaaaaatcctcatcattaggagaggtattttcaactgtaggcagcagtgcaaaatttgcaatagacagtaattggtggggtaacactgctgaaaatgcaacaactgctccaagaaaagggttgaacaattggttatttttaaatgtaactggtaatgttgataaattgaatttcaatgaaaatgggataataactgttgatttagctaatgtaattaataacaacggtgaaatcagcaaatatgatgctggagacaaattgccattagatactttaaatatcacttctgttaatggtataacaacaactgtcggtgataaatttgtggatggtaaaatacaggttatatttactccaactgctactggagaagcttcagtaactactgatctttatggagtaaccagtactataaaattcaatgtaggtaaaacactttcagatttacatatctatactaatgatattaaggtaaatgaagaccttgtaattaaagtagctttagaaagcagcaggccaacaggtaccgttacagttaatattaataataaatcatatattattaatttagtaaacggtactggatttacaacaatatctggattagctggcggagaatatgaaattactgccaaatataatggtgatgataattacgaagaagctattgctacgtcttcagttaaagttaataaaatagcttcatcaatggatattaaagtttctcttggaaaatacactacaattgttgtaagtcttccagaagatgcaactggtgaagtaatgtttactgttgacggtgaaagtgaaactgcaactattgaagatggtaaggcatatatagttttatttgaccttgatgagggagttcacactgttcatgcagtttatggtggagataataactactttggatgtgaagctagtgaacaattcagtaaaaccaaacttaattctactttaactgtaaatgcaaatgatgctaaagtaggtgaagacgttgttgtttctgtaattgtcatgcctgctccaggtagtgacggatccagtgtaaatattacaatcggagataaatccacaattgtaaaagttgataaagatacaggtaaggcttccttaaaagtatctgatttagcagcaggtaattacactgttaaagtagtttataatggtaacggattgtataatggttgtgaaaatacaactaatattaaaataaccggttattctgttcctcaatggggtaatgatggatttgacactaaaaacactggaaaaacaaattacacaggaaatagtaatggtgtagctatctggaattatgttgtaagcggaagtcagattaacggttctatggctattgataatgcaggaaatatttatgtagcttgtaatgatggaatttattcatttacttcaaacggaactttaagatggaaatttgaaggttcctttggaagagagatatcttcaggaatagctatttcccgtgatgttattattgctccaaaagcaggagatgcaatatactttataaactccactacaggcaaaaaatataattccaatatctggcagggatcaagtattttctcacctgttgtagatgaaaatgctaatgtatatatttccagtgaataccagtacagcagcggaagctacaatctggtaatcatcccatataatatgtggaaatacggcggaactcctacaatgattgatttaggatcccaaccggttagtgcacctacattactgggtaacggattggtagctgttaatacaaaagacggtcttaaaataatcaatgttacaagcaaaactgtaattggaagttttgtaggaataggtgttgtaggacgtccggtagttgactccagtgatgtcatatatgtatttgataaagacggaaaagtcaatgcattaagtgcaaataacaaattatggactactgaaatagctataaatggaagcacattagctttagatgaagaaaacagtgcattatacactgttggcagtgatggaaatgtctataaaatagatatatttaacaaaggagcagcttctgttttctataatttgggaggtaatgcatcttccataatgattgacaatgatggaactgtttatataggttcagataatggaaaagtttctgccatcactagtgaagctaaattattatggacatttactgctgagtctccaattaaaggaccaatcgtcatggataaaaatggtacggtctatgtttattccagtaaaacagtttatgcagtaggaatgggaaaaatcactcctgctattgatgtaaatgctgaggatgttaaagtcggtgaagatgtaattatcaatattgagcttcctgatgatgctacaggcagtgttgaagtagttattggaaatattacacaaaatgttaatattaaagacggtaaagcttctgtaactattgctaatttaagtgccggtcaatacagtgctgctattcagtacagtggggataataaatacaacggtgcaaaaacagatgttttatttaatgttaataaacatgaatcaaaagttgatatttctgcagatgatatagaaattggtaaaactgctgttgtaaccattaatgttactcctggtgctacaggtaatgttactgtagttgtcaatggcaaatcacaggttgtagaacttaaagacagtaaagctactttaactattgaaaacttagctgctggagattataaagtagaagcaatctataatggtgatgccaagtatttagcttcaagcaataatgcttcattcaaagtttccaaaatatcaggatatgatattaaagttaatgctggtgaagtaaatgaaggtgaagatgctacaattatagtagttttacctaaagatgctaccggcaatgtaactttagttatgaacaacaaaccttactttgcaaaagtcagtgatggtatggctaaagtggttgttccgtctgtttctgcaggaactcatgatttcattgtaaattattctggtgatgataaatatgataaatcaactgtaaacggaactataaaggttaataaaaaagcagcaacattaattgttgaagatcttgtaaaatattacaaaggagatgaaaaacttacagctaaactggtagacggcagaggcaatccaatagctaatgctgatgttgcttttaatattaatggtaaagattacatcagaaaaaccaataatgaaggaatagcttctatgaatattaatttggtggctggaacctataatgtggcagttaaatataatgaaagctcagttaatgtaacagtaactgtaaaatctactattgtagctgatgatttagttaaaatgtatcaggaccctacaagattctatgctaagttcctggacagtacaggaaaagcattggctaatactcaagttagatttaacattaatggtgttttctacactaaaactactaataatgatggagttgctgatttgggtattatgttaagacctggaacatatattttgactgcatataatcctgcaaatggtgaagaaagaggaatcaccataactgtaaaatctttaatagttcaaagtgatttaactaaatactacttaaatgcttccagattccaggcaaccatttataataaggatggaagcttggcggtaaacaaagaagtaacctttaacatcaacggtgttttctatcataaaaccacggattcaaatggtgtagctagtttaggtattgctttaaggcctggagaatatattatcacaactattgttgatggacttgatattggaaacaaggtcactgtacttcctacattagtaactaaagatttggatatgaaataccttgatggaagtgactttactgcacaaaccttggacggtcagggtaagccattagctaaccaaaatgtatcatttaatgtgaatggtgtattttatcataaagtcactaatgaggacggtattgcaagtctaaaaatcagattgatgagtggtgaatacattataacttcctcatggaataatttccaaacaggaaacactataaaaattagtccttaagagaatttctcttattctcttaactttttctttttttattataatttttattggatatcaaaaatagctattttaatatttcaagtattttcaatcctaattttgttgttttataaagtctgccttttttagcattttcattgagacatattactagttttttacttttcaaatcatttaatgcactggatacttgtgttggacgtaaattggtttcttttgcaatttcagaaggcattttataatcattgccagacaatgactttattgttttgtaccgtgaagatgatacttttataaatccgataatttcccagatattttcttcattttcttttttattcatgttatatgtctttatgttgcattaatcacttttttatttataactttattctgtattattttatttttacttggtttttgttctatttattatgttttagtaacaattttatactacttgtcacaaaaatgttatttgtaagttaaacatggttttaatttacatttttatgatgatggcttggctattgttataaaacatcatttactatttaatttcaatgtaaaagtagtaaatttgggaaatatgggataaattaacttaagaattatacttgtctgtttaataaaagaataggtaaaattttgcacattttaggggtttgtgcaatttttttaagataatggctgtcatttatatgcagtctgaattttttaaatagatgtataattcttgttaattttaattatttcagctttttttatatttctaaagtcattcaaatctttaaacttaaaaatactggtttattttttaatattattttacttactaaaatttactaaaatagaaagctttttatatagcaatttgccaatatttaaatagtaaattaacttaaattatttattgttgaattatattgaactaaaaaattatgtagaggtaggtttcatgaaatttgaagaacaagaatcaatcgacgattcctcaaaagaaactgtattaaagcctgaaatagaagaaaatgaggcttttgaaaaaattgaaccaatgttagattatggtaatattaaaagttcaaaagatattgaagttcctccattattaattgatcaagttattggacacgaagagtccattgaaactattaaaaaagcagcaaaacaaaggagaaatattttacttatcggtgatcctggggttggaaaatcaatgcttgctaaaggtatggctcagattttacctcatgaatccttagaagatattttaatttatccgaatgtagaagataataatcatccattaataaggtctgttccagcaggagaaggtaaaaaaatagtaaaggcaaccaaagggtctgctaaaaaccatgaagagaaaaaaacattaattacaacatttgttattgcagctattgttgttattggatttatgtatggcagaatacttgaagctattattgcagcagcattaatattgcttatttctattcagataaaacctaaaaacaataacatgtctccaaaattactggttaataatgaagataaacgattcgcaccatttatggatgcaactggtgctcatgcaggagcattacttggagatgtccgtcacgacccttatcagtctggaggtcttggaactcctgcacatgaacgtgtggaatcaggaatgattcataaagctaacaaaggtgttttatacattgatgaaataggtacaatgactatgaaaacacaacaagagctcttatctgcaatgcaggaaaaaaaatatgctattactggtcaaagtgaaaacagcagtggtgcaatggtaaggtctcaggcagtaccgtgtgatttcgttcttgtagcatcaggtaaccttcaagttcttgaaggaatgcacatagctatgaggtcaagaatcaggggatacggttatgaagtttttatgaaggattcaatggaagacactccggaaaacagaaaaaaattagtaaggtttgtagctcaggaagttaaaaatgatggaagaattcctcattttgctcctgatgcattagatgaaattattttagaagcaaaacgtcgttcaggaaaacaagatgctttaactcttaaattaagggatttaggtggacttgtaagatcatctggtgatgtagctattgaaaaaggtgctgatttggtaactgctgaacatgtaattgaagctaaaaaattctccagaacattagaacagcaaatagctgacagatccatcaaacaaagaaaagaatacagtatggttcaccctgaaggtggaagagttggtcttgtaaatggacttgcagttattggagatagaagtggtattgtttcaccaattgctgctgaagctgctcctgctcaatcaaaagaaggtggaaaaatcatagctaccggtaaacttggtgaaatcgctaatgaatcagttcaaaatgtaagtgcattaattaaaaaatacactaacaaggatatttctgattatgatattcatgttcagtttattcaaacttacgacggtgtagaaggggacagtgcaagtgtttcaatagctactgcagtaatttctgctgttgaggatattcctattgatcagactgttgcattaaccggatctttaaatgttcgtggggatgtaatgcctattggtggtgctacagctaaaattgaagctgctgcagaatccggaattaaaaaagtattgattcctaagtctaacatgaaagatgttatgcttgagaaaaaatatgaagacatgattgagatagttccaactgaaactttaagtgatgtattggaaaatattttaattagcggcagtaaaaaagaccgtttaattgaaaaaatgagaaatttaagttccaaagttgcaagtaaagtttccaaatctcaaattgaaaaaccagctactaactaagttggtttttattattctttttttttattttaaattttttcaatcgcatttttataacgaaaacataatatattaataattttatattaatataatatattagaagttgaaatgtgattgatatgggtgttaaaattcgttttaatgtagctaagtttggagctaaggtagcttctcaggtatctaaatttggatttggaagtggtaataatcttccgggatatgttttttataagattgctggaaaggaagcactaaaagatttggctcatgaaatgagtattggacctattttaatcacaggaaccaacggaaaaactactacaacaactcttttaattaaattgctttctgctgatacgaaaatcagaaaaagctttgaaagcaatactattcatgcaataactacaggtattttaaaaggtgatggggatcttggtgtttttgaatatggaatcagaaataagagctatggaattccggacactgttcagagacttattgatcctgtaggtgttgtttatacaacaatttcacgtgaacattcacaggtagcaggtgttaaaaatccctttgaggaatatgtagatgccaaatctctactttcacagggtatgactcggggagttgttatttctaatgcagatgatcctgtaacagcaaatattgcttgcaataaacgaaatgacctgcatgttaatttttatggattggccattgatagtattaatgatattttcgaatcagacagtccaaattgtccaaggtgtggcaaaaagcttgaatattctcaaaaattcttgaatcacagaggaatttacagttgctgctgcggttttaaacgccatgaacctaatgttaaattgattggtgctgactttaagcctgataattgggatttgacaattgaaggaaatttatataattatacaaacaataaggatatttcatttgaagtaagtataaatgttcctccattcggattccataatatttacaacacattggcttccatttgcacatatgctacttttactccaaaaatagacaatattgaaaatactattaaagaggttttcaataatttggacatgtcttttattcctcctggaagatttgaagtagttaaattaaatgacaaatatgttggtttgggacagggagataatggtgatgcagctaaaatcaatgcattatttatgaatcagtatattgacggtcctttagaatttatttacacaactcctgatgaaaatgaggaagaaatatttgaagaccatctggaagttattaaaaatttaaatcctgaccatatgattgttgttcccggaagaaaatccattgaaaaagctaaggaatattataacataatatctgaagaatatgataatgctgatttttatccattaagctatgataaaatggatgaaaggattagaaaactggtggatttggctgaaacttcagattataattatgtgattatgacaggctgcggtgaagagcaggaaatgtgggaaaatataaaacaaaaattaatcaataaataatattgctttcaattatattatttattgttttatagaagttgtcttcgctttttttgatttgtctaaatgatgaatcgattttacatccgcataaatcacagctgccgataaggaagtcattgctgttttttttaatcaggattccgaagtactcttcttttaaatccccatatttttgaaattcttcactgctgagacttatagttttatcttcaatggaaaaaatatcgcattcattaaacataggtataaaagcgagcattccgaaagttataaagatattttcatgtttaaggacttttaagactttttcaacatagctgtcttcattttcaattccatatttttttaattcaccaatgttgttggaacccattgtgcaattatcacggattatacaaatagctagttgagggtctatataattatcacatttagctacaatattttcaatacttttttcaatattcattaataacaccttcgtaactttcacataatgaaagaatctcttcaatttttggaatttgattgagccaatctataggaattgaatcaaatccataataaattccagaaagcccaccacaaacagctgcaatagtatcagtatctccacctaaattaacagctttcaggacactgtatttataattgtcagtagtttccaaacaataaatgacactttccagagtgtctattacataacctgaacttttaatattctcttttaaatcatcattaaaaattctctcaaaatgtttaagctcttctgaatctttgtaatgttttctgattttatcgcaggctattttaacatgttctttaattgttaaattatctgaaatcattgatttggccagttcaacataaaatacgcaggctatttttgatcttaaatggccatgagttaagccggatatattttcaattgtttcatagtcaatgtcatggataaaggccagaggcaaaattctcattagagatccgtttccattatctctttcactgactcctccacattttaaagcttcaaaaccatttttaaaccttaataatgattcataagttgtgttgccgtaatcaaaagtttctccatactgagtgtatttgccattaagaagccattctaaaaactcgctttggatatcttcatagtcaatagtctttttattgcagatgctgctcatagtagccagggtcattgaagtatcatctgaataagttccgggtggcatattgtatgttccgtaacctgttatagttttaaccggatttttttggagtgtttcacgggaactgaactccgccggaacacctaaagcatcaccgacaacaaatccacaaatacctgctttgattttcatagatatagttatatctttaaagttgatataaatagcagtttcaaattcataaattataattatcacttcaaataattatttaacatggtgattctcaaaacacagaatttaattttaaggtcatggaaggtagatgatgctgaagagttgtatcatcatgctaaaaatccaaaaattggtccgattgcagggtggccaccacataaaaatgttgaaaatagtttggagataattcaaactgtttttgcaaaggatgaaacttatgccataactttaaatggtcaaattataggatgtgtgggtttgcttgtttatcctgacggaaatcattattggggagaaaataatgcagaacttggatattggattgcagaagaattttggggaaataattatgcatgtgaagcatctgagaaacttttaatacatggttttaaggatttaaagttaaataaaatatttgcttcatttagaaaaaataaccttcagtcaaaaagggttcttgaaaaattaaattttaaatactttgatgaactacaaaatattgattataccggaaaatgctatctggaaattgtaatgagtttagaaaataatgacactggatgataatatggaaacattggaagcaattaataaaagaaaaagcattcgtgcttataaggatgagcaaataacgaaagaggaattagacacaattataggagtagctaataaagccccaaatgcaggaccatttcaagttagtgtaattcaaaataaagagtttttaagtgaaataaatgataaaactaaagagttcatgttaaattctgaaggttttatgcgccagagagcttctattccaggttatgagccattatatggtgctccaactttaattgttatttctgcacctgagggtcctttttctcaaataaatgtttcagcatctgcaacaacaatgattttggcagctactgatttgggattggctacatgttatgttgtatctccaatagctattttaactcagcttaaagataaattaaaccttcctgaagatttcataccagtttcaggtattttagttggttatgaagctccctgtgatattccatctcctgaacgtgaaattccagataatataaattttattggttagataattatggttagaatttgtaaaaattgcggatttgagaatcaggacagctatgacttttgtgccaaatgcggaactccattagtggaagggctccagcccaacacattctttgtttatagaaatgtggaacagggaattagtaggaaatttataattatttcttatataattaccatatttttttcatttggaggttttcttatggatctggtagctagaaatacttcaatgggtttttttagcttctttggatttttcatgccgtttttcctaattcaggcacaggataataatattaaaaagcatggtttcatccaattgttcatatctcttgttggatttattctgtttgtaagaactttaccattgtaaaaaaagagtttttagtattgtttttaaaaaacaatacttttttttaaatttaaacaaaatgtattttcatatctccagttaataaacattctggaattgccaaataattcatgtggaaatcacccattgctttatcagctgcatctccacggtccattccgtcaccccagtcgtattggcgaatatcggatatgatgtctccgccaaatattttctcggctgcattattatttactgttatgataatatttggagatatattgtaagtgtattccattatttctttagctgctccgtaaggattgtcgggatcatctaaatgaatgttgtgtagtgtttgatgctgtgcgttaaatgaacttcccggataaatccagttaaatccaccggttaaattccatgtggcacccatgtcaacaccaggaatacctccttcactttcgtcttcagctattattaacacactagaagttgcagctattcccactataacaatgacagcaagtattataactgcaaaaataattcttccaattttcatgatttacaattgtttttagcattaatatagttaactttttttatgttaaaatcaaatattaattattatattaatttttggtgataatgtgattattggtggttcagcatctcaagatttggccgctcatgtggcagaagagttaaatgatgatttatgttatgtagaaactaaaaaattcccagatggcgaaagatatttgcgtgttgatggtgagattgatgatgaagttactgttattcaatctacaggatatcctcaggatgaaaatttgatggaattgctgtttttaatatcaaatcttaaagacctcggagcaaaaaaagttagggttgttgttccatatatgggttatgcaagacaggaaaaacgttttcatgatggggaagcagtttctgcaaaaattgtagctaatttaattcaatctgcaggtgctgatgaatttattacatttaatattcatgaaaaatgtgttttggacttttttgatattccaactacaaatatttctgctatgggtgcaatagccgaatatattgatgaaaaaattgatgaaaaacctttaattgttgctcctgataaaggagcatatccttttgctcaggaaatagctgaaattcttgattgtgaatgcacttatctgtctaaagttcgtcttggacctgataaggtggaaactagaattgttgatgttgaaggcagttctgatgaaacagttaatgtggattcagttaaaggtaaaaaggcatttattattgatgatattatagctaccggtggaactattgttaatgcagttaaaatattaaaggaatacggtgccaaatcagttgatgtttgttgtgttcatccgattttggtaaatggagctactatgagaatctatgcagctggtgctaacagtttaatatctaccaatagtttatctgcagacagttctcgtgtttctcttgcaaaaagcatagcgaatgttttgagggattaaagatgtttgataaagatgctattaaaaaagaacttattgaaggatctaatataattttaaaaagatatgatgaagaggatgttgttgattccatatctgttatgaatacaaaagatcatgttatttttttagggtctttaagagtttataatgaaatgaatgttaaaaatattgagaaagctttagaaaactgttttgaagactacggcaaagttagcataagaagtagaaaagttgttccctgctgttccctgccctatttccatatcagttttcacatcaatgttgatgaagtaatttagaaaagcatgaaaaaatttaaactaaactcaccttacaagccattaggtgatcagccaaaagccattaattcattagttgatgggataaataagggtgaaaaggaacagactcttttaggagttacaggttccggcaaaacttttacaatggctaatgttattgaaaaagttcaaaaacctacccttgtcatctcccataataaaacattagctgcacagctttatgaggaatttaaagagtttttcccagacaatgcagttgaatattttgtcagttattatgattattatcagcctgaggcatatgttccaagaactgacactttcattgataaggaatcatctgtcaacgaagaaattgacataatgagacattctgctacccaatcacttttatcccgtgatgacgtgattgtagtcagcagtgtcagctgtatttatggtataggttctccggaggattatggggaatttgcatttggaatagctgtaggggacaattatgaccgttcagatattattcgcaaacttgttttcatgcagtatgaaagaaatgatattgaatttgcaagaggtcattttagagtacgcggagatgtaattgaaataaatcctgttcacggcactcctcctgtaagagttgagctatttggtgatgaaatagatgcaatcagtttaattgataaagtcacaggcaaaaaaacagaaagtttaaaaagatacatgattttcccggcaaagcactttgttgtcgggcaggataaaatggatacagcaatcagaaacatttctgatgagctggatgaaagattaaatgagtttaatttatcaaataagcttctggaagctcaaagattggaacaaagaacacgttttgatattgaaatgcttcaggaaatgggatattgtccgggtgtagaaaattattcaatgcatctgtctggaagaaaatggggtgaaaaaccttattcattattaaaatacttccctgaagattatctgactattattgatgagtctcatgttacactgcctcaaattcgtggaatgtataatggagacagggcacgtaaagagactttagtagaacatggattcagattaccttctgctaaggaaaacaggccattgagatttgatgaatttgaatcatctataaaccaaatcatttatgtttcagctactccaggagcttatgaattgtcaagatcaagtaatattgttgagcagattatccgtccgacaggtttggttgatcctgaagtgattattcgtccggttaaaggtcaggttgaagatttgcttggcgaagttaaaaaaagagctaaaaaagatgaaagagttttagttacaactttaaccaagaaaatggctgaagatttaactgattattatgcaaaaataggtgttaaagtcagatatatgcactctgaaatagatactttagagagaattgacatcgtagatgatttaagacggggaacatttgatgtgctggtcggtgtaaatttacttagggaaggtcttgatttgccggaagtttctttagtagctattttagatgcagataaggaaggatttttaagaaatgaaacttctttaattcagactattggaagggctgcaagaaatatcaacggtcaggtaatcatgtatgttgatgaaatgactgattccgttaaaaatgcaacagctattacaagtaaaagaagaaaaatccaaatcaagtataatgaaaaacatggtattgttcctaaaactactaaaagggcacttaaggataaaaaagtagctgaggatttggatattgaaggaacggatattagtaaaatacctaaagatgaattacgtttacttatcagtgatttggaaaatgacatgaaagaagcagcagctaaacttgattttgaaagagcagccagtttaagagatcagatagctactttaaaaggattaaaaaaagattcttcatagaataatttaaaaatgggaactgtccattaattttaatttttgcattttatttaatggacagctagaacttatttttttagaaagttgtttttagtgtttttaatatttcgtcggaggtttttccttcgttttcaagagtttttattgtgtttttcatatttgttttttcttcttgttttcctttttgttttccttcttgtctaagttctatttctctgttgtgtagtttttcgtttatgctttgtcattttagggtactcattgttctcaccttttctaatgtttctgggttttttatgaatatttctgttgttagccaaagtccccatgttaatattttagtttgtttggttgttattttggtaattttgctaacataaccacagatttctttaactatttcttcagaatttttggttgtgtttaaaaatggtatgaaaattaaatctaatatgtcaaaagctgttagttttttgttattttctattttgattttaacattttttaatctttggtctcaaggatatttttttagaaaaattattcttattggtgtatatttatttacttttccaatccagcattctgtttctgatttgtttggattgcctgtagatattatgatagtatttatgggttttccagtttcttcatgtaattccatgtcgtaacgtccagtatgggtaagattaccatgagttaagttaccgctgtaatgttcataatggatatatgaatcatcaaccatttcatatacaaaatccattaataaacccttaaaattaggtgttattaattctgtagaatatacctttttaatttttgtacaaggcaatggttcatgtatttcatctgtttctttttctaatgcttctaaataatcaaagaggtcttgaccataatattttgctaatccttttattaatttatcctgtttttgataaatcattttttctctccttaattgtttagtattctataaatcgatttgataaaatacactaatactttctattggccactatataagttgttaagttgtaaataacttaaataaaatattttgagtaaatttaacacttttaaatcaatatttcaatagtttttataatggtggtgtggatacagttccaaaatattaagtggaaaaatgattagatatatttatatatgtagatgtctaatatttgtttgatacattacgaatgttttatttttcaaatgctcttagattaatatattatattggggcattggataattattattaaggagggtactatgacaaaagactctaaaaaacagattatcattaaaggagctaaagaacataatttgcaaaatatagatttagctattcctcgtgatgaatttattgtaataacaggattaagcgggtctggtaagtcttcacttgcttttgatacaatttatgctgaaggacagcgtagatatgttgaatctctctcagcttatgcaagacaatttttagggcaaatgaaaaagcctgaaatggaatatattgaaggtttgtctcctgctatttcaatagaccaaaaaaccacaaaagaaaacccaagatctacagtaggaactattactgaaatttatgattatcttagattattatttgcaagaatagggacaccccactgtccaaaatgtggaaaggaaatatctcaccaaacattgggccaaattggagacagtataatagaagaaggggaaggtaaaaaaatacatattttagctccggttgttagggataaaaaaggccagcacaaggatgttttggatgatttgagaaacaaaggatttgtaagggcaagagtggacggtgaagttagagaccttgaagaagatattgaccttccgaaaacttacagacacagcattgaagtagttgtagacagactaaaaataagaaaggatgttgactttaaaagaagactggttgattctctagaaacagcttcagagtttgcagacggactgataaatgtactattttcagatgatggcagagattatgagaaaaaatattcagaacactttgcctgtgtagactgtggaataaactttgaagaactcactccaaggatgttttcatttaatgcacctcagggagcatgtcctgaatgtaatggtattggagttaaaatggaaatcgatcctgatttaattattccaaataaaaatcttacattaaatgaaggggcagttactccttgggcaaaatcaaataaaaaagaaaattattatcatcagatgctggaagcagtatctaaacattttaacttcagcatggacactccgtttaatgaattaaccaatgaacagcaggatataatattatatggctgtgacgataaaataccattttcatttaaacgtagaaataaatcttatcaagttaatcgtcagtttgaaggtgttattccgagaatggaacgtttatacattgaaaccaaatcaaattacagcaggaaatacatttccaaattcatgagtgacagaaaatgtcatgtatgtcatggaaaaagacttcgtcctgaggtactggctgtaactgttggtggaaaatcaatagctgacgtagtggaaatgtcaattaaggattcatatcagttcttcttgaatttggaacttactgacagagaacagttcatagctaaagaggttttaaaagaaatcagacaaagacttaaattccttgtcgatgttgggcttgactatttatcaatggcacgttcatcaggtacactgtctggtggtgaagctcaaagaatcagattagctactcaaataggctccggattagttggtgttctatatattttagatgaaccaagtattggtcttcatcaaagagataatgtaaaacttattgaaacactaaagagacttaaaaacttgggaaatactttaattgttgtagaacacgatgaagaaacaatattgtctgcagattatgttgtagatataggtcctggagcaggagaacacggtggaaaagtagttgcctgcggaactcctgaagagattatggagtcacatgaatctgttaccggtcagtatatttcaagacgtgaaacaataccaattccacaaacacgcagatcaggaaatgatgaatcacttataattaggggagccagacaaaacaatcttaaaaatattgatgttgaaatacctttaggcaagttcacatgtgttacaggagtaagcgggtctggtaaaagcagtctgattaatgaaattttatacaaagggttaagcggaaaattaaacaataaatttacctttgcaggagattatgataaaattgaaggtgtaagcaacattgataaaatcatagctattgaccaaaaaccgataggacgtactccaagatcaaatcctgcaacttatactggagttttcacggatattcgtgatttatttgcagaaactccagaagctaaagctaggggatataaacctggcagatttagttttaatgtaaagggaggaagatgtgaagcatgttcaggtgacggtattgtgcaaattgaaatgcactttttagctgatgtatttgttccatgtgaagtgtgtggcggcaaaagatacaatgaagagactttagacattcgttacaaaggtaaaaatatttatgaagttttggaaatgactgttgaagaagcattggacttttttgaacatattccgaaaatacataaaaaacttaaaaccttgcttgatgtaggtttgggctatatgaaaataggtcagccggctactactttatcaggtggtgaagctcaaaggattaaattagctaaagagctttcaaggtcaaatacaggtaacacattatatattttggatgaacctacaactggtcttcattttgcagatattaagagattgttgtcagttcttgccagattgactgatgcgggcaattcagttgttgttattgaacataatttggatgttattaaaacagctgattatattattgatttgggtcctgaaggtggagatggtggtggaaaagtaatagctaccggaactccagaagaaatagccaaatctggaacatacactggtgaatttttacaaaaaatccttagtgaaaatatcacaccttatgccaaacagcttgttaaagagaaaatgagcaagtaaattttctctttttcaacaaagtatttaataaagttatgacatattaactttaagttcacttttttagaagtaactaatatttaaggtgaaatattttgaaatttgtagattttttctcaatttttattcgcggaatacttatgggttctgcagatattgttcctggagtttctggaggaacaattgcattaatcacaggtatttacgaacgtttggtacattcaataagtacaattaattttactttcataaaaccattacttaaaggagatttaaagggttttaaagaaagactattctatgaaattgactttaaatttttcataccgttattatgtggtattggacttgcaatgttaacattagctaatgttatttcatattgtatggatgtatacactgctttaacctattcattctttttaggattaattattgcttcgtcatatgtgttatacaggcaaatggatgaacttactctcaaacatgtaatttttactgttattggggctgttttagcatatatttttgtaagtttaaatccgatagctatgaatcatactttgccgatactgtttatttcaggtttgatagctatctgtgcaatgattttgccgggtatttcaggatcatttttacttttattgttaggtcagtatgagtatatgttaaatgctttaaagactatgagtttaagtgaaattgttgtattttgtgcaggtgcctttattggtattttaggattttccaaagtcttaaattatttgcttgaacatcatgaaggcattacaatggcatttcttattggtgtgatgattggtacattaaaacttcctgttgtacatattgtaaatacaactccgcttacatttgctgcattattgccttgtattatcctggctattattggatttgttataattgttgttatggaaactaaattcgattatatcgaatgatttttcctctttttttttaaaatattataaaccttaacgatataatattatataatgataattcttaaaaaaataaaaaaacagtggaaattatatccaataggttctccaaaaggagcattgaataataaaagagaacctgagtatgttggaactgttaaatttaaaaaatatgatgattcaatagctatttccagatttgtagcggattacaattactcggattcatctaatttatcagaaaaattagttccgcctcaggaagtaattaaacttttaaggagtcaggctgtttttttagcaactagggatgatgaagttgaggattatcttaaatcactgaatattaaggtaaggcacaccagagtttgtgatttttgtgcatttgaaggaaatattacaattgtaaactctgaattttcatataaacacaataatcagttgatatgtgagcagtgtgcatatgaaacaattaaaagggaaattaaacttcagggatttgataaaaaaatattcagaaaccttaaagacattttagataaaacaggtaatttggaaaaaacattgtctgttctctcacctaaatttgatccactttctaacagaaatttaacattatttgacagagtagatacaaaatccaagtataaaatacctgatgtatcaatgaaaagacttaaaatacctcataagttcagggatattttaattaaaaatggaaataaaaaattattgcctgtccaatatttggcaattaaggaaggccttttaaaaaatcaggatttgcttgttgtaagtgcaacaggaagtggaaaaactttggttggagagcttgcaggagtaaccaaagcaatgaaaggtcaaaaatttatattcctgacacctctggtagcactggctaatcagaaataccgtgattttaaaagaaaatataaaaagttaggcttaaaggtagctattaaagtaggtagaaatagggttaaagctaaaggtgaattgaaactgcctgacagtgatgttaaagatgcagatataattgttggaacctatgaaggcttggattatcttttaagaaacgggaactcagctttattgtctaatttaggagtggttttaattgatgaaatccacatgattgatgatgaagacagaggaacaagacttaatggattaataaaacgtatcaagcatttatatcctcattcacagattattggtctttcagctactgttaaaaatcctgaatttttagccggtgagtttaatatgaaattggtggaatattctcaaaggccggttccattggaacgtcatttggtttatatcagatcagaatcttcaaaacaccatataatgcaaaaattagctaaaaaggaatttaatacaaagtctaaaaaaggttacagaggacagactataattttcaccaattcaagacgaaaaactcataagatagctaatttcctccaaaataaaaaggtcaatgccgcagcatatcatgcaggtctgtcctattataaaaaagaaaaaatagaaaaggactttgacaggggaaaaatatctgttgttgtaactacagctgcacttgctgcaggtgttgattttccagcgtcacaggtaatatttgactcattggtaatgggaaataagtggatcagtccaaatgaattttcacaaatgcttggacgtgcaggaagaccaagctatcatgacaggggaatagtatatttgctgcctgaagtaggccatgactttgacggcgaaagtgaagaggcaaaggcactggatttacttgaaagtgacagcgaagatgtatttatagaatatgatgaagaaagctcatatgaacagatattggcagatatttcttcaagatcaataaaaacaacagatgagttaaataaattctataaaaatataaatattccggtagacattagaacagctattaatgaaatggaagatttgggattaatagatattgtaggaaataaattaaacataacaaaatatggccgtgcagtatcagtatcctttttatctctggaggatgcggattatattaaaaaatcaattgatgataggggatatctaaaggtctatttaagaaagtctccgtactataagaaaaaagacaaattcaacaaattaagggtaaaaatattggctattggactgcagctggaaatgtttgaaaatgcatatctgtcttcagttgtacataatcagatagcaaacgctttaaaaattaaattttcaacaagactgtttgcagaatcaacactggatattatttcatcaggtgaagcaataagtaaactggacaaaaaatttcaggatgctttaattaatattcaatcagatttcttaaaatgcaaatgtgaagacagaccgttttgtgactgtctgcaaaagggaatatctgaagtaataataaatgaaaggcttaaaggtaaagatccgatagatatttcaaataaactgttcaggaaatatcagatacaggtctatcctggagacatattttcatggttagacagttatgttaaaaatttagatgcgataaaaagaatagctaaagcatttaaccgtaaaaaagttgaaagagaggcacataaattaatcaaagctattgagaacggatgaaacttttaaattagccaattttgagtttttaaaataaattaaatgggagtggcatttgcagtcactgcagccgaaatcagctattgattcctcattttcaattatttttttagctatttcacattccagtttttcatcagactcttttgtataaaccttttcaatttcgctgtttttatttaataaaaggtaatcaatatgccagtgctttttcttattgtctgacaggtgtcttttaactctggattcaaggcagttcatagctgaaccgacataaacataacatccttttttaaagttgataaatcctaattttttgccgattttaatttcagtatcttttttaatgttgattattagacagtagcttcctttcatgtttttctacaccttgtaataatagtttattatatattttttttattttcttaatgcttttttaaatatatttcaattaactttatttattaataaaaacataattgacttcataataaagttattttattattatataaaattatgaggtgttttatgaggaaaaaattcttaacagtattttttattttattgtttttactatgtttgtctgtagtttctgcaactgatgaaaatactaattccagcatagttgctcaggattatgatggaaatgaattttatgttgatttaggaggagatgatagtaactccggtcaacttaatagcccatttaattcaataaataaagcagtagaagtatctaatcctcgtgataatgttgttattcatttaggggaaggtacatttgaaggaaatggaaatgtgatgatatcaatcaataaagctcatttaagccaaggtggttcaataactattgttggtgcaggagctgataaaactataattaaaggaagtagtgcatattatgcatttaatatatatgctgattctgtagttactttaagagatttatctattgttgattgtaaaagtgttgaaggtggtgcaatatgcaattccggtacattattagttgataactgtattttcaggaataattttgcattcaatactgggggagctatatcttctatagaaaatggggattgtaaaatttataactcagtatttattaataattcagttacctgtaatgatgaatatgggaatgctaatggtggagctgtttattcattaaaaagtgatttattagttgattcctgcagatttgtaggtaattttgcaaaaggtaactgtttaaatgcaatttctggaggagctatttatgtaggtacttatttaaataatgttccttctgtgaaaaacagtaattttattaataattatgttgtttcaacaaacttcagaacaaactgggaatatgccaaaggcggatctatttatatgataaactgtaacttatttaatgattcttttattaattctagtgttacaggaaataatggagtaggtggatcttattattctgaacctaaatacttaaatagtatttccaatattttgagaattaactcaagtgttaatggtgttttggaaagcaatatttatcctgctgattatgatggaaagtactctaatgaagttgtagtgtatgtttctgttaatggtaatgatgaaaatggtaacgggtcttttaataatccttatgctacaatagctaatgcaattgctaaatcagcgggtaatgtatataacttgaaagtgtacttgttagatggaatttatagtggagcaggcaatactaatatcagtttgccaagtagtatgaatattcaaattgcagctattggttctaaagtcataattgatggaagtggttctaattggtttgcagctaatgaaagatcaatttccggatttaaatatgttttatctaatttaaatttaattaattttaaagctaaaagcacaggatataaaaaagaaaataatattggggttatttctaattatgcagatttaactattgataattgtatttttaaaaatattgcaggttcttcaatatccaattatgatttggctaatttaaaggttattaattcatcatttgtagattcaaaacacttgggattctatggtggtgttttatttaattatgatgctaatgcaagattttataattgtattgtaaataattattcttcaacagatattttttattctacagcagttaatacagaaaatgtttatttggagttttttaattcaacatttaaaaatttaaaaagctttgattccagatgtaagtttttaggagcaagtaatacaaatgttactatgagttatgttaattatgcagataatgattgcaattttgcagttgcttatgataaatcctttgtgaaaatagataattctgtatttaaaaatagtaactggttaagcgggtctgttaatggaatgatatggaatgtttataattcctcttttataaatataaactctttaactttcagttcaattaatgattataaaagtaattttaacggatgtctatttgatggaggaaatgtggaatttagaggaaataccataactgttggaaattcaagtttttataataataaagtaatcattgttaataatgataatcaaaagggaaatttagattttaattataattattggattgatgaaactcctaaaaatatgattgatacaactgcaaatgttaaattaaattattggattgttaaacatttatctgcagaaaacttatttaatgatagctataaagtagttatttcttataaattatttgatggaagtgattataaagattatgatgttagatatgttccaataaaaccggttagatttactttaataacttccaaaggaagtaattctttagattccggtacattgattaatgatatctttgaatttattaatacggctaatgatgatagaaatgtagtagttagctttacagataatactaaattaaatataactctttataatcaacataaagtagatactaatatagatttatctcaaaaaacagctaaaatatgggacatagttgaaattaatgtaaatattaaggataataaaacaggattggcagttgatttcggtattgttgaaatttatttaaataataaattaataagttcaaataatgttactggattaactatcagtaaatctatcacagttgatgaaagtaaatcattttataatatttcagttatttataaaggaaataataaatatgcaaattcttcaaattcagctatattaagaatatcttcaattcctcttgaaacagttattatttctaaagatttaactaaatattataaaaacggatcccagtttgatgttgtccttaaagatgttttaggtaatgttctagttggtaaaatagttaaaatcacaattaatggtgttacttataataaaataactaatgataaaggagaagccagattgtctataaaccttttcccaggtgtttataatataactgttttatttgaagatgatgataattatgttaaatcattaaataccaataaaatagttgttttatccaagataattacaaaatttgtagataataataaatttattgttaaattggtaaatgatgatggaactccaaaaacaaatgcttcattagctattattgcaaatggtgttcaatataatcgtattactaatggtagtggtgaagctagacttaatgttagattaaatccgaataattatatttttgctgtaactgatggtcaggaagttgtttcaagttctgttaatgttttatcaacaattgaaactagtgatatttcaatgttttataaagatggaacaaaatattctgttaaattatgtgatcttgatggaaatataatgcctaataaaaatgttgcaattactattaatggtgttacttataataaggtaactgactctaatggtgttgcttatttaaatattaatcttaatcctggtgtttatggtatttcagcaagttatgatggaaaaactgtttataataccatttcaattgcagctatgcctgttactatagtttcatctagtgttaatattcaacaaggtacattttataaagttaaattttctgatgctttgtcaaatccaatcatcggacaaaaagtgggaatgcttgttaatggagtaatgtattatcgtgaaactgatgatttaggtgttgcatctattaagattaatcttaatccgggtcattatatgataacttctggtttattatctaatgcatatgaagctaaaactatgaataatattataacagttagtggaggttacttatgaggtttaataaatgtatattattagtaatatatgcaattatagctattatagtattcacaccattatatgctgaaaatagtaataatactatatttacgttaccaagtgatgatgttattgtatgtgataatgtttatactggtaatgtaattactattactgatgataattatggtgattattttgatgtttattcaggtgagatgaatcccgagtctaatatcaatgatggagatagaatacatattggtaatgttacagataaaacatttgttatcaataaacaactagaaatcactactatgcataatggtgatattattaaaaatggttatattaaattagttaaaggtagtgatggttctagtattcatgggttaactattattaatgataaagtaaattatgttgtagatggtatacctagtattgatttaagtggtattggtttattttatacaaataataattatgtatataataattctgttcaattagcagatagtaggggagtatttgcacttcctatgggttcatcatctaataataagatatataaaaataaatttgtaagtacattaagtacttgtgtgcctatgagtgaatgtgataataatctattttatgataattatttccaatcaactgcagctaatgtaatttattataatccgtggggtcatgcaggttatagtggttctggtaagtgttttaataattcatttatcaataattacatgtgttctttaaataggaactctccttgggttattggaatgtctcttttaagtaattgtaatgtaaatattgtaaacaacactatttttaatgttcgtgacggtgttagtggtttaggtgttaattctacaataaatggaaataaatttattggtgtgtctaatttagctttatccgtaagtagtgctaatttaactattgagaataattcattttcagatacatctatggctatagctattttaagtagcaatataactgttaaaaataatataatcgaaaattcttcaattggaatttgggtatttggaaaaaatgcatctttaatatctaatactattagtttagttgatggatattatgcagttaatgttgaaagtgaaaatgttttaattttaaataataatattaaagtgagtaattttggtgaaggaattagagttgctgaaaataatgtatctataataaataatactataagaactgctgttgactctggaatttatatattgtcttctaataatgttattagtggaaataggatatcttctaatttatatggagtttatattgatgcagtatctgatttatattattatactcgtggtgtactaggtgtttcttattatgctaaaattgatcaaggtaaaataaatcataataatattacaaacaatataatcaattcagcttcttacggagtttatctggtagggactgtgtataatacaactattataaataataatattactacaaatgcagctgtaggtattgttgagaatattactgatccattttcaaataatattaaagacaatgttgttaatggtgttcttttaaattatagtggtatagttatcagtgatgataattttaatgtctattttgatgaaaaaggatgttttaaatttgaagatattaattctattgttttggtaattacaaaactttctaataaggacatgttgattaatcaaaaaatgactttattaaatggaggtttagttaatatattaaccaatgttactatttctttagtaactggatcaaatggaacattaattaaatcattgaattttaaaaacacagataaaaatgcgattatcataaataatgtaagtgatataactttagaagacaataatataatgtctgtttctcaaatgaaagatatttttggaatttctttaaatttatcaaataatactgaacttattgataatgatgtatatattactggtgaaaatacattaattcaaggtattttacttaataattctgataatcttacatttgtaaaaaatagtgtgattttagaagctaataaaatagctcagggaattattataaatttattaaattcatctaatttagttaataatacaatccatcttcaaggaaatggtgtttttgattgtgttttaattaatgggtctaataatttgaatattttaggcaataatattatagctaggtctatttctaatgttatttcaccattagcaatttctagttctaaagatattgttttggataaaaataatattagtgcaattggtgatttagtaaaatcattaaatttctcaaatacatctaatgttgttatagaatctagttttattaacttaataggattaagtaaaacagaggtgatttttgcaaatgatgatttaaataatattgaaataactaattgtgtaatttattccaatgctttaggtttgatcagtggaaatatcacattaaaagaaaataaatatgtaatctatgatgataatgttgaaacttactttgattcaaatggtatgtttagtaataagttaataactcaaaaagatgtgttgatgtttgataatttaaaatcaaaacattatactttgacttttaatcaggtggttattttaacttcttattataagaattcattaattgatgcaactttaaatttcaattcaaaatcaagtaattcaactattaaaaatttaaactttgatttagttgaaaatgttgcatttaatttatattttgcattaaatattactattgaaaataataatattaatttagtgtcttctaaagatgtttcagctatcattattactggagaaagttttaataatttaattaacaacaatactgttaaaataaggggtaatggtaccctaactggaattactatttataattattatgatgaatattatggtttaagtccaaaaaataatgtaatttcaaataatgatattgtaatcaattcaaataatgatgtaattgctatttataatgcaatggctgataatacaattattagaaacaataatattagaatagatgcacgtgatcatgcttatggtgtttataatatttattcacaagatttcaaagtattcatgagtactatttggactacaaacacaaaaattatccacaatattattgaaggaaatggatctattgtttgtttaattaattcaattgaagctaaaaacacattagttgataataatacattaatagctatagctaatggttcttatggttatgtaggatataaaacatcaggggatgtattaagatataatgattttacaataaatggaactggaaataatgatttatttatatctaatgtaagtcaaactggtatttatttatcaaatagttcttctaatgcattgattttggaaaatagtattatttctaattatgctcctggaaatgattatgcaatttatgtagaggttaattctagcaaaatttctattgttgataattatttaattagtgataattggaacagatacgctgataatgcaatatatgctccatcagctactttaactaataatgaactttattatgtttatgtatcacctgaaggtagtgatgaattaggtaatgggtctattaataatccatttaaaacaataaaacatgcactaaataaggtaattaataaaggaatagtttatgtactgggaggtaattatactgaagattatattacaatttcaaaaacacttactcttaaaggattaggtaaggttatagttgattgtaaaggtagtttatttaatattactaaatccggttcattaaaagtttttaatattaaatttatgaatgcaaatgcaactacaggttcaacattttacaatttaggaaaactatacttagaaaatgtttcagtaatcaattccacagctttaacttatggtggagctattgttaattatggtgagttaattataagaaactctacattttcatcaaataaagctaaaaatggtggagctatcactaattataataaattagatattaaatcatcaaattttactaataatagttgttatattaaaggctctggaggggctatttataatttagaaaaagctactcttagtattgaagattgtaattttgtaaataataaagttgatgctgaatatcttattgaagaagatgattttggtgttcgtttaggatctggaggagctatttacaatcgtggaaatttatatattattaattcaaatttcaaatctaatagagcatttaattatggtggagctattttaagtgcatctactcaaaaacacgatcttaaagtaatcaattcaacatttgataaaaatacctgttttgcaggtggtggaggagctatgtatattgttaatgcaaatttagacattgctaattcatcatttacatcaaatgaaattggagaaaatagtggtggagctttatgcataagtgaatctgaaggtaaaatttataattccacattctttaaaaactctgcaagttttggtggtggtgcaatacaattttggtcttctgatataactatggatttatgtaatattactgataataatgctggaaaaggtggtgctatatcttattatggtcaacgtattggaaatcatgttgtaggttctctaaatatttataattcaacaatttataataataaaggatttgatagtggtggagcattttatgttagaaatttaaacatgaatgttaaaaattctaatatttatgataactttggaggagatggtaaacatactctttcagttgaaataaattatcctacaaaaccagttaacaatattgatttaaatggtaattggtggggtagtaatagtggccctggagaagatgtttggttaaatgcacaatattacagggaatggattaaagataaaatttcatgggatgtacttaatccgaatcctaatcctaatcctaataaacctggaagcaatacaagacctggtcaatcaaataataatccaattgtaggtccaagtactggaggattattaaacccagggagacctggacaaaatggatttggaacgggtattggaacaggaactggaagtggttttggttctggatctggtaatggtatgggttctggaagtggaactaatgctggtggaagttccggaagtcatggtggaagatttggttctggtagtggatttaatggaacagcctattctaaccaaggcacattaggtgatttaggttcatcttcaagttctggagctggtgggagtgaagcaggatctccatcttcagcttcatcaaataatgcaatttatgaacttaataaagatgttaaaaaagcattgtctggatataatataatttatggaattatatttttaatagtcattatattattaattatatttggatataaacgtaattctaaagaggaggatgaataaatgagcaattttaaaccaattttaattttgtctttatttgtattatttatggtttcattaggagctatatctgctgaagatgtaaatgttacagttataagtgattctcaagtagataattcagtatatgttgattcaaatatagttgctaatggaaatgggactattgataatcctataagtaatattaaaaatgctgttgatttagcaaataatgattctacaatttatcttaaaggtggaaattattctggtgtagaaaataatgggataatcattaataaaacattaactattacttcttgtgatggactggctattattaatggtgattataaagattatatattttacattggagataaaggttgtttaactttaaaaaacattagctttgctaatacaaattatttaaatgttaaaacatatggagctattataaattatggtaatcttactgtggaaaatagtttctttgataatgcaactggtttaagagcaggtattatattaaattatggaaatttaactgttactaattctgaatttaagaataatactgcaaaatattatggtggagctataaccaactttggttttgcaaatattgttaattcattatttgaatccaacactgctgctgaaggtgaggctattttaaacagttatgacatgtttatttcaaattcaagatttgttaataataatatttcatcaagtaaatatcaggatgctgaaagtttaatagatatttcatcttcatactttatggaaaattcaggtatctttgttaaagatagtggtatacatattaaagaatcttatttgactttaattaatacaacaaactctattgttgatattagctattcatttatcaatacttatgattttattaactcaaaaatcaatgttgatgataatttatggtgttctaatgaaaacattcctaaacaagctaatagatggttaataatgacttttactgataaaaatactggaagttccataattccatctaaaaccgttactgatgttttagttagttttaaaacatgtaatggaaaatctacatatagtttgccttctagtgttaatttacctcatgtttatattcaacttgaagcagataatggtaaatttaaagaaaatggtggatttttagtaaataatgtattttcaactacttattatggtaattctaaagacacattattatttgcaatgattgatgattattttgctactttaacagtgggatctggtgttaataatgggaaaatatatgtttcaaattcaggttctgatgaaaaaggagatggatctattaataatccatataagtcattagttaaagcagttaatgtagctttaaatggtgacactattttgattgcaaaaggaagttattatggttggaataattctggacttttaattaataaaactttaacattttccagttataatggtgaggttatattatacagagataattttcatacaatgtttacagttacactaagaggaaatttaaatttaatgaaattgaccttaacagctgaagacaaatcaaaattcttcccacttgtaaataactctggaaaaacaattatagataattgtattattaaaaatattgatgggggagataaatataaatataaatcatatcaagcattatcttatcagtattattctaatcaaagtgtaatttacactagtaatgatttatttattaataattcattattcacggatttagaagatattgttattagatcatacttttatactggagataattattttaaacattttgacgtgaatattgaaaattcagtatttactaattgtaaaggttatgcttgggaaactgtatgggatagccaaacatatgctgataaattggatgttgtatctccatcatttataattaatgtaggtgcagaaaatgttttaattaataattgtacttttaaaaacaatttagcatctgttatgcgtgttaatgcctctaaatcatttttagtaaatgcttctaaatttataaataatagaggttctatttattctttaacaaatggtgtgatgaataatacattgataagtgaagataatggtccagttttaagatttgtaactggccatactctttcaataattagaaatatgcaaaatgttattaattcaaatttcactaaaaataatgatgttattataaatacatggtattcttattcagataatgtctatttgtataattgttctttttggaataatagtaataaccatgctcaaggttatggaaatactagtggaaaaggattaatattaaatggtggaaatatgactgtagattactgtacttttgaaaacaattcagtattctatggtggagtgttttataatgatggaacagctatgggtgcaggtggaatttattattctacattaaacattactcgttcagtattttataaaaataatgctgttttaggtaaagatatatttcatagaggtggtaatttagttgtttctgattgttggtggggatctaacagaggaccaaatgatgcgaatatttataatgctgcaggtagtgttgaagttaaaaattgggttatattgacatttgatattcaggataatacattaattgctagtttaaataaagtaacggacaataaaagtaatatttataatataagtggaaatttaccttctagaatagctatctttaactcttcaatggttaaaataaatccaaatgttattccattaatcaataatcaagctaaagtaaatatttcatttaatggtgaagatatttcagctacagttagtatagataatcaaacaatcagtttaatattttataataaaaacactataattgatttaaaagatattattgtttatggtaaaggaactgcatattcatttgttttaaaaagtgtaaatggttatgttatatctaataaaacagttaatttattaattttaaacggaactgatgtttatcaaaatcatacattaataactaatagttttggtgtagctagtttaattcttaattgtagtatgggtaattatacttttaaagctagttataagggtgatgattactttaaacctgttcagaatagtgctaatttggttgtaatgccttattatacttctgtatttgttaaaagtaatcaaacattttatggtaatggtaatttcttatatatgtatctttatgataatttaggtgatgctgttgttaatcaaatagttttatttactataactagttcaaatggtattgtttataagaagtatgctcttactaattgggaaggtcaagcaggattctaccttaatttatctggtggaaattataatgttaatgtaagttattctggtgataattggcattatgggtcttcaagtactggtttatttaatatattatctattggaactaatgtaatcattgaacagtctttatttaatggtaggggtaatactttaacagtattacttagagataataactatagggttttatttaatgaaactttatctattactttatctgatggtaaaattgcacaaacatttgatgttactactaatgaaaatggacgtgcagggattattgttaatttacttccgggtaaatacaatgtttatgtgaaatatggtggagataagttaaactttgcatcttctagtgaaggtgatttaattattaatcctgttggcactcaaatttctgcagattccgttgttatttttaatagaacggttaataattatcttgttaaattaactgatatttatggacgtttgcttgttaatgagactgttgttattacatcaattagtcaaagtactggggttaaacagatatttaaagttaaaacaaatgatgaaggaatagctaatttaacatgtaagttagatattggttattatttattgaaagttaactttgaggataatgaatggtatggtggcagtaattatgcaagtactttaattgtagctgatactgttagtgattttaatccatatgctactattttagttgctaatgactttaataagtattataagaatgctactcaatatgttgttcgtttgcaggatatttatggtaatcctatttcagatatggatgttgttatttgtgttaatggtgtaaattataatagaataaccaacagttctggtgaggctaaattaaatattaatttgtatcctggaatgtattatgtaagtacaagttttggaggttgtggaaattggactaaatcatttgttaatagttcagttacagttttgtctcaaattatttcacatgatttaactaaaattttaagaaatggaagtcaatttattgttaaatttgttgataatgctggaaatcctattggaggcaaaacaatagatatttctattaatggaattgtttattcccgtattactaatagttctggtgaggctaaattaaatattaatcttaatcctggtaaatatgaggttataacttcttgtggtgattttgttaatcataatatggttaatgttttatctaacatagaaagtgatgatctttcaatgtactataaagatgggtctaaatttaaagtagttatctatgatagtgaaggtaaagttaaacctaatgcaactgttaaatttaccattaatggtgtttcttatgttaaaactactgataatgatggtatagcggctttaagcattaatttaaattctaatatttatacaataacgactgaatataatggtgttgttaatactaatcaaatttggatttataatatggcagttaatataggtgctgttaatgaaacagttgaaaggggcaattctttttgtgtaaaattaagtgatgttaatggaaatgtattgtctggtggacaagtgacatttaaagttaacggagtttcatatattaaacaggttaatgaaacaggttatgcaaaattaaatattaatcttaaccctggagtatataaaattatcacagcattttctattagaaactatgaagataaactagtttataataccttaaatgtgacaagtcattaatttattcatttaatgaataaatttcttattttttttatgtaggatactttttaaattttaattttttgatttattttttcttattttttattatagttactaaccaaacttttattatagatgggtgatagattataaaatatgtcaggaaaatctaaaattaatgtttttaacaaaatgacaaaaactgctttggatgaagaaataagtacttatgtggcatatcatagatactatcagcggttaattgcagttaaaatagttagtgaaggaaatacaattgcagatgcggcaaatatattgggaaaatcatatcaaacagttcatagatggataaaaacttgtgaatctgaaggattagaaggtttaaaaccatcatttggtggtggaaggccatcaaaattaacttatgatcaattgattgaattagataaaatcattgaaaaaacaccaaatatgtcaatgaaagatgtacatcttcttgttaatgaaaaattcaatgcagattatagtttaaagcaaataggaaaaattgtgagaaaattaggatacaattacagcaaagcatatcctaaattttcaaaatcacctgaagatgcagaagaacaattaaaaaaaacttagaagaacataatatatcatctaacgatattatagtcttgtttgatgaagcatcctttcaaaatgaaccatatactcaaaaatcattatataaaagaggaacaaaacacactcaaactgtaaatcctttacaaattcaaaatcaatgccacaggatcattatcaataaatggaaaatcaaccaccacaatcacaaattcttcaacagcaccagaaatagcaatagcactcctaaaattaagatgtattaatacaaaaaataaaaatgtcgtaaaattattaaataaaataattgaagaagttaaattaactgatgaagaaatagatgaaattttaatggaaaacaatgaaaataacaaagttttcacagaaaaaataataaaaacaattgaaaaatataaagacgatacaacctcaacaattgctagaatcattggaaaacactgcaatcgagaatcattcaataatgtaaaaagaagagaaataagaagaaaaataaccttaaatttattagaaaaagaagacatgataacaaaaatgcaaaccgaacaaaggatatgtttaatcttagataatttcagcgttcataagtctgcattcatcaaaaaaatagcactacatctcaatattacattaatataccttccaccatactctccacatctaaatccaatagatcaaatatggagacaaatgaaacgagaaattaaacatcattacctagaatcaagagaatttttacaagaattaacaataaaaacctacaaagaatcgatttatgaaacaaaagtttggtaactaactataaatcttaataatttctgccaacattcaatttataaagtttcctttacttagtataacttttatattattaaaaagtaatataataattgtcaattttatttggcgaaattaatgttaaggaggaataaaaacttgaaaaataaatttgcaatattaattttgttaatattgtttatggtatctatttcttgtgttagtgcagaagataatgattcttctaatattctaactgatggtgcttctgatatttatgttagcccatctggaaatgatgctaatgttggagatatgaataatcctgttgctacaattaataaagcaattaattcaactgcaactaatattcatttatccgaaggaaaattcactggtactggtaataatggtttaacaattgaaaataaaaccataactattgtgggtgctggtattgataaaactataattgatttaaacggaactcaatttatggatattaaatctactagttctgtagttttaactaatttaactataataaacggttattcaaattatggtggagctatttataatgacggtaatttaactattcaaaattgtaactttaaaaataactcagctagttctggtggggcgatttacaacaatggcaatttagacatatattattctacttttgaagataattttgttaaatatagtggtggtgctatttgttcttataagtatgcaactattcaagattctacttttttaagaaatataggtactgccacatcttcaaatggaggttctgtttatattagtggtaataatgataaatattccattttgaatagaaataaatttaaagatactcaggctttaagaaatggtggtgcactttatgtaaattatgcaaatgttactaattgtatttttgaaaatgcatcaattacttctacaggttcaagtaatggtggtggagctatttatggttctaactttaatcttaaaaacaacactatgactaattgtgtatctaaaagtggatatggaaattacatttggtcaacttctagctttaatggggtagttacagttcttgatggtaaaaatgtagatataactagttctacttttactcttaatgcaactgcaactgatgatatgggtcatccaattcatggtggatattatacctttaaatttaatgatgtttttgttggcggtgcaaactctgttaatggatttataaatggcacattttctaaattatttgataatggtaaatatactgttacagtttcaggtcctttaaatgataatgcagttgttaaaacagctactgtaaatgttaaaattgaccgtgactatgtggattattatgtatcacctaatggtgatgataataatactggttcaaaagataatccatttaaaaccattaataaagcaataactgaagcttttgctaaaaatatctatgtaaacatacatcttttagaaggaacttatgtaggtgctggaaatcttaatttaacatttaataacttaggttaccttaacataattggtgtagacggtaaaacaatcattaacggttctaataaagattgggcatttaattttggaagtacattaaatgttaatattataaatattacatttgctaatttatatcaaaataattatgtaggtttaattaaagcaagtggaaatgattatactgtaaacattgataattgtgtctttgaaaaatgtaatacaaagtatataatttatattactaatggtgagataaataatgtaataatgagagagaatattataactggatgtgttattagtggaggtactagtataactaatcttttatttgaaaataattctggttccgcttatttcacaaatattaaaaaaggagtttacaattctactttcataaacaacaaaattaatcagggtaatgattatggattattctatatatcttccaaaaactttgtatcaagcaataatatatttgaaaataatacaattaaagcactatatatttcagcatataatgatattaattttacaagtataaatgatacttttaaaaataatgttgcaaaaaatggtggtgctgttagtggtggcggaacttttattaatgctaaatttattaataatacagctactcaaaaaggtggagctatttaccataatgctatggttttagttttaaaaaattgtatttttgaaaacaataaagcagatgacggtaatgatatatatggttttatgagtactaatgttagaattaatccacttttaaacatgtctaattctttaaaattcgtatctaccaattcttcaaatgttaaatctgaattaaaagctatttttgatttaggtggtattcaagtaagtggttataatgttaaattctatttaaatggaacttacaaaggctcagctcctttaattgataatgtagctactttaatagctattgctgaagatggaaaatacgaaatttccggttctgttgatcaagttaataaaactaatgttgttactggtattttaaatgttaatgctaatcctgcaagtgtttttgatgtttatgtttctgaaaaaggtagtgatgaatcaggtgatggttcattagctaaaccatttgcaactattaaaaaagcatttgattatggaatgaatcaaaatgcattaagtttaacaatccatttaattggcactttaaaaggtgaaggtaatgttaaacttgatttaaaaccatatgtggatttaactattgttggtgagaataaagaaacttcaattattgatgcagaaaaaaatatttatgtatttgattttgtaccaatgtatgatgatgttaaagtttatttatcaaacttaacaattaaaaatggtgtaactaacaagtatccttctggaggtgttagttttacagtggacactggtcttgttcgcagtactggtttttatttaaatgttaataactgtatatttatgaataatacaggttatggaatttccgcagataaattattctcaactattgtaattaataatactaaatttatagaatctcgtggagcattctattcttatcaagcagcattaaatattattatatcaaatactgaatttttaaaaaataatttggttgtagaaaataataggggaaaattagtttgtttaaatggtttaatttcaattagggatattctttcaaaaggtagtagtaattataattatcattttaatattacacaagtgttatttgataatgtgacttttgacggaaatcataatgttactggtactgctaagcctagtgctctttatttagtaggtacaaatactactataattaattctaagtttacaaatcaaaaagatatttcagctataggtgtatttagtaattatgatactggatgtaatgtaactatttataatacttattttgaaaacaatacaagagatattatttatggatattcatctcaaggtgattatcgtccaattattatattaaataattcaacatttgttaatagtggagcatttacatggccagatcctcgttatcaaaatgcatggtgggttgttaacaatactaaatttattaacatgaccaatatgatgatatttaaagggtcagtatctagttcttataaggataatccattaccgttaggagttaataatactgtaactattatgaattcattattcttaaacaataaaaacggtgttgaatttggtaatggtaatatttcaggatctagtttctataataccccagtatttgtatctttaactagtggtagtcaacctcctgcatgtattgtttacttaaacaataatttctggaatagttcagtacctatatataatgttaccactcctgctagagctactgtttattgtgatagttggttagttccagcattagttacagacaatgcttctggtccggttcaaactattaaacttgtatatttagcatttaatggaactgattattcttattatgatgtttctaaagtacctattttggatgttaatgctagtttaacagtttctaatggtgtaattactccaaataaaggtgttcttaactctaatggtttaactgctaattatacatataatggtgttggtaatcaagttgtaactgcaactttaagtgatggaaatattttaaaattaaatgtaactttctacagaattgatacatttacaaatatgactatttcaaataatgttccgcaaactggagattatattactgttaatgttgttgttcgtgataagaatggtaaacttttaaatggtagtgtgaatgtttatcttaatagtgttttaaaaggaactatcagtttaataaatggtatgggttcctttgatgtgttagcagaaaaaactggtccttgtgaaatatttgttaattatactggagatttagataattcttactcaagtaatatgactattgtttcagttaaaaatacacaaatgaatgtttctgtttctgattcagattctgcaagtaatgttacttttactgtggactttgatcatgtagctaatggttttgtatttgtaactattggtggtgtaacttacaatgctactgtttcaggtaaagaagctaaagttattgtacctccgttagctgtaggtaaatatgatgctattgtttcatataatggtgttgttaataaaactgttgcagttaacatatctcctgatagaaatccagtattaaacatttcagatattgtgatgatttacaaagacggtaccagaatggttgctgttttaactgattatttaggtaatcctattgctaatgctattgtatactttactattaatggtcaaacttacaataaaaccactgatgttaatggtactgcttccatgggattaaacttagcgtctaatgtgtacaaagctactgtttcatataatggttcagataagtataatgcagtttctaaaaacattactgtaactattaatccgactattgtagctgatgatttggttaaaatgtatcagaatgctaccagattctatgctaaattcactgacagcactggaaaagcaatagctaataaggaaatcagatttaatattaatggtgttttctatactaaaaagactgataaggatggtgtagctgatttaggtattatgttaagacctggaaattacattttaactgcttacaaccctgtaaccggtgaagaaaaaggatttaacataaccgtaaaatcattaatcatgcaaaatgacttaaccaaatattacttaaatgcttccagatttgaagcaactgtctacaataaagacggatctttagcagtaaacaaagaagtaacatttaacatcaacggtgtgttctatcacaaaaaaacagatgaaaatggtgttgcaagcttgggaattgctttaagacctggagaatatactattacaacaatgtatgatggtttggatattggaaacaaagtcactgtcatgccaactttagtaacaaaagatctctccatgaagtaccttgacggcagcaatttcactgctttaactttagatggtcaaggtaaaccattagctaaccaaaacgtatcatttaacgtaaatggtgtcttctatcacaaagttactaataaagacggtattgcaagcttaggaatcagattaatgagtggtgagtatattattacttcctactggaatgatttccaaacaggaaacacaataaaaatcagtccttaaagagaattcccaattctcttactttttttcttttttatatgtagatttaactttatatatttattattttttaacatagctattaatttaataaaaataacatttaatttttcaatatgttaactaatatatcgctaatattatggtacttatttttaattatattcaatgaaaatatttattagttttacagtttaaaattacaattatgatttttaaaattagaactaaaggtcacaaaaatgtatcttccatgcacaaatccacttttgaaataactaaagatccagaaattggacctactgcagattgtattgttggagtggctatggataattccatggatgatttttcagatgagtttaaagctaaaatagctaataaaaacactaaaataactgttatattagatactgaaaacggccatgatgagattgtcggctttggtcatgaagatttgactttaactcatccgacagatattgtctgcagaaccagtgattatgtctgttcccgtactttaatgataaatgcagacaaagctgccagagatcttgatttggatttaattgaagatttgaaaaatgaaaaagaaatggaagttacaattattctagactgatgtttttaagctggtctttacttgcactttgtgctgctttaagataagcgtcacagactttatttacttcatcaaaagctacaacttttccttcattaatccataatgctttatcacatatgtttctgatttgttgaattgagtgtgatacaagtaaaacagtagtacctgagcccattagtgatttaagtttatcattactttttttctggaatttaacatcaccgacagacagaatttcatcaataattaaaatatccggatttacaacagtagctattgagaaaccaagttttgcaagcattcctgaggaatagtttttaacaggaaagttaataaactcttcaagttctgaaaattcaacaatttcattatattttgattttaaaaatttttcagtatatcctaaaatagcaccatttagaaagatgttgtcttttcctgaatagttataatcaaaaccggcacctaaagaaagtaacggtgcgattattccgttagtagttacttctccactgtcacagtcataaacaccagatactattttaagtaaagtactttttccagcaccgttaaaaccgattactccaactttttctccctggtagattttaaatgaaacattatcaagagctttgaattttctgcttttttctttgtttcttttaatagtacgtattacatattcctttaaattgtcaattttatcattagatattttaaaacttaaagaaacatttttaagttcaactgcaactttttcatgatagtctggaataaattgtgaaactagattatcaacatcctgatgttgttttgcagtttctttttctaatatattattatgaattggttcgatgtaatctggaacttcattattttttgatggctgccaaccattagggtgtagagatttaggctgttgcatatcatttgggattctgttgtaatcatcttgcaggtcaaagataacttcttttggttgttttctctgattaaaatttctgttttgattgttggaatcactatttatattatttttaaatcttaaattctttttcataataaacaacctacaattctaatgtaattttcctttggtattttgtaaatattataactccggcaactaatacaataagagcaaataaactggtattaataacactcatgatatttggtaatgtattatacattataatgtctctgaattgatcaattagtaaatacacaggattaagatataaatattgtcttaatgcttctggaataatctctgcaggataaaatatagcggatgcatacatcaataatattgtaaatatgttgtaaaggtattcaatatctctaaagtatgtacatacgattgataatattaatccgattcccactaccataacaaagagtattatcataggaataatagctaatactgacattaaggttaaatgaaggcctgttaaatacattacggcaacaagtattattaatgaaattatgaaattgataaactctgaacatattcctccaaaagcaaagatgtatcttggaacgaatattctttttaagataccgctgtttccttttatggaattcatagctatttttgtcccggcactaaaaaaatcaaataaacatcggcctgctaaaaaataaaccggataatttgcaatatttccggaaaatattgttgaaaaaattgcagttaataaaagcatagttaacaatgggtttataaaactccataagattccaagtattgaatctttgtatttagcagtgaaattttttttaattaattgtttaagtaggaaatgctcacttgtatttcttttaatcatttctttaaacataacttccacacaaaaatttataaattagtatcaatatactaatatttaatttaaatatcatttataggttactgaatcatgtcgaaagttaaagtttctgtaatagttccggtttttaatgttagagattatttatcaacatcattagatagtattttaaaccagagtttagaagatattgaaattatttgcattaatgatgggtcaactgatgattctttaaaaattttagaaaattatgctaaaaaagataaccgaattaaaataatctctaaagaaaatgaaggacagggaactgcacgtaatgttggattggacaatgcttgcggtgaatttatatcctttgttgatgcagatgattttataaaaaaagacatgcttgagaaattgtataataaatcagttaatggaaatttggatttggtaatgtgtaaggtttcttcttttgataatgaaacacatataattgatgataatttatggtattattctcttaaatgtttcagcgggtttaaaaaagaggtatttaataatttagatactaaagagttcacttcattaatttcggtaactccttacaacaagttatatcgaaggtcttttattgaaaaaaataatatcagatttccggaaaaatatatatttgaagatgaagtctttttttacaatgtttatcttaaagctaaaaggatttctttaattgatgaaaacttatattattacagaacaaacagaaaaggttcaacagtttctaaaggtcaggataaagattatattgatgttattcatattttcagattaattcgtgacttattagttgaaactaattatataaatgtctataaaaaacaggtttacaacagattcatccatcttattttatggagattcagccagacagctccaaaatatagaaaaaatttctttaatctgatgaaaaaagaatttgatgaaatattagatgatagttcaaaagatttttcattaaatgttgatgaactggattttaaaataaaatcaagaactttaaaagtattgaattccaaaaatcttgaagaatttgaaaaattggattcatgtaagccattttcagttataatggcatcttataataatgacaaatatcttgaagatgcagttgaatctttaacagttcaaaattttggattcgaacataatgtggaacttattatagttgatgatggaagtaatgatgattctttaaaaatagctaagaaatatcagaaaaattatccttataatattcaggtaatatctaaagaaaatggcggtcaggcaagtgcacgtaatttaggattagaatatgctacgggagattatataaacttccttgacagtgatgataaactgtctccaaatacttttaaagcagtttatgattttttagtgaaaaatcctgctgtagatgttatatcaatacctataactttttttgacaatcagaaaggagcacatattcttaattataaatataaaaacgaaaaagtagttaatcttttagatgaacctgattatccgcagctttcagcttcatcagcttttattaaaagggaagctattggtaatttaagatttgatacaagtcttgttaattcagaggatgcattattcgttaataaaattcttattgataatccgaaattaggattagttaaaaatgccaattatttatatagaaaacgttttgatgaatcatctacaattgataattctcaaaaaaagaaaggattttttacagacagattaaaatattactttaaagaacttattgactattcagttaaaaaatatgataaagctctggaatttattcagtatactttaatttatgaccttcaatggatggtaaaagttgaagaaattgataatattttaaataaagatgaaattaatgaattttgggaagtttttttagatatcttatcttatattgatgaagatattattaaaaactataaaactttagataataatgttcgcgagtttttattaactatcaaacagtctgatttaactgctaaaacaattaatgaattgcagcttaatgaccgtttaggtattcacaggttttacattgacatagtcaatataaaaaatggttttttaaacatatcaggtcttttaatgagtaattttaatccggacaatattgaaatagtagctaagtgtgaaaataaggaatttatctctaaacgatttgtttatcctacaaggaaaccattaaaatttttatcagttgggtataaatttccttatgattttgatttggaaattccggtagatgaaattaaaaataaaaaagtaactataaatgttttaagtggaaatgaatcatttaatcttccaattacttttgaaaagcatgcaagattatcaactagcagcaattacttaattaaagacaataatattgtggtttttaaagataattctttttatataacatcatattcatttattaaaatgttaaaattggagtataaatgtttaatgaaaatctataaagatagaggtccttattatacttcggcattggcttttagattaacttatcttgccttatatccatttttaaaaaataaaaaaatctggttatttatggataggcgaaatgaggctgatgataatgctgaacaattatttaagtatgcactatccagaaaagatcatgttaaaaaatatttcacagtttcaaaggatagtaaagattattccagattaacaaacaaatataaaaatgttttaccattttattcactaaaacaaagattaatctatttatttgcagataaaataatttcttcacatcctgatgaaaacattttaaatcctttttatgccaaaaatggagatttatacagtggactgattacatcagagaaatacttcttacagcatggagttacaaaagataatatttctaaatggattagaaaatatgataaggatttatctttaattttaacagtttctcctttagaaagaaagtcctttttaggtgaagattataattattctcctgaaattattcaaacacttggatttccacgttttgataatttggaaaataataatctcaaaaaacagatattaataatgccttcctggagagaatatttgcaaaaaagtgaatttgctcttaaaaattccaaatactttaaaggattaaatgatttattaaataatgaagagttaattggttatgctaaagataaaggttataaaataatttttaaaccgcatccgaatttagctaaattccgatatttgtttgatttagatagaagcattattgtagatgataaaaagacttatcaagagctatttaatgagtcaaaattacttataactgattattcatctgttgcttttgatttttcatatcttaaaaagccagttatatattatcaatactcagatgactataactttgatttatccaaaagctattttgattataaaacaatgggctttggagaagttatcaaaaaagaggatgatttaataaagctaattaaagattatttggataatgattgtgaaatgaaagaagtttataaaaaaagagttgacaagttctacagatataatgatcaaaataactctaaaagagtttatgactggatttatgaaaattaattacattaaggcatactatgacaattaaggataacatttttggaaataaaaaaaagctgattcaggaaaataaagttcttaaacaagaaatagaaaatttacataaagagattgattctcttaacgataaatataacaatcttagtaaaattagagctaatgaacatactgcagctagcttttgtaattggtcttatataaattattattttagagatgattttgaggaaaaattcaagaaaatggttgaaaatttacctaaagaatcaaaaaactactttaaatggctttttttaagaagtttagctattaattataacagaagagaaactttattttttgatgatgaactggaaaaacaaaaacagtggacagattttaaaataaataatgtatctgaagataaaataggaaaatataactttaaaggtggatataatcttcatggatttatagatttaaatttaagtaaagaagataagaattttcttgaaaataaagatataattgatgcaggagcatttactggagatactgcaattccattatctgaagttactcataaaaatgtttttgcttttgaaccatttgaagagtcttttaaattattaaaagaaaatgttgaaataaataatatttcaaatataaaacctgtaaacaaatctttaggaaatattaatggtgagcgaagtttatatttagctaatgataattttcaggggattacatctgattctaacttaagaaaatatacagaagagctaaaagttcaagaagtaactgttgatcaatttgtcaaggaaaataacttggatgttggtttgattactattgatgttgaaggagcggaaaaggatcttttaagtggagctattgaaacaataaaaagtcaaaaaccaatgctgtttattagtatatatcatagtgtcgaagatttctttgaaataaaaccttggattgagaatttagatttaggttataaatttgagattattaaagaacagccctggacatttattgtggatactattttaaaatgtaaaataaatgatggataattattaatttttcaattaatggagtctgtaaaattttataggcttatttgattttaatgtgtttttcagtccaattttgcatttgatagtctaaaaatgtcaggattccatttttggttttgtatattttctttattttttcaggattggtttgtctgtagtaattttcgactttatttgatgttttttctatattttcatcatcaagatattctacgtatctgtggaagtgatttatgatatgttttcttatgaaatcttttaaaacaactggtatggccgtatatttttgtaaatattgtttaaattgttctattgcttctttttttgagttttgtctgaaacagttttttaattcttgtgcattttcgtaaatatggtctctttgttttccattaatcttgtttcttctacaatatacttttaatttatggtttattgtttgaaacagatgaaatatgcacaattgatgttttacttctatttcatctgctacattacgatacattgggaataaatcggttgttaggcaaatgaatggtttattttctgttgattctaagataaattttttcgtgttttttggtattctgcgacgtactattcgttctgtgactggaatattgagtattgcatcaaataaagttaatctgtagtgtctagttccattaagtcttaaaaattgctcatcatataaataatagccagaatattcaaatttttcattgctgatgctttcttcgtgatttttgtcagaccagttcttgattgtttgatgagatattctgattccaaggaatatttcaaagtatttacttattttacgaagtgattggtaccctattttcattattcctggaattttatccattatttcttgtaaaaattgtttattttcaccaattaatggattattgtatattccgaatttttttccacattttttgcattgatattgctgttctttgaattctgttgtttttccattagtattttgtttgtttttctttattgtgccttttttgattattttgtggcttccacaaactggacaaatgggattatcatatttaaaagtattattttcatctaaaaatagtttatgattagtattttcaaaattaggtgttttattcaatctttttgaaataattttttcttgatcaattttttcatcaaaaaaatcataaagtttaagttgtatgaagtctatattactattgagggcagatttgttttgtttggtcataaaatattatttgtcctcacttattaaagtattttactatttttaaatcatttatattaaaattaaagaaaaattagaatgaaatttcatcaaaatgaaagttcaactgtaaaaaattaaaaaacaaataagcctataaaattttacagactcaattaatggagtagtgtgatttatgaatgtaataatagtataattcacaaaattaaatattgataattagattattataattttgacaatttcaaagctattcatttagatgaaaataatggtgctgaaggtaagcatcgtaatattggttttgaggaagcattatgtgattttgtaatgtttttagattctgatgatttttttgtagaaaatgcaattgaagttttatacaatcaaattaataataatgtttaattggatattgttttgggaggatatcaaaatattcatggagataataaacagattgtattgccttttaaaaattcagatgagtcttattttgaggatactgctaattgcattgatttggttaagataaatccagttaaaattaaataatcagggtttttttaaataaataaaatcaaagttcaaataaaaaaataattttcattgattaattagtgtattaattaaaataaattttctgaaccatagagattaaaattgtaattttaaagaataaagtttacaagttttaaaaaagaaaaatggaaaaatcattaattgaaaatgagaaattaattgcaaaaaataggaaattaacttgaaaataacttttttccaaaattaagagattagtctttaaataggatagacaattaactataaaatttgaaagaatattaagttctgatttaaagttattttctttaaataaacttaaaataggaaataattattaatataattaattataaattatatggtagttaatcaataatatttaatgggataatatgcataaaagttcgtttcaatcaatggaaaaatttaaagataattatttgaacactgaagattcattaaatattttagacattgggtcttatgatgctagtgatacttcttataattacggcagatttttaagagaagataactggaaatatcagggtatggatattcaggaaggtcctaacgtagacattgttgtttcagatatttataattggattgaaattgaagataattcttttgatgttgttgtttctggtcaggcttttgaacatatggaattcttttggaaagctataaaagaaattgaaagaatcttaaaacctggtggattatgttgtattattgctcctagtgcagggcctgttcacaaaaatccttatgactgtttcagattcactgataatggtatgaaacaagtagctaattatgtaggattgcaaatattggaatgctatgttaatgatgatgaaatttcttatccgtggtatgattgtgttttaatagctagaaaacagtatggtgttaataataatctagaaaaaagaatggataatcttgaaaataaattagatttaattttagagagaattaattggtgataacatgcataagtctagtcatgataaaatgagttggtttaaaaatacttatcttaatgataatgattttttagatatattggatgttggttctttagatacaagtggtactaattataattataaatctatttttaatagttctaattggacttatcagggtttagattttgaaaaaggggctaatgtggatattgttgttgatgatatttacaattggtatgaagttgaagacaatagctatgatgttgttgtttcaggtcaattttttgaacatttaggtttcttctggcttacaatggctgaaattgacagagttttaaggcctggtggtttttgctgtattattgctcctagtggaggacctaaacatggtgatgcagatactgactgctatcgtttttatgaagatggtatgagtgcattagctaaatatgttgattttgaagttattcatgtttctacaaatgctgatgctaaaccttggtgtgatacatgtcttgttgctaaaaaaacaggttctttagtaaatagtggagataatttagaaagaagaatgaataatcttgaaaataaattagatgcgattctaaattcaattaaaaaataattattgtggtttttatggagtcagttagtaatattgatcaaattgggaatttaaagcaaaataattttattggtagaccagaatttgttaattccaatgttacttttagaggtaaaggtaatttattttattgtgaacgtgaggttaagttagttaatgcaaatatacgttttgaaggtaataattcgttagtttatttatcttccactcctaattcacaatatcctttgaatttacaggtttatcatgattcagttgtcttttttggtcgtgataataatatgactgctcctttaaacatcaatgttcaggaacatcagaatttagttattggtgatgattgtaatattggtagtggtacaaatattagaacttcttttgcttatccgatatatttatccaaaactaaagaaaggattaattttccgggttctgttcttattggggatcatgtgtggttaggtcatttggcttatatatcttcaggagttgttttaggttctggttctattgtagataataatgcatttgtccctcctaactgtaaaggattgtctaattcttttttgagcggtaatcctgtacaaattattcaagaaaatgttttttttactaaagattatttaggtgctttcagtgaatcagagtctgaaagtgttaatagttatgtaagtgatgtttttatttataatgtcattccaaatgaatcactttactttcctaaaattgacgaaacattaaaatgtttgaatgttgatgattctctggattttattcagaaattatttgtccaaaataaaagaaaaaatagatttgcaataaaataaggatttgaaggttatttttaacctatatatccttgatttgcaggtcttaggcttgtaataatttcagcagctatttttgaagaataatcatttttattatcatagttcagtatccacatacgataatttgtattatctttttcaaagaataattgtgttgaattagtataatttgtttcacgataggttacatatacattaatatcatctattttttgagtttcattgcctactgtaaaattatcttttagagctttttggaaataggttttaattgaaacattgtcatttaaatgagttatatttatagttatattgttacttttatcgtagaggcttattgtatttttactttcattagtaatattgaaattgtcaggcaaatcaaacttggcaccttcgaattctattttgtttgaattaaaatcaaaaccattgtaattgtataaattgacctctaccattaataaaatcagtataattaataataaatatagttttttcataattctcaccatcaaaagctttattatctttggtagatatattattatattaatggttatatctgatatatttttgggattattttttaaaatagtggggggctataaaaattcatgataaatttttattttctgttataattgcagcacataactctgatttgtatttaaaaaaagcatttgattctgttattagtcaaagtttggattttgaaaaaaatattcaaattattgtagttaatgatggaagtacggataatacagaagaaatgtgtttgaaatatagggttagatatcctcaaaatattaagtatatatcaactaaagattgttttggcccagcacatgctagaaatcagggattaaaagaagcacaaggaaaatatattaattttttagacagtgatgattatataagccataatacatttaaagatgtttataatttctttgaaaaacattattcagaaattgatgttgtttcaattccaatatattattttggatcacaaaaaggtaatcaccctttaaattttaaatttaaaaaaacagaagttgttgatttattgaaacaaccggaatttattcaattatccggaccttcttcattttttaaagcagaagctattgaaaatattaaatttaatgataaattacaaactgctgaagatgcattttttgttaatcaggttcttttaaataaactaaaattagggcttgttaaaagcggatcttatttttatagaaaatttgaagctaaaaattctcttcttgattattcaagtaaaactaaagagtactatatttctagaattaaacagtttcattttaaattaattgaatgttctaaaagagattatggtgaagttttaaagtttattcaatatgtattgatgtatgatttgcaatggcttttcaaaattaaaaaaattgaccatattttaagttatgatgaaatttatgaactttacatcaatctgatttttattttgcaaaatattgatgatgatgtgatatataatcaaaaaaatattcaaaatcagcttaaaacacatatattctttttaaaatatttaggtaatgattatttagctaattgtgattgtaaatatagaaaacaagtttataatgatattcttgataagttatcattaaatcaggtttttattgatatttttgagatacaaaatgatgttatttatgtttcaggatttattactacatttttcaataaaaaaggtaaggtttttgcctttgttaatgataagatttttgaaactaaagagttgaaatatccacaaagagataggttttctctaaattttgaatatgcttacaataatgattttgagctttttattccaattacttcaaaaaatcttaaaatccaatttaaaacggatgttaatgattttaaagatcttaaaataaaatttaataggccttgcagactttcaaatacttctaaatattcactttcaaaaaatcacattgctaaggttaaaggaagtgtaataactgtcaaaccaaaaaattgggtaagaatattgaaaaatgagatttcaactatttacacaatgttgcgtgaaactaatcagggctggagaactggtgtgatatttagaattgtttattttattttatatccgtttttatcatctagaagaatttggatttttatggatttaccttatttggctgatgataatggtattaatctttttaaatatgctgttggtataaatgatggtattgaaaaggtttttgttttaaataaagataattttgcatttgatgaagtttctcaaattggaaaaaccattgaatacggttctattaaacataggatatatgctttatttgcagaaaaggtcatatcctcccatccggataatggtttagtatatccattttggggcaattatccttttttatcaggtcttgttaaatttaggcttgtatttttacagcatggtattacaaaggataatatttcaatgtggcttaataaagcggataaaaacatttcattaattgtaactgcatcaaaactggaattgcaatcattttttaagtatccttataactatcataaagatgttcctcagttattggggtttcccagatatgatgctcttgaaaaaaaggaagattataaagaaattgtaattatgccttcttggaggaggcatttccatcattcaactaaagaaaaaatattaaaatcaaattacttcaaaatatacaatactttaattaatgattctcgtttaattgatttttgtaaagaacatggttataaattgatttttaaaccgcatccaaatgtttacagattcattgaattatttgaaactaatgattatgtaacaattgattcaacttccaatagttataataatattttcacacatgcttctttagtaataacagattattcttcaatagcttttgattttgcttatttaaaaaagccagttatttattatcattatgctcaggattatcattttgatattgaagagagctattttgattataaaacaatgggttttggagaagttgttgataatcatgaagaattaattgatttgataatggaatatattgaaagtgaatgtgaaatgaaaaatcagtatattaaaagagtcgatgatttctttgagtttaatgataaaaataattgtaaaagagtctatgaggctattaaaaagatggattatgagtaactggataatgaaattaaaaaatcagtttttactgtttatattaaaatcgttaactttatatactttaaaaaacacattttttaataactacttttgttatgtgtgatgcgggggtggtcgagtggtcaaaggcgataggttgagggcctattgggttagtcccttcgcgggttcaagtcccgtctcccgcactttaattaataaactatttttctgattattatgtctaataaatacttaaatgcaatttcttcattagataataatgtttttatagatattgaggtttctccaaattccaataaatttcaaatttcaggatttaacgaatggagaaacagatttgaaatacgtattaagcaagttcctcaaaaaggcaaggccaataaggaaattgtaaaagaattatctaaaatatttaattgtgatgttagtatttcaaaaggtgagaaatcttctcaaaaaacaattgtctgttataatgtcagtattgattgtatattggaaaaattaagtgaaattttataaatgtaaaaaataattaactatttaaccaattaaaacataagttattattaattaaattaagagggtgataattagatgaaagcagtaattccggcagctggttttgggactaggtttttgccagctactaaagcacaacctaaagaaatgttgcctgtttttgataaacctactattcagtatgttattgaggaagctgtagcttcaggtattgatgatattttaattgtaactggtaaaaataaacgttctattgaagatcattttgataaatcatttgaattggagtatactttaaagcaggctggtaagactaaatatttaaaacaggttcaggatatcactgatttggctgatatttgttatattcgtcaaaaagagcaaaaaggattaggtgatgcaatttattgtgccaaaaaacatgtgggagaggaaccttttgcagtaatgcttggagatacaataacgaaaggaaaaactccatgtacaaaacagttaatagatatttacaacaaatacgaagcatcagctatttctcttgaaaaggtacctcaggaaaaagtggaaagatacggtataattaaaggagaagaaatagaaacagatgtttatcagattgatgaacttgttgaaaaaccaccagttgatcaggcaccgtctaacttagctattatgggaagatatgtactcactccagacattttcgataaaatcaaagaaaccggagctggagttggaggagaaattcagcttactgatgcgctggctaaattagataaaatttatggaaatacctttgaaggaaaaacctatgatataggaaatcgtttagaatggttgaaaacatctatagaatttgcaatggatgatgaagaatctaaaaacgatttaatcagttatatgaaagaaattatagcttcaaattaaaattaagtattttctataatttctttttaacttttttttaaacttatttttaccacaacatttatatatttttgtgtataaattatgatttataggtatctataatatatctagtatggattgatttatatgcttaaaaaaagggataaaatgggttatggcgaagatatgaatcatcagatagtaaagtctattgaaaaaatgaacagccacagtgataaattattttatgagcagttatatcttcaaaaagatcctgtaaaatacaatgaatttaaagattggtgtattgaaagaggatatttaaatgaattgtataaaaaagagtaatatctgttattttattatatgtatgtaatttttaaatgctctttaactaaaaataaataagagaatgtaaaaataagtgtgggagctgtaattgggagtgttaataaaaaattaatggtgaaatcaaattatttaaaatagcctcataataactctgtgtgattgaagaattaactgattgtaaggtagttggcaatattaattctaaaaaaacatgatttattatataaataaaattaaaataaaaaaaatattatggtttcatcatcaaatccataatactgaaagcttcattttcttttttaatgcctggtccgtttaatccgccaaatgcattttttgcaaattccttgttaagtcttttagaaacttcaccaaaaatcattttataagccttacattgaggatcaacagcttttggagttttactggctacaatagcattatatggacatccgccttcgcaatattttacatatctgcatttggcacagttttcatcaacatattctctaaattcttgaagttttgcccatgcgtcagactcttttagcttatcaaaacttgggtttgctttgacattgcctaaaatatattcatccattcctacaaacctgtagcatggataaattgaaccgtctgcaccgacagctaatgttgtacctatacaatctgcaaacgtacataatgttccccttcttctgaatgtacttttagcaatgtggtcaagatccattacactgaatttatctaaatcataaagatacttgtctagccagtctattaaaagttttccgtgttcttcctgatcaagagcccatgggtcagcattgtctccacgtagtgacggaagtgcagcatgtatttttaaattcataccatgggatttgaaaaattcatataactcgtcactgtagtctttggaatattgagttactgttaaaacaaagtttatgtttaatcctttttcttttgctctttcatatctgccaatggtttttttaaagtaaccttctgctctttgatagtcattaatttcttcaggtccgtcaatactggtacttacagcaacattgtactttaaaaataaatcgattagttcatctgaaagtaaccagatattactttgaagtgaaaaaccttctaaattgtctattttggataatttttctaaagcttcagcatagaaatcatagcctgcaagaagaggttctcctccgtggaatgtaaaatgaactttatcatctctgaaatcttttaaccatgtgataatgtcatcaattacgctaatgtccatcatttcttttgttgattctgaaccccaacagtatttgcagttgcattggcaacctaaagtgggaattatcattacatgaaaagtcattttatccgtaatatttatttaattcttttaaaagttcttttttttcgtcttcttccatactatcatttacaaagaaaatataaccgcaatcttcgcattttacagtgtctaactctgcatgtgctctgtgattgtctaacatttttctgtgtacatgtttatctttggaaccgcattttgggcatggagctaatatttcttcgagtttcatgtttatcactttttattttattatttaaaaaaatttctgatatattttcataccgatactttttacgaataatactttaaatttaaagaaatggccttcaaattcttttttaactttatcaagttcttttggaatgtccaggtgttgggggcattttcttaagcactttctgcatccattacataatcctgcatttgaactgtctatcataattccgcttacagttaaataataatcgattaagctttgatttaaaaggcctttttgattgaataaatatttttcattatatattttcatgcattcaggaatattcacgcctctggggcagggcaggcagtatccgcagcttgtacagttaatttgaagcaattcttttaaggctctttttgcataatcgattgtttcaagttcttccaaactcatggaatggggttcaacactatttccaatagctatattttcatcaatttgagctatgttattcattcctgaaaatacacaggttatttcaggatgatttaaaatccaggatatgctccattctgcatttgtttttgaggggtcggcttttttaaatatactttcaactttatcaggcattttcccggctaaaattccaccttttaaaggttccattacaaaaattcccattccttttgatgctgcatggtgaattccttcaatatctgcctgaacattgttatcaaagtaattatattggatcatcaccatatcccagtcatatgcatcaagtaataatggaaattcttcagtagtgccgtggtatgaaaaaccgacatattttattttttcctcttgttttgcctttgataagaattttaaaacatcttttttaagcagtctgttcatagctttcaaatcaacattgtgtagaaagtaatagtcaatacagtcaatttgcagcctttctaactgttcatttaatattttttccatatcttcatacttttttatgttcattgcaggcaattttgtagaaattttgactttgtttctatattctccttttagagcctttccaaggactttttcactttctccattattatagatagctgcagtatcgataatgtttattccattgtctattgcatggtgtattaacttttcagattctttgtagttgattttaccattttttgaaggtagtctcatagctccaaagcctattggtgagagttcttctcgtgtttttttgacaatcctcttttccataataatatagttagtaaatgaccataataaatatgtttagaaaatttaaataaaaggttattattttatatatactggataaacaactaaaattcttaatttttttgaaaaattgtaaacaattagtttttgatgttttgaatatggctgatttttctgaacattaatcactaaagttcttgacggagctaaataaatcgatatgataatatttatatattgatgaaattaaacttataattatacctatttgacaattaggttattatgactaatttttgagggtattgatttattttaaaaggtgatgaatagtggtttcaaaaaagattatagctattgttgttgtaatagcagtgttggctgttggtgttggagtatgggctaacggttcagcaagcactgatgacagtttaaatggacaggaagtaaatttagctgctgcggctagtttaaaaaatgtttttgatgaaaaattaattccaatgtttgaagaaaaatatcctggagtaaaagtcactccaacttatgcttcaagcggtgatttacaaaaacaaatcgaaaatggtttggatgcagatgtatttatgtctgcaggtaataaacagatgaataaattagttaatgaaagtttaattgataacagtactaacattcaatttttagaaaataaagttgttttgattgtacctaaagattccgacttaaacatatcttcatttgaggatttgaaaaatgtagatggtaacattgctatgggagatccttcttcagtacctgcaggtcaatatggtaaggaagtattaaccaatcttggtgtatgggacagtgttgaatccaaattgtctttaggtactgacgtaactgctgtattaaatcaggtagctcaggggtctgctgaatgcggtattgtatattctactgatgccaaatctaatgatgatgttaaagtagtttgtgaagctccagatgatgctttaaaaactccagttatttatccggtagctgaacttaaaaactcagagcatcaggatgctactcaaaagttcatggaattcttaaaaagtaaagaagctaaagatgtatttgttgaatatggatttacaattcatgaataaactttataacttaaaatccatatgataatttaaaggagaattattaacatgactgactggactccaatttttatttcaatgaaaacagcaagtttatcaatttttataaccttttttttaggattaatagttgcctggggcattgttaaacttaaaaatgattcagtaaaaattgtacttgacggtatttttacacttccaattgtattgcctcctactgttgtaggattctttttattgtatatttttggtgttaggggtccgataggtaagttttttgtagactttttttctgtgaaaatagcattttcatggtctgcaacagttatcgctgcagtggtcatgtcttttcctttaatgtatcgttctgccagaggtgcatttgaacaggtagattctaatttattggatgctggccgtacattggggatgtctgagttcaaaattttctggaaagttttgcttgcaaatgcacttccaggaattattagtgggggaatacttgcctatgccagaggtttaggtgagtttggtgctacggcaatgattgcaggaaatattgcaggacaaactagaactcttccaatggcggtttattctgaagtagctgccggtaatatgggagatgcttttaattatgtaatattcattgttattatatcatttatagctatttttattatggattatgtttcaatacgtaaggaaaggcagtggaaataatttggggaatatgttatgagtaatgaattgttaaaagtaaatattcaaaagaaacttaaagaatttgacttaaatgtggattttgaattaaaaaaaggatgtttaggtattttaggtccttcaggttgtggtaaaagtatgactttaaaatctgttgcaggtattgtaaatccagataatggtgttataagtttaactacaaatgatgaaactgtttattatgattctaatgaaaaaattaatttaaagccccaaaaaagaaatgtaggatacttatttcaaaattatgcattatttccgaatatgactgtagaggaaaatgttgctattggtttacctaaagattatgatgaaaaaaggttaactgatatgattaaacgctttcgtttagaaggtttggaaaagagatatcctagagagttatctggaggtcagcagcaaagagtagctttggcccgtatattggcttacagtccggatgttatactgttggatgaaccgtttagtgcaatggatacatttctaaaagaacagttacgtattgaacttagtaatgtactgaaagattttgacggattttctattcttgttacccataatcgtgatgaagtatttcagttttgcgatgagcttttaatattggacaagggtaaaattattgcaaaaggaactactcacgatgtgtttgagaatccaaaaaaagttcaggttgctagacttacaggatgtaaaaatatttctaaagttgaaataatagatgattatcatcttaaatcattagaatggggaattacatttgaagtagctgaaaaaatttcacaggatattactcatattggaataagggcacatgattttttgcctgctgaaaaagatgatattaattcatttgacactataaacgcaacaaaattggaaataccttttgaatggcaaataacgttggcaaatggattatggtggaaattagataaaaaatacatgatcatgaatttataattcctgattatttaaaggtagatcctaaaaatattatcttgttggaagagtaattcaatataaatgtatttttaatggtatctgaattaatatggattcattttatccaattaattattattttttggaaaatgaaataacgatttttatttttttaagtgtttttatagtttttgttctgtttagattacaggcattaataaaaaataagatgctagtaaacagataaaaaaatcagctgactttttggcggagccataataaactttaaattatttaaataagatattatttttcatgaaactgacaattattggaaccggctatgtaggtcttgttaccggaacttgttttgcagaaatgggaaataaagtttactgtgttgataatgacttggaaaaaatagctaatttaaaaaataatatcttacctatttatgaacctaatttggcatcattagttaaatccaatcaaaaaaagggagatttaatttttaccagtgatttaaaagaggctttagacaattccaatattattttcatagctgttggaactcctgaacatgaggacggtagcgttaatttagattatgtttatgatgtagcttcagaaatagctgatgttattagccaggattcattaattgtcattaaatctactgttcctgtcggcactgcttttaaggttaagaaagtaatagaatctaatttaaataaagatattaaaattgatatagccagcaatcctgaatttttaaaggaaggggtagctattgctgattgtatgcatcctgaccgtgtaattattggtgcacaaaatgatgaagtttttgagactttaaaagagttatactcatcatttattgttaatagtgatagatttgttttgatggatgttaaaagtgctgaaatgagcaaatatgttgccaatgctctgcttgctactaaaatatctttcatgaatgaaatagccaatatatgtgagaaagttggtgcaaatgttaaaaatgttcgtttaggtattggcagtgataaaagaataggttatgattttatttatgctggctgcggttatggtggaagctgttttcctaaagatgtaaaagggctgattaatactgcccttgataatgttatgaacctaagattttggctaatgttgatgatgtcaatgaaaatcaaaagcttgttttagtaaacaagattgttgataggtttggtgaggatttatcaggtctaactttcggtatttggggtctttcttttaaacctcaaactgatgatgtaaggtgtgcaccttctttaataatagcttctgaaattattaaaaggggtggaaaaataaaagcatatgatccaaaagccattgataatttcagacagaactttgattctaaaaatattgattataaaaaatccaaatatgatgttttagatgatagtgactgtcttgttttaattactgaatggaaagaattcagagctcttgatttggatgaattagctaaaagattaaaccagaagattatttttgacggcaggaatatttattcacctaaaattagagaagcaggttttgagctatatcaaataggttgctaaaacttttagcaatatctaaattttattttttaaatttaatgaattttaaattatttttagtgttttgtttttattttcctatttttccctattcaattctagatttgttatgataaatcattatatttataaacattatttgacagatataatattaatttttataatgatatttaggtgttttcatgttaacatcagtacaaaaagaaattttacaaacattaattaatttgtaccagtctgctaacggcggatctattaaaggtgaagacattgctgaaattatgagtagaaatccgggaacaattcgtaatcagatgcaatctcttagaagtttaggtttggttaaaggagtaccagggcctcgtggtggttataaacctactgtagaagcttatcactctttaaacatttcagtcactgataaggattttaatgtacctatttataaagatggggaaaaattaaaagatatttcagttgcaaaaattgaatttacaagtattccacagcctggcgaatgtgaggcagctattaaagttttaggaaacattaaggatttaagtttgggagataccattagaataggccctacaccagttaacaatttgggagtaatgggtaaaattgtaggtagggatgatatggacaatattttgcttgtagacactactacaattagaagtattcctaaaaatactgttggcgatatagccagccgtgatgtagtatctttaaaagtcagttctactttaaaggaagctgcagaagtttttgcgtttaatgatattaaaggagctcctgtaatggaggatggtaaagcagtaggagtatttactgtaactgaccttgttagagcaatagctaataataaagaggatttgcttgttggagatttaatgactacgaatattgtaatcgttaatgaagacatgagaatagctaatgctattgaaataatgcttaaaaaagcaataagtagggtgcttattgctgataacgataataatttacttggaattgttacaagaacagatttaattaattccataacaaatttaagtcaattccctattattacccaataattattttttacaagtgatttaatgaaagtaaatcagatagacatttctaaagatatgaaagtaagtgatttggtggctcaatttgaagcatcagatgttttaggtgctggcagagttgcaagggctactaatattctggcaaatatgattaaagatgaagatacaaatgtatttatgagccttggaggtcctttaattcctggggggatgagaaatattgtttctcaaatgataagggaaggtcatgtggatttaatcgtatcaagcggagctaatcttactcatgatttacttgaagcatttggtggagctcattacagggatgaaggaaaagatgatgaggaacttaatgctgaaggaattggcagaatagctgatattaatgtgggatccaatgattttgaagtttttgaaaaggaaataaatagattatttgaaataatatctgctaaaaaacctgtaatatctattcaggaattaatttatgaaattggaatgttgattgatgatgaaaattcttttatagctactgcagcaagaaataatgttccaattttcgctccaggtattattgattgtatgattggtttgcagttatggattttttcacaggaccatgattttacaataagtgcagctggagatatgccttatttgtcagatattgtatttggcagcgaaaaggtaggtggaatcttacttggaggaggccttacaaaacattatactttagcttcaaatattttaaacggtggtcttgactgtgcagttcagataacaatggataggccggaagcaggtagtttaggtggagctccattagaagaagctaaatcatggtcaaaagcaaaatgcggatctaatttagctactgttgttggagatgttacaattatcttcccgttaatctatgctgctgcattagataagatctgatttatttttatggtgattttaagtgagttatattattttggctgttttatttttcttaagtggatttttcatgaaattgtccgatgatgcctgtgatgtaggtgatgacaagtcattagctattgcactgggactgttatgtgcaataacttcagcatttgcaacagtatcaagtgcatctgcagcatacatatttatcggaattttaattggtaatttgcttgccttaaaagttgacggaattcatcatattataactttggtattgtttgtattgatttcattagttatgggcattccggagttaagtgtggttattttattaatatgtatattttcagcacttttagatgaaataggacatgaattaataagtaatttaactgaaaacaaatttttaaattacttttttgaatataggtgtgcaatgaaagtagcaatattcttactggctgtttgcggtgtattcaatatatttttctttgtattgtttatattatttgagttcgcatacctagttgcaggttcaatatctgaaaatggtttatttaaaaaaagtagaatttaaaaaggattttttaatcctttattattttttcacaggccagtgcaggattatctgattcataaatgcttcttccaacaataatggcacttgcaaattcaagagtttttttagcatctccaccctgttttccgacacctggagaaataatgcaggcatcatcacctacaatgtttcttatttcacttaatctgtctaatcttgtagccggtgcaacataattggtaattcccatatcaactcccattttagctatagcttcagcatctttttgtaaaaacattttagctcccggatgtgacatttcagtaagtaaaaatatttctttttcgtgtttatttgcactgtctagacaagcctgaacactgtcggaacctacaaaaccgtgacagattattgcatctgctcctgcatcaaatgttaaatcgcagattttggaattggtagcgtcaatgtctgcaactttataatcgcagattatatttgcaccaaattcatcttttataattttaatgatttctaatccttcagctaatgtcaatggatatcctatttttattgtattgatataggggcttacttctttacatatttcaattgctttgtctttattggttacatcaagtgctaatattaagttatttttaatattcatttggaatcgcctttagtaatttgtagttggtttatatttattgtattttaacagttatataaattaggaattattttttggtgtacttaatttagtaatacttttcatactatctttgtctaattcgaattttatttttaattttattatattttttttattttttgccttgaatttttataattagttcattattcaagtaaaatttatatatgataaacataaaaataatgtaataccaatttgattttttgttggattggttaaagagaatgagtatgtttttggcttattttggaggaatataattatgcatattatggaaggttttttacctgcagagtggtgtgctgtttggtttattatatcaataccaatagtgctctacggtgtatatcagataaagaagattacagaaaccacaccggaatctaaagctttgattgctgtaagtggtgcatttatgtttattttatcttcattgaaattaccgtctgttactggaagttgttcacatccgactggtaacggatttggcgcagtattatttggacctgcagttactgcagtgttagcttcaattgttttaattttccaagcattattacttgctcatggtggaattacaactttaggagcaaatatattttcaatgggtattgtaggtcctgttgtcgcatggattgtatataaagctttaataaaagcagatgttccatctattgttggagttttctttgcagcatttttaggagatttattaacttatgttgctacatcattccagttagctcttgctttcccacttcctacttttggagcagctttatacaaatttttaataatatttgctgttactcaaattcctttggcaattggtgaaggtattttgactgtgattatttgggatagattgaaagcatataaaccaaaattgttgaaaaaacttgatgtattaagtgctaaggaaaactaggtggttattatgaaaaaatcaacatcaatcattttattagcagttgtaattattttgtttattgcaccgttagtaatgtataacggctatggtgaagacgaaggatactttggcggagctgatgaccaagctggagaagctattgaagaaacaggttatgaaccatggttctcatctatatgggaaccaccaagcggtgaaattgaaagtttacttttcgcacttcaagcagctatcggggcattgataatcggatatgcctttggttattggagaggccaatctaaaaaagaggattaatttcctcattttatttttttttagtgatttttatgaaatttgacatggactacattgctcatcataacagattaactttaatgaattcctattataagatagctatagctatgggattaatgataattacattaattttgaataatttatattttgatgttattatctttgctttaatgttaattttaatagtggcagtagctggaatttcatttaaatcctatttaaagtttatttcaattcctgcagtttttacaatactgacatgcgtatttttattatttttctttggaactggaaatattgtttgggacagtcatttttatggaattgcaataaggcaggatgcagttgatttggcaatttatactttttttagaatttttgcatgtttttcatgtttgggatttttaggtttaactaccccaatagcagaggttttacattctttggaagttataaaagtacctaaaatagtaatagaaattgcattgcttatgtataatacaatattcatatttttaaatgaaattgatataatgaaaaaagcacaggaaacaagattaggttataatggatataaaacttcatttaaatctgtagcaatgttggggagcaatatatttttaagatctatggataaagcagaatcactgcagcattctctagattctagaggatatgatggtgagattccaatgtacaaacctcaaaataggagtgatgattagtgttagaagcaagaaatattagttattcttatgatgatgattcacaagctctgaaaaatgtgagcctaaaaataaacgatggagaaatggcggcaatacttggtaaaaatggggcaggaaaatcaacattattcttgcatttcaatggaattcacgaacctgatgacggtgaaattttaattgatggtgaaaaattaaagtataacaaaaaagcattaattaaatgcaggcagaaagtaggaatagtttttcaaaatcctgacaaccagatatttgcaccaagtgtagaggaagatgttgcattcggaccgttaaatttgaaattgccgatggatgaagttcaaaacagggtagaagaagctttaaaaagagttggaatggaaggatttgagaaaaaagcaccacatcatttaagtggcggacagaaaaaaagagtagctattgcaggaatattggctatgaggcctgaaataatgattttggatgaacctacagcaggtttggatcctcagggtgcgataaaaatcatgaatttattatctgaacttaacagggaaggaattacaattgtaatttcaactcatgatgttgacttggtttccaaatatgtaaataaaatatttgtcatggctgacggtgaaatcataggtgagggaacacctaaggaaatattttccaatgaagatttaattgaaaaagctaatttgaagcttccaataatatctgaactttttaaagcattgaatgatgaaaatcagataaatattgaaaataatgattatcctttaacaatcagtgaagccaaagataaaatttttgaactgatgaaaaattaataaaaagttatatattaaaaataacagattttagcttaaggtgaacttatgaggattggaatttgtgatacaacttttgctcgttttgatatgggagctgcggctattgatgaattaaagaataatgctacagatttaactattattcgccaaacagttcctggagttaaagatttgcctgttacagctaaaattctaattgaagaagaaaattgtgatattgtaatggcacttggaatgcccgggcctatggaaaaagataaagtgtgtgcccatgaagcatctacaggtcttattaatgcacagttgatgactaataaacatattttagaagtatttgtccatgaagatgaagaggacaatcctgaagatcttaaggtattggctgaaaacagagcacgtgaacatgcaaaaaatcttattaaaatgatgtatcatccaaaagctatgagaaaagaagctggaacaggggtccgtgaaggaaagcctaatgtaggtccattataaaaagtgtatttagatgactgctaaaagtgaatttaaagtatcaatggaagatagaaaacaaacttatgttattattccagcatataatgaagaaacaagagttaggccagtaattgaagcaatagctgatatggggtttaaaataattcttgttaatgacggatccagtgattgtactttggatgttttaaaggatgttcaaatgaaatatcctgaaaatatttttatttattctcatgttattaatcgtggcgttggattagctatgcagactggttttgaagctgttttaaaatataatccaaaatatattgtaaatattgatgcggatggacagcattctgttgatgatttggaacgggttcttgaacccttgattgctggcagggctgaagcagttattggtgtacgttctttaagtgatatgcctaaatctaaaaatttcggaaattctgtaatgaatatattaacacatattttctatggagttaatgtttctgattcccaaaccggatttagggcattgaccagaagtgcattggataaaatatcaatcaatgctcagggttatttaatttcttcagaatttataagggaaattaatgacaataatattccttttgaagaagtgacaattgagactatttacactcctgaaacacaggcaaaaggaactaactacaaagttggaattaaaatattgtttacaatgattagacataaattattcgattaaaaaaggtgattttaatgtttttttattctttcttatttcctgtaattgcagtattggctattttatggtttgctgtacgtgttagaaagggaaaaaatacaattagcacattaatactttggattatattgtggattttcttagtgttatttgcactggttccagatatcagtatggtctttgctaatttatttggaataacaagagggctggattttattgttattgtggtatttgctgtaatggcttatattatagttagattatattacaagctggataaattagaaaatgacatcaataaaatggttaaagaaatagcattatctaatgaaatttccttatctgatgatgaggattagacaacttatttttttattttaactttattcaattctttttttttctaaaaaacatatttttaaattaaattttaaaatccatcatatatattagtaataacaccatattaataattgcaatgttatattttagaggatgtactgcaagacaaaaagaaacaggtattgctgatgctacagaaaagctgttgaaattagctgatgttgattatcatgtattggatgatgaaaaatgttgtggttcagtcttgcttagaacaggttttgaaaaggaagctaaaaaacaaatagctaaaaatactgaagtttttggtgatgaaacaatactgacttcatgtgcgggatgttataaaactctgcttcaggattatgaaggtttggatgttattcatatttcagaactgttggctattctgattgatgagggcaggctgaaatttgataaaaaagatttgaacgttacttatcatgattcatgtcatctgggaaggcactgtaaagtatttgatgaaccaaggaaagttatcaaatcagcagctaatttgattgaaatgaaaaatattaaagaagacagcctatgctgtggagctgggggtggagtaaaatcagcttatcctcaaattgcatcggaacttgcagatgccaaaatcagccaggcaaaagatacaaaatgtaaggcacttattactgcatgtcctttttgtaaacttaatttaaaaggtcatgatttggaagttttggatttaactgaatttttaattaaatatgggggagaataatgaaagaaagtgaacttgaaacaatgagaaagtcatttaaaacagttaaggataggtcttctaagattaaaaattcgtcttccattaaaagattggaaaaaagagtcagggaaattgaaaaggagtcaattgccaataaggaggaactgatggacatagctgttgaatcattcaggagaaatggcattgatgtggaatatgctaaaactaaagatgatgcattaaatattatttatgatctgttggatgaaagcgattctaaagtaatagctaaagcaaaatccaatactttaggtgaaattgaacttaaaagtaatttagcagctaaaggatatgatgttgttgaaactgatttgggagataggattttacaactgaaaaaagaagataataaacctgttcatccaactggtccggcatcccatttaaatgtagatgagatagccagtattgtcaatgaatcaatgaaaaccaatgtcggaagggttccacgtgaaattatggaagttgtcagagcagatgtgttaaaacgtcttgaaaactcaactgtaggtataagtggagctaatgttgtagcggctgaagaggggtctattgttttagttcataatgagggtaatatttcattggtttccctaaaagatttgcatattattgtagctggaattgataaatttgtacctgttctggaagatgcgatgtctgttgcaaaacttgaaacagtttatgcaactggaaattatgtaacttcctatatcaatgtaatttcaggaccttccaaaacagcagatattgagaaaaaacttcttaaaaatatgtatggtgcagaaagggtggttgttatcttactggacaatggaagaagtgaagccagggaagaatgtctgtggtgtattggctgcggaaactgtatagtcaactgccctgtatataatgctgttgggaatgaattcggatttaacaattatttgggcggtcgcggagtggctatgagtaaattcattgaaaatgatgaaaaatgctttgaatcaggattatataaatgtactttgtgtggtttatgcactatcaattgcccggtttctattcctacaaatgacataattgaaaaaatgagaaaatcttcacagcttcgtccaaaagctcatgaaaaaataagtaaatcggttatagaaaaagattctccttactaatctttttcttttataatataaagaggtctttttttgctttccaaataaattttagctaaatattctccaattattcctgctgcaaacagttgaattccacttaaaaataggataattgaaatagttgaaggccaaccttctacaggatctccaaataaaagggtttttataacaatgactataatggatagaaatgcaataattgaaaagaaaattcctataattgtagctatgtgaagaggagctgttgtaaaagaaacaattccttcaatggaatatttgaacagttcccaaaatgaccagctggtttctcctttttgcctttcaatgttttcatattctaaccattttgtttcaaatccgacccactggaaaattccttttgaaaaacggttatactctttcaaatcaaggattgcatttacaacttctcttttcattaatctgaaatctcttgcaccatcaacaagctctattttagttattttattagctattttatagaataatcttgcaaaaaatgatctgattggaggttctccttttcttgtgactctacgtgttcctacaatatcatatttagaaatatattttagcatttctggaattaatgatggagggtcttgtaaatcagcatccattaatacgatgtaatctccggtagaatagtctaatcctgcatatattgcagattctttaccgaagtttcttgaaaatgagatgtatttaacattgccatagctgtttttaagttttttgataacttctaaagtgttgtcatttgatccgtcatttataaaaataacattccagtttatatttttcagattatttgaaagttccctgtaaaatattggaagcatttcctcttcattataacacggaacaactatatccaatgttttcatattaaatatttttttaatattactattttaaataatttattatcaacttttaatttttttttgatttttaaataataaatatttataagtaaggttatacaatatttaattattatatttaaaatgtaaaaacggaggaaatacatgcttctattaataagtcctataaatcatgaagaagctcttgaatctattaaaggtggagcagatattgtcgatgtaaaaaatcctaaagaaggatctttaggtgctaatttcccttgggttattagggatattagggagataacccctgaagataaattggttagtgcaactttaggtgatgtgccttataaaccgggtactgtttctcttgcggcaatgggagctcatgtttctggagcagattatattaaagtaggattatatggaacaaaagattatgatgaagcagttgaagttatggaaaatgtggctaaaacaattaaagatgttgataatgatactattgttgtagcttcaggttatgcagatgcacaccgtgttggtgcagttgaccctatggaaattccaaaagtagctaaagatgctggatgcgacttggctatgcttgatactgctgttaaagatggtcatacattatttgattatttaagtattgaagatttagaaaaatttgttaatgaagctcatagttatggtttgaaaacagctcttgcaggttcagttaaaaaagaacagttaaaacctttaaacgatattggatgtgatgttgtaggtattagaggagctgcttgcgtaggtggtgatcgtaacactggtaaaatacatcacaccgctgtagctgagcttaaagaattatgtgattcattttagataggtgtggttttttaaatgttttcaaaaaaagttcaagaagcaaaagtagcttatacttttgatgattttttattaactcctaatgcaagttatgtggaaccaaaagacattgatactaaaattaaattaggaaaagatattaaattgaatataccaattttaagtgctgctatggatactgttactgaatcagatttggcaatagctatggcacaagaaggtggtgttggagtaattcacagaaatattactcaggaaaaacaagtggaagaagttaaaaaagttaaatcagctgaagatttaacaatacgtgatgttataacaattacccctgattctacaattgccgatgttcaggcaaaaatgaatgatgagttaatcagtggtcttccggttgtagacaatgatgaaattattggtatcatttctaaaagagatattaggcctgtgttgaaaaaaggtgttgacaaaactgtaaaagacattatgacatctgatgttgtaactgttgaagagccaatcactgcagaagaagctttaaacattgcttatgaaaataaagttgaaagacttcctgtacttcgtgacggcaaattggttggaatcatcactattaaagatattttaaaccaagctcaatatcctaatgctgctcgtgataaagacggtaattatttagtggctgctgcatcagggccttttgatttagacagagcaatggctttagaccaagctggtgcggatattatttctattgactgtgctcatgctcataatatgaatgtggttaagttcactgaaaccattaaggacaatattgatgctgatttgtgcgtaggtaatatagctactgcagaagctgctgaagatttggcatctatgggtgtagatggccttaaagtaggtataggtccaggttcaatgtgtactacccgtattgtggctggtgttggtgtgccacaacttacagctatttcagaagttgctgatgtagctaaggaatatggtattccagtaatagctgacggtggaatcagatactccggagatattgcaaaagctatcggtgccggtgcagatgcagtaatgctgggtaatttacttgcagcatcttacgaagctcctggtgaaattgttgttatgaatggaaaacaatacaaaaaataccgtggaatgggttccatgggagcaatgaccagtgagtacgacggaggagcagacagatacttccaaggatctaaaagtaagatgaatcatacaaaatatgttcctgaaggaattgaaggtgctgtaccttacagaggaactgttaatgagattttattccaacttgttggaggtttaaaatcttctatgggttactgtggtgctaaagatattgcagctatgcaagaaaaagcaagatttgttagaatcacaagtagtggtataaaagaatcccaccctcatgatttattaattactaatgaaagtcctaattatccaactcttgactaattaggatttcctgattcacaaaaatgattggatttttttctcatttttgtgttataatccttttttaagttaaaataccattaactttaaatattagtatctataatattattatattagataattttaagattattttataatctgtgtaaataattttaaatatttacattattacatatttattttgatgtggagagaatttaaatggcaagaacaaaaaaagtgggtattacaggtaggttcggtgcaagatacggaagaaaagcaaaaagatctgtaaaaatgatcgaagaaaacatgaaaaaaaatcatgtttgtcctagatgtgatagaccttatgtaaaaagacaagctgctggaatttggaaatgtagaaaatgtggcgcagtatttaccggaggagcatatgtaccagaaactcctatggcaaaatctgcagcacgtaacataagaaatgttaatgtggaggaataatccttgtatagatgtccacgttgtggaactgaagtagatcacaaaagctacatggaaaataaatgtcctaaatgtagatataggattttatttaaaaatgttccagaagtaacaagaattataaaagcaagataatcatttttgcttttatctacatattttttaaaactattttttatgatttaaatgttaatttcaacttctagaaaaccttctcaaaaaacaagaaagttttgtaaaaatctcgctcatgcaactggttccactagcgtaaaccggggaaaaagtaatatgcgtgagttacttttaaaagctctggaattagatgagcataatttagctattgttaatgagattaagggtaatcctagcagagtaactttttattcaaataaaggggaaattttacttataatattaattggagttactacttctaatgaaagatgtcatattttacctaaaaatttgaaaatagtttctaaagttgaaaagctcaatgttttaagtgaaattttaggttttgaattggtagataaagctagtgaaaattatattcttatttctaaagaggatgatttaatagctaaaattaattttgtaaataaattcggagataaaaccgatttacagattaatgttaaaaagattttagatggggaattatgaacgtagacagtcctcttgaatctattaaaagtgatatagctattgaatttgaaaatcaaaagcaggctaaaataatttatgaatccattattttagaatttgaaactgctcctgattataggtcatctatgagtttaactttagatgaatatagaattctaattagaattgatgcagaagattctacttcttttagagcttctgttaactctgcaattaaatggattaagttgtctttagagattaataatttaactatttaatacaatatttttaaatattataaaaaacaacttttagttattaaaataaaataggtggtaaaatggaaatcccagaaaatatacaacatcaattaaatcaattccaacaattacaacaacaagctcaagctgtaaccatgcagattcaaaatgttgaagttcaaattcaagaaagtgaaactgctcttgaagaacttaacaaaactgatgaaaatgctgaagttttcaaacaagctggaaacttacttattaaagttgattatgcacaagcagttgaagatatgaatgaaaaattagaaactctcaagttaagaaaacaaaccatggctcgtcaagaagaaagagttatgaaaaaacttgaagaaatgcaaactaatatccaagctgctatgcaagggttacaaggagaataattctcctataacattcttttttttatagattttcatgtctaaacttaaaaaattatcatctgttgatttagctactatttctgatgattttggtgaaattttagaaattgaagtttcaaaagctatttctactaaagaactggatgatttggatttggatattatcgtcagctatgaaaataatcagcttgatgttgatgtagatgttggagttacctttgacaaactttcagagattacccaggatcaggtagccggtgctattgatgaagcttatttaaaatttgattcatatattgatgagaattatagacaataattttatttttttaattttagttaatactttttttattttatatattaatatagtaatacttttttataaaaaaatatttatactgtgggatttaatgtataatatacagtttgaagtgatgttttgtattattcattaagtcatcctatttaagatacataatgtatttgtttttcagttctcctctttcatacattacttcaagctaatttttattgatattttgcttggatgtttttaaggggtgttgtgtattgggaaacatctttaattttaattttcaagcttaatttagcatattttgaaattttagcaggttaaaaattacatatattcaaatttttattaatttttatatttttgtttaatttcaaaattaaatattttaattctatttaatatttgatctattttattgtataatttaattatcaaatatactttaatttttataaaataaagtaaagtttatatactacgaagttaaatctatgtgtaaggttcataacatattttttgttaaacccttataattgatcattattttttttatttaggaattaggtgcccttacctaatttcacctccttatatttagcaactttttttcaaaaatattaatagtcagacattatcaaataattaatcatgattaaaaaagttccagttttagatttaaaagataatattgcagttagtggaaaatctggattaagggacacatatactccattacaaacagttttcgcaccatcagctaatcctgttgatatagctaatggattatcaattaatggggcagatgagttatatattgctgatttggatttaattgaaggtaatggtcataatattcatgatgttaaaatggtaaactcaattttgccggttatgctggatgcaggtgttaaggattttgaatcatttactttctttttagactatgcatataagataattgtcccaacagaaaccataaaaagcattggtgagattaaaaagatttttgaaaaatatcctaaagaaaggattgttgtaagtgtagatgttaaggacaatgaattatattcaaagaatttaaatatttcattagctgaatttaaagaaattttggaagaattggatcctgatgaaataattcttttagacattacaggtgtcggaacacaaaaaggttataatcaggaattactggatgattttaaagatttaaaagataaactgattatagctggaggtttaaataacaaatcagttagtgaacttgaagacatgggtataaaaaaggttttagtaggaacagctttgcattcaggtgaaatgaaattacttgattagttacactatggtgatgatatgtttaataaaaatactataatcattgtattggctattatttgtttggctgttataattgggggaacaatacttgtctttggaaatgctcatgaagcatacaacggcacaacaattaataatactaacaatacttcagtatctgtagataatgtaacttcacaatcctcttcatctgggtctgcagatgatggttataaaagacctacaagaacttatggtggtgaagaacacttaactgctcatgagtctgatgttttagatgacgggtgggatccaaaacagcacgaagtttcccgtagtgatataggaaacggatatcatagaatcaattatgatgacggctactttagggtctgtgatgaccacggttatgttgtaagttatggttattgataattcataaccatctttttttttaaaaattataaaaatagtaaagtgttattttataataacaaaaatcttaagattatatacggtaatacagctgctaagacaaacaatattgttcctacaacaaatttgtatttattttcatctaatgttccagctattattagtaaaactccgaaaaatccgaatattaccggtaaaatatgtgaaaataaagtaattcctgtaaaagccattttttatcactattatacatattgtctatttaattatataaagatatttgtggtgttatcataaccttttttaatttaatcaaacttattatattatatgaaaatagaacacaatcatgaacatcatgaaaaagctaaaggtaacctcctttttgttttcattttaaatattacttttaatgttatagttattcttggaggattaattacaaacagtgtagctattcttgctgattgtttacatgatttgtcagatactatatctattggtttggctggggtgctggagcatgtatctcagaaaaatccaaatgaaaattatacttatggttatcaaaggttttctattttaggagcagtcataacttcaatttttgtgattattgtttctgttgttgtagtttatgaatcaatttcacgtttattatgtcctgtagcaccggaagcaggatggatgcttttagtagctattgttggaattatatttaagggagtttctgtttttaaacttcataaaggagaaactattaatgaaaaagttattttattccatcttttgggagatgtattcggatggatagctattttggttattagtgtaatcttaatgttttggaatgtatcatttttagatccgttgctttcattaataatcagcttatggttattatataatatgggtaaggcattacatgagtctgtctgtgttttacttcaaaaatcacctaaaaatgttgatgttgatgaaatcaaatcccaaatagaaggtttaaatcatattaataatgttttagatattcatttatggtctttagatggtattgattctattttaactttaaaaataaatattgatgatgttaataatggtgatgaagttaaaaaagagatttatactattgcttctaaatatcatatagtagacacgacagtagacatattatcacatacttatcaaatgcactctacatcaaacaatataaaaagagaaaaatagatttgataaatatgagaaccaatgaagaaatcctaaatgagatccattctgttaaaaatcataaaaaaacaacacagcatatttacaaacattcaataaataaatattgtgaattgaataagttatcattagccgaattaatcgaagaagcagaaaaagaagaagaacagggtatacgatggaaacatcgtacattaaaaagaagattattaaattttcgcaagtatttgatggataattattattataacactgtatcaaatactttcacaccagttcttgttgtatataaatattttgaaattgaaatacatgatctgccacgaattgataaaaaaagttataataatcccaaaccgatcagttttaaagatttacctgataaagaaattattcgtgaagcagttaatatatgtacttctaccatgaaagctattatattattcatgagtagttcaggttgtgccagaagagaaacattaaatttaactgtaatggactatatgaacgcaactaaagaataccataatacagataatattatggaaatgatagatgtgttaaataatattgataatgttgtccctacttttaatattttaaggcaaaaaacacagaaatattatattacctattgcagtccagaagcagtcacagctataaatcatcacttactatcaagacaaaatttaacaccagaatcccaactattcaaaatacatgaagactacctaaaccaacaattcattaaaataaacaatgaattaggattaggaaaagcaggaaactacaacagattccgcagccacatgctcagaaaattccacgcctcaacactatataatgatggtatgagtctggacaaagtaaatgacctgcaaggcaaatcaaaaaacagtactgatgaagtatatttcatgaccaatcctgctgatttaaaacaggaatatattcaacatttaccagcattatcaattagtaaagaagttgaaaagatcactgttaaatctccagaatttttaaaattagaaaatacaattgttgaaaaagatgaaaaaatcaaagattatgaaaaattaatctatgatattgatgaaagattacgaaatattgagaaaaaagaagaaaatttcaaagaaaatgactttgaagatttattaatttaaaaattttttgacaaggtttatatgtttaataaaagatatttattaaataactattttggaggaagttaaatgaaaaaggatgcaagaagcttaagagtgcttcaagaggggatttcccttaaagaagtttttaatgttgattttttaaaaaaacttgaagaaaactttgaaaatcttgaagttatacctataaatgcagcttttgttttaaaagatggggaaataaataaggatattcttactttatcttataggaatgatgaagaaataaaaagtaatacagttcttattgatgttcaaaataatcctgaaacattggatattattagaaaaactttagaataaacatttataggtggtgtctatggtgtattcagttgataaaaattatggatataataaaccttctaatattgtaggggatttttttaaaaataagttttttaaaaaatcatccacagagtcttttgaaagtaaaatcactgaattttatgatgaacttataaaaatttctgacaatttaggattaggaaaaaatatatctattgatacagtgtatgatggatcatatcctgaaaaagtatttacaattaatgttccatttcatattgataggaaagaaaaatattctctgttagaccaaattattaatgatatggttatcttttcaaaggaaaataatatgtttgatttctataaagatacctatattttaattaaataatttattgggggttttatacattaatattgaaaaataccctcaatatgaattatataaattcactaagcagttatatgaaaataaagaagaattaatccctgaaaattgcgataatcgttgtgtgtttagtactattatcaataggtgctattacagtgcttatttatatgttagtttgtggcttcaggaagtttataaatttaaaccattgtctaaagaagactttggtgaaaatgagtttattacagaacatgggcaagttcaatatgaacttcttgaggtcaatcagtattctgttaggaataaactatatgatttatttaatttaagaaaaaaagcagattatgatcctttttataatatctctgaaggtgaattggatgatgctatgtaccttatggaacaaatttttaaaactttaaaaatttgaggttttatggatttatttttaatattaaaaaaagaatggttttagatgaagtggtagtattctaagaatacttcatcttcatcattgaatcttataaatgctccttgtttatctttaaatactattgttgcgttttgtttttcatttccccatgttttgcctgtattgttgtttttcaggtctgtgaatgttatgggtttgttgtttattgtgaatattggttgttcttttatgaactcgtagttttcgtttactgttcggggtattagttgttctagtgtttcgtttagtgatttgcagttgttttgtatttttattaattgtattttttcagctatttctttttttattcttatgctggtgtagtcagtcattttttatcatcttccttttttttggcttataatataaaaaaaatatgggggggttagattaatgtttcgtagatgaaacttattaaaataaccaaccatattattaaacttatccaagtatatttttggtttctattaatgtagattaatattgctaatatgattaataatattagtattatgatgcttgttattgtcattttgtttttcacctcctttttaagaaaaatttatataagaagcaataaaaaatataataattgtaagagggggttaacctcctacttgtgtttttgtcttttgagtatttctaggattatactcaaagacaatattatgatttttattgcctctgattctgacaacttttcacctccatgtatttctattattatattgtactacatagtatataaaggtttctatttttttaattaaaaatatcaatacattttaataacaaaaaaagataaaaaatattcattataaaaatgaacaataacctaacagttcacaaaactaattaaacaccaaaatttagaacacaatgcgtttcattttttcatactgaataatgtttagtgtttcattattttcattgaatatactgtatttttaaggtttattttttgaatagaaacatttatattaacttataacataaatataaaaacaagaataaaaaaacttttttgaagagtaaaattgtagaggttatataaatcatggtggaaagtaatcttattgaaacatttttatataaaagtgaagatgggccagtatcaattaaagttatcattgatcaagaaaacgaaacattatgggcaacacaaaaaacaatggctaatttatttaataaaacaccaaaaaacattagtaaacatttaaataatatctttgatagtggagaacttgttaaagatgaagtaactgttaatccaaacgattccactattagtggaatcgttattaaaattaatcctgaagcaaatactcaacccatactctataatttagatgctatgatttccgtaggctatcgcgtcaatagtaaagaagctacacagttcagtaaatggtccaatactattttaaatcaaaaaaagaaacggaatgttacaccagattttctagctgatacagtaataaaaatttgataagacagttaaatacaaaatgtaaattgtaataaatgagtattgaggggtaaaaatatcatgtcacaagatttcccagaaagtccttttgaaccagggagaccagtatctccagataattttaaaggaagaaaagaagatatcaacaaaattataaaatatttacctaaagttaaaaatcaaggagctcccgaacattttttcataactggaaagagaggaatgggtaaaacatcatttataaattatgtttcaagaaaagcagaagatgattttcaaatgattccaatccatattaacaatggtggtggaaaaactattgatgaattaatacaaaagttacttgatggattattaaaagaatttaaaaaggattatttaggtaaaagtgtaattgataaaattttgaataatattaatgaatttaaagttgcagggactggagtatctttaaaagataatgatactaatttaattcataatattaaaaaacattttgcagattttttgattactacttgtaaagaattacctgaagattatggaatatttattgttgttgatgatcttaatggtttatctgataatgaagagtttacagattggtataaaggattatctgaaacattattggttaatgaatatcatatgcctgttgttttcacattaataagttaccctcatgaatttgaaaaattatgttcaattaatgaatcattttctagaatgtttaatttaattgaaattgataatttagaggataatgatattgaagatttcttcacaacttcatttaataatgtaggcattgagtttgaagatggatataattctatagaacctatggtttatttttcatggggtatgcctttaataatgcaacaaattggtgattcaattttttggaatgctcaagataatttaaaaataaatgaatctatagtattttctggtattactgatgcaacagatgaattagctaaaaaacaattaaaatccaaattaaataaaattagaagcgatacatatattgatatttttcttaaattaggggaaaatagattaatggattttaaaaaatcagatgtgaaaaatattttgacaaatggggagaagagagcttttaatgattttttaaagagagctaaagaccttgggattatagagtctattgggagagaaaatagtggggaatatggttttgtaaatagattatactttacatattttatgatgttatcagaacaaaaaaaggttgaaaaagaacaattaaatgcaaaataagtaaatgtaattcctagttgatgagggggtctgtgatgcggcaacatctcgcctctcaaaaactagaggctacaaaaaatagataccacgagttgataaaaattttagtaaccaatactatttattataaaaaaagatatttaatatttactaaaaatatttgtgaaggattaactgattatttttcagctttttcaatagatacagttattccttcatcaatatttacaatccaatgtaatgaatcccccagttctaattctaataattttatcacatcttgggggactattgacctaatagaattaggtccgcctttacttaattttgttgtatattctaaaataggcatacctccatttttatatttcttatataatatattctgttttgcagtatatatatttacctttaataaaggtaaatataataacctttatatagtattaagtataatagttatttgaagaagaaaaaatcagagcggcaactctgaagaagatcttctaaaaaatccacgagttggtaatatggataataataagattgaagtttttggaaggttaacttccaaagaagaaattgaacatgtatttttaaaagcaaaaaggcttcaggctcaaaacagagtctatgaagaagaactccaaaaattcaggagtgtgggcgtatgagttgcagatacaacaactcaatgtatacgattactccacctgaagatgaggtcgagtttgattatcttgaacagatattattgtctgaggattatgaaacacaggaagaaatagatcataggttggctgatgaatataagcaatttcaaatctatgaattgtctgatgatcaaatgttggagtttgctcgtgcaggtgaactagcttacgggggtaaatgaatgttcactcctgaattttggaaaaatgaaaacaagattggtaatgcgttatatcgtataaaccagtcacagtacaaagattactgtgaaatagatgaactgttcgtatttctagcacaggaatatcctgaacaaagagaattgttcgaaacattatacggggagtatgcagagtatgttgaagaacaaaccagattaagggaattgaaagatttccttaatactcctggtatgaaaaaagaagttaagtataaagtgttggaggctcaattatgagtctcttcaacaataaacctactccagttagacttcataaaaaagtgtcctggagagaaaagtatgaagttgaaataatctttgcaaaaggaataattttaataattttattattcatttttgcattccttgtagtagggcctatggatccttataataatgggtgtttagtatgattacttatgatcagcaaaacaggttttacaatcaattattaggaattgttgaaaaaatgggcggacgtatttctgctcatggaaacttacatggtattttcttatctgtaattgtttttcatgacagtacttatgagaacacacgtgatattatgaatactttacaggaactgtgtggtggtgaaatccagtatcatgactactgggtgtcaaaaagtttcattccacactctcaagcatctttggaaaatattgatgaaaacaaagtattggagattattgaggaggaattttaatggagaaagaactatttactgaagaaatcataaacaaaaaagagttaaaggagaaattaactaatgcaatccactttttagaccataatgtagatgctaaaaatcctgcagaattgaattcattttttgatatgatctttaaacatattgtacagaaaaatcaagttagaatagttaaagcactgatggaagagttatgtgctgaaaaaaatatagattacgatgaatatattctgaacaccatgtttagaaaaataagtgaaaatgaacagttaaaagaaattagggatttgatgaaaaagtcgatgaatatgtaaaaagggggattatttttttatgactatatatcagaaaattgcaggaattcaaaagaatctcctgcataaaaaattacctaaaagtgggtacaataaatttgggaaatttaagtactatgaattagaagatattttgcctgcaatcttttgtgaatgttatgaacaggagttattcattgagttttcatttacaaatgaattggctcaattgaaaatcagaaattggaatgaacctggggaatctgtcatcaccagtgttcctatgcctgaaatagttgctttaaataaaggtatgaatgtaatgcaaagtgaaggcagttacattacttacttaaaaagatatttattagcaaacatgtttctaattgttgaaaaagatgttgtggattctgataaaattaatgttaaaactgctaagggtagttctgcaagaactgagaaagttgaggctactggtgctgtgcagaaaatccgcgagtatattcataaaaaggacagttcactggaaataactccatctatgattaatactcatagaatgaagttattcaaagatggtgaactgaccaaagctgaaaacaaagaagcatataactggtttaaaaatcaagaaaaagaggttgctgtttaattatggaacctaaggtagaaataatattcatacaattcaaggcatcaggaaatactggatccaatactgtgaactgggacagtatagatggatggtggtgtagttgtgaagattatttctaccgacatcaaaaagtagaacattataaatgcaaacatattaaaaaagcagaaaaaatgttaggtgtaagagtatgaatactcaggataatttccctgaagtggtatctggtaggattactacaagggcaaaaaagttaatggaaaagtatggtttaactgtacgtttctgcgtggaacattgcattgatatgtatgtgagtaaacaaaatcaaaggttaattgaaaaggaccagttaaaagaggaaatcaggtctttaaaattagatttaattgcaaaggaaatgcaattagaaactgtcatgaaagagttaggtgatgatgtatgagtgaaaaaatacaggtttcattcatggttgattctgaagtatggagggaagctaaaaacaaactggggacaaccagaagtgagtttttagaagagcagttaagattagctattgatttatctgaagatgaggaaaatagtttgagaaaagagatagctgagttgcaaaatgagattaatgctcgtgaatcaagattatgtaagattcgtgctgagcgtttagaacatgaaagaagtgtaaatgtctttgatggggtgatgggtacagttaataggattgttgataatgctggttttattggtaaagatcagctgaagaatattagtaagcagcaagaagttccgtataagtcattattggatcatgtgtatgatttgggttatgatgttcggaattatggtttggtgataaaatgatttgtaaacatttatgtttacatttttccgaagaacctgtaggaaaccacgtacgtgcacgtacgtacgtacgtatacgtacgtaattcactataaatattttttaaattgtaaacatttatgtttacatttttttaaggagagataaaaaatgaataaaccagtttttaatattgttgaaacggattatgatgtttctaaaggtgaagaaacatatttgaaattcaggagagattataaacatgaattaaatatctctgttgatgagttgcagaaaaggtatggattaactcgacatcaaaaagattcctttgtgaaaagaatcatttgtgaagatcatgttaggcgttatgggggaaataacttccaaactaggttaaaaaaggtggaatcatgaagaaagaagatgaggaacatattatattaaggtggcagttgatgtggtttagaataagtttatttgcagatgagtttgttaagtttgctgaaaaggtacgtatgaggtgtggtgttcctgaaccaagtcaaagacaaccagtccggaataaaaaggagatccaaaaatgagttgtaatgatatacttgaaaaattagaaaaagaaggaataatatctgctgaaggagtaattgattcttatctgttatgtaaacatgctgaagaattatttggaaaatcatacctaaaagaacataatatagtgttggatgatgataaaaaagaagcaaagatatgtaaaaaaggaagttgataaaaatgaaaacattgaagtttaaaccgtatttctttgaacctttaagaagtaggaaaaaaatgtctacaataagaaaatctgataaaggattgaaaaaaggtgaccttgtagaatgttggtttgaggggacgggtttttgtctgcttcgggtagtacggagagttgaacaggttaaatttaaagatttgaaacataatcatgcttggtttgaaggttataggcatgttgatttgttgaaacatgagttaaaaagtatttatccagatatatgtggggatactgttttgtttcagattatatttgaaagaccaacactaccattacaacctttcaaaattaaataggaggatattgaaaatgaataaggaagaaattaatgaattaactgccaagattgagtcttgttgggatgagaataatcctggagatgtaagaagttttgatgaaaggttaaaacagaagttaactcatgaggagtatgagttaataacaagttggagataatggggggagaatatagtatgatggatggttgggtagtttttagtgtaagtgtaattattagttgttgtttagtgttatgtcttactgatttttttgatgattaagataggttatattgtaatcaggagtttttatgaaagaagttaaaaaatacatggaggataaatatgtatgattgatgagaaattattactatattttattaaaacaagaagcagggaatttgaagaacaatcttttactattcataaagaatgcacaggtagtttgagagacatggagtatgatgatgttataattcatagtattaatcttcatactttgatgcatgttactcgtattcttaatgagttgattgaaatgattgaagatggtaaattcaacacttctgaaaattcagtttcttgttgtggtggagaatgtgaaaaacaataaccttaatctatatgaaagagtatacattagtttaagtagaacagtctccaattttgaatgcataaatgaagaattaaaacaagaaactataactgaagcattaaaaaaatcacaagtaattaatgaatatgtgaaatatcagggtaaacttttaccttttcacatgtttgtttttgaagtgaagaaaaacttactatctaaaaatttagaaagatgataggatgttattgaagaaaacattaaatgatccacaaacaagattctacatcagcaaatgcaaatactgtggcagagtatttattaagtttgagaataaaacaggttattgcagggaagcttgcaggacctgggcggtacgtgagcagaaagcaaagtatcaacaaaaacgtaggaaattaattaatgatggggagttaattagtaatgagttaagggagcctggtacaacatttctttcacagcatgctttgagtgattttggtttggaggaaagaactgtgaaaagagaattaaaaagaataggagtaaaaatatgaattttatcaagtatcttaaattattaagaaatcctaatgagaagtattattggtatgatgttgataaggaatgtatttatatttctggtgaagatattgcattgtatttaactattgatgaaattgacagtattatttttcatagaaaaaaatttaaaaagacatctaaagaactttttgaaaggataatttttaatgaaaaggttactttttggacattgaattattttattaaagaatatgaaaaaggtttgatggatcccatgattaaatggattgtaagtaagggacatatcagtcgtggtgagcattttcttgatagttatttattaagtgattaaattttttttatttttaatctttttttctatttttccactcctatatattgaaggggataaaatattttataattttatctttttttatgaaaaaaaaataaaagacattattataattatatatgggaggataatattatttggatgctaatacattttttaaaaacatgaaacatgcagaaatagagtgtcctgtttgtaactggaagtggaaacaaaggaaaaaacaagaaaaacattatagaaatcataagacatcttgttatattaagtttcctgaatcccctttaactgttttggatgaatctcgtgcagaatataattgcacaaactgcgggtgtgtatttcccttaaaaaatgaaacatgcagaaatagagtgtcctgtttgtgaaaaactgaaaaaagattgcaaaaaggtttactatgatgagtggcatgatgagtatgtttgtaaaaaatgtggtcttgtaataaaacacttataaaaaatattttatcatatgttattgtacaattagcttcgcattatcattatttgacaatttaaaaataatattcttatccgtttattattcgcttttcatttattattattcttaaaaattattatgggaatggtagcaaatttttaatgaataatagaatgattggatttttttcttcattaaaatatataggtatcctccaaagattaaataattaatatcacatatcttaaaaaaaaatattcttcccataaatataatataaatatttatctcctttaatacatgttcatgatgttggtaatagcttattttttattgtaacttagtaaccactcaaaagttgagggtgcaattccctccaccaacaatgttggggtagcctagcctggtagggcgttagactgctaatctaatgatacactagtatcgcaggggttcaaatcccttccccaatgttttttttaaaaacaaattttttttaggagtgaaaataataatgactaacttcaacaacacaacattagcaataattggaataataattataggaattctaagcacctatattggaaacaacgaactagcagcagtagcattaggggggatagttggatggatttcaagaacttacacctccactaacaatggaggaaacaataatgacccataatcaagttcaagatttacatgagaaatattgtaaacaggaatctcgtataagtaaactggaagcaagtgatcagtttcaaaataagcaattagaaaaactgataaagaaaatggataaaagtattgaaattcaaacaaaacagttggctattcaggaagaacaagctaatgatgataatcgattattcacaataaaaagtggagtattcatagcaattgttggtgctttgattgtatttttgattgatggatttcagtttgttattgtgaatttcctaaaactattataaaaaactaataaaacttttttttgttcaaaattcaaaactaaacaatattatattgttcactatgaaaataaaaaatcccgtattttaaaatttcgtgttcaacaaaaaagaataaacattacaataatgttcaaaaaaaatataaggatggggggattatgactgaagcatgggaaagacaaaaaggagaaccaagtaaaagctattcactattcaaagaatacagagatttaggttccaaaagaacattcccacagataataaaattgaagaaatcgaagcatactgaagaaaaaaacataccttcactaagtcaactaaaaacactctcttcaagatggaattgggtggaaagatgcagattatatgataatcatatggatcaaaaagaaagagagtggaactatgaattattcaaacaaggaaatgctaagtttcaagaattcttcaatgatgattttgaattactaaaagaaatacaaaaagaactaaaagaaaatagtaatgagaatgctccaactacacgagcaaatagttttctaaatctaaataaatctgcggaaataatctatagaaatttcagactagctcatggtcaaccaacagatattaaagataataatactcaaatacaaggaagtattgaaacatccaccaaagaaaatgataatgtaatccatatgaacgacaaagaattagaagaattactaaccattaacgatgatttagaaaaattcactgatgaattatgagagtagattacaagaaaatacacttagatcaacaacaaaaaaagttgattagaagaacaatacttgaaaacccatacattccagtaacaccatacgaccgacaattatatgcaattgcagaccgccacacaagaaaactaattggaggttccgcatattctggtaaaagtatgcttggagcagtattagccttacaacattatgaagtaccatactaccgctgcttaattctacggtctacttatgataatgtaatagcgactggaggaatagtagattacctggaccattggacagaaccattcgattacatagaacacaatcaaagtaaaagatgtttcattaaccatgaaaatgatgcacggatttattattcatatatgcttctggaaaaagacaaagagaaattcaaaagtcgtgcttatcataaaatcattgttgatgaagcttcagaatttgaaaaagtaaacctgcaattcctgaatcgtagtctcagaggaactgataagttaatgactttcccattagcaatttactatattagtaatcctgctgatgcagatggatcaacatacttaaatgaaaaatttgttaaaggacaataccctttttttgaaatgaatttctggcataatccatatattgacaaagaaaaatacttagctaatttacgtgaattatcaaaagcagattatcagtatcagattggtaattgggattatgaaataagagctggagatgtatttgattatgatacaattgaagcagcaacaattagcaaacaagagtttaatgaattattaactgaaaaggatattcttcaagaagtaattacatgggatattgcagcaacagaaaaaagtacttctgattatacagcatgtagtttttcaacagtattacaaggaaaagtaggtgtagtgcataatcagaaaagcacacaaaaaaagccaggtaagttagaacaatacatgacaaggattatggatgaacattcagagtatgataattggattgagtatcagcctgcagctgcaggtaaaatagttaaaagatactgggaaaacgaattcgaagactatcatcctaattttattcgtgttcctaaatcaaaattaataagagcaagtagaactatacgggggatgaataatggacggatattatttgttcgtggtaaatggttgaaagatttcatgaaacaagctgtgaaattcccatcagagaaaataatagctgatgatgaaacaacacatgatgaccgtgtagatagtgtatcattgttacatgaaggtttatatcctcaaacaaaacctacagttttaagaaaaagaaatcgtagaaggagaaattaataatggttaaaatagttaaaagtaactttttaagagattcagtgattaaaagtgttttaaatgaatatgagattaaatctcaagaaatgagtaaagatgaattaacatatggtacagaagtaattgacccagcgtatgacccgttccaattagataagttgcgtgatattagtggtttgcatgatatttgtattactgttaaatgtgaagatgcaattttcacaggtaaaaaaataatctctaaagaaggagaagaaatacctgaaggattagatgattttttaaatgattttaattttgatgaggaaatagaatcattcctagaagatttagaagcttttggttttgcaggattagaactacttagggaaaaaggggagttgaaaagtgttaatcatgtaagcagtttatacctgagaatgtgtcgtgataaaaaacgtgttgtacaaaagatagggcataaagaaaattatttcaaattatatgatcctgacaatattaagcaattgaatcgtgaaactggtttgtgggatgataatattacagatgaaaatcgtgcaaatgatttaatctggtttaatcttaaaagtaatgaaagtcttgtttatggtagaccgaaatatttgtccgagttggatgctattttaactgataatgctattattgagtatcagcaagggcattttaaagcacatggtattccgaattatattattactgttacaggtaatgttgaggaaaaagaagattatacttttgatgattttgaagaggatttggaacatgagtttcgtgaagtgtccaatgagcctggaactgctttagttttcactattcccagtgaagaaaataatgttagtgttaatgttactaaaattgctgatgagaaaaaagaaggcagttttttagaactgtcaggtagtgtggctgatcgtattcgtcgtattcatcgtgtacctcgtgaacgtttaggtgattctgagtctacaggtattgctagtaatcgtactgaaactttgcttaaaaattatagtaaatctacagtagctacattgcaaaagaggatggctaatttgattaataagactattattcaaaaggaatttggaatatttacacataaacttgagtatttgcctgttaattttgatgaggaagataaagtattggatcgtggaattaaattactgcaaaatggtgcagtgactttaggggagtttgttaatcgttttggtgaatcttttgatttgaaaatgagtgaagatgatgagtattataattgtaggtttatgaataatcagtctttggataaggttttgtatggtgatgctccaatggatgctgaaggtaaattggatagtatgattgatgctttgaattctgattttaataagaatggtttattatgatttctaaaaagaaacttcagtatctgcttttaactcaaagattgcatcagctttatgtggttaaaagagatataagttttaatcatttgtttaaacatacgaataaagctgataaaagtattgattcttataaagataaattattaaataatattattgatggaaataaaattgggaatagtaaaaagattgcagagaacataattgatactgctttgcaaggtcaagctaatactttaatgaaaaagcgttctaagattattcaaggtagtgttgatcaaactgttggggattattctaagattttatcttcacgttttgatagtgatgcttataagttaaaagctaagattgaagctgaaagtaagttgtctgatagtgagattaaaaagaagtatggggagttgtatcgtaagaatgctaagaatattgttcgtgatgctttgcatactaatcagtctaggatgagttttttacatgctttggataaggggtataagtataaggtttggatgaatggtcgtgctagacaacatagaatttggcatcgtgctaactttattgagagtgttcctattgatgattattttattattactggtagttatcgtactgagatgatgtatcctggggatttagctggaggtgctgagaatgttgctaattgcagatgttggttaagctatactaatagtactccaagtaatcttaaaagtaaaagttcttttaatattccttctaattcttacttacatggtaagaataaaagtagcagtaatcaaaattctttgaagataacttctaagattaagaataagataattagaaccatatcgaatataggtaacaagattaaaaatacaggaagtaaaatcactgaaaatgttaaaagaaaaacagtaatgattaatatttcttcaaaaccaaaacaaaattcaaaaagagatttcagtaaatttaaattaaatgaatctatcactaaatttagtaaagctaaaaataaagcagtgaaaattggtaataaaacagtttatggtgttggtgaatcatctaaagataaattggcatttgaatataaatatggaattaaaaaagaagatttgacttctgaagagtataaattcataaaagcatattctgatgaaggatattatagtttgaataattatttcagagaaataaaaggggagctcaacccagttaagaggtggcgtattaaaagaaaatattctaaattatgggagcaggatttagctaattcaaaatattatatctcttttaataaagcaattaaatcttcaaaatcagtatttaagaaaggtaaaatattagaagaaagtcttgttgtagttagaagacaaaaaagtccaatgactaaatttgtagaaggagataattatcattcagattcatttttatcaacttctatttccgaaaatgttaaacctgaagaatatggggagtatattaattatattgtcattccaaaaggaattaaaattctgtatattgaaggaataactgaaactcctcaggagtttgaaattttgtttgataaaaatgttgatttaagattaatacgtgaaaaatcagagtttattgctcattgggaaatgatatcgtaatttttatataggaagttttatatataatatactaacaaatactggggttcattatcatggttgaaaaattgattcctaattatgaatttgttaaaaattggtctgaggatcaattaagagatttcattacaacaccttcaggtttacctcatagattaatgagtattgtacgtgaagttattcctaatattaatcgattaagattaattcagtgtattgaacatccggagtttgaatctttggatcagaatgaacgggctgtaactcatagattaaaatatgaagggaaacacaaagaagctagggaatatcatatacaatatgctttagattttcttgataaatatcctcaatttaaacctatggtcaaaattgttgaataaatttatttaacttttcgtttttttctatttttccactcctatatattgaagggggataaaaaaatatttttattttagtaacttaacatcatttatctttttttaaaatcctcctttcttttttactaaaaaaaactccaacaaaactaatttttttccaatataaaaaaatggggagtcaaaaaaaactatgattgtgaaaggtgcagtctgcataccaggaatccctgatgcaacaggagacatactggatgaagaaacaataagacaagcatcattaatatacaatcgcctgggattaggagttgatgtacagcacacactccaacctgtaggaagaattttagaatcatatattcttgaatcaccaaccactttcaggggaaacacttaccccaaaggatcctggtttatttctgttgatgtaactgatgaggaaatacaacaagcaatccgagatggggaatacaatggtttcagcatactggctgcaccatataaaagtgttgctcaaatgagtagaggattaggaggttaaatatggctttgaaatttaaagacattaaagattggaaaccatcaacaatcagtattgttgatcaaccatcacatcctatggcggtttttgaagtatatgaagatgatgaagaatttgtgaaaaaatatatcacaccagaagaggtggaagttatgacaaaagaagacaatggaaaaaataatgtgcaggtttcagaaggtattcttgaaaaattaattaatggtttagttgctaaatctgaacctcaagaaccaactgaacctccagcacaaaataatgaacctgtggaagatgaaaataaaattttagaagcactaggtaaaatcgataaaagattagatactatggatgcaaggataactaaacttgaaggtggggaaaaaccaccagaacctccaaaagaggatcctgttcctggagctgttaaaaaatcagaacctccaaaagatgatgatggaggagaagttaaagtggatactactattactgctgatggtgctgttaatccagatgctactgttagtaaaagtattgatcctgaccttgcaaaaggcaatgcttctgaaaaatcattccttgagagaatgggtaggaattcaaatggaatgacctggtagaaaaaaagaagatattatacttaataattaaattttttatgagaaggtttgatataaaatgacaattaaacaagtagaacaagcgttagctgataaaatcatgcataatgaagattttatccttaaatttgtagatattggagaaggaagtgggaaactcggtaaaggagttcttcaagcggaaaaagcagataaatacatgcaagctgttcaagaagaaacagcatttttaaacaagactaaagttgttccaactcacaatcataaaagagaattggacatgatgagttttgatattgaattggaagctggaagaatcagtggtacaccacaaactttaagcaatgaacaggacccaacattcactaatagggcttttgatgcagaagaatatcgtgctttaactggtgttcacagaactgtattatatgacagtattgagcaaaagaatttcatgaatactttaactggtcaatttggtagtgcaaatggtagagcattagaaagaacattaatctatgggaatactgcaagtactgaatctaatgttgcaacttcatataaagtaaatgatggtatcttgaaaaaattagaagatgattctgatatagatcaagaaacaatagatttaactgcaacagattccaatccgttaaaagaattccgtagaatgttggatttattccctgataaatataaaaatgatggtggggtagctgcatttgtaccatacagttttaaaagagcagtatggagatatgtagcagataatcatgacaagtatgctgttaatgatgtagttattactaaagatggggacatcattattgaggaagtaccattagtaccaattccagctttcagtactcttcgtaatggtttcactaaaaaaccagtaattttaactcataaagaaaacattcaatggttggcggatcctgataatattattgttgaatctgaatttgatttaaaatctaacaagtattatattgcttctacaatgtatgctgatattcagtttgcatggtctgatgcatctgctcttgcatacataaaggaagcataaactccagcacaacaactagtactaaaaatattggtgtaagtgttgatgatggaacaaatcctgttgaaggagctattgtaactttaacaaatattactgatggtaaaacttacacttgtaacggtactggtagtgctggaggctgtacaataagtaatgttccttatggagtttattcatatggtgcaacatgtactggttatgaaaactttgaaagcacaggtaattatactgtaggtgatgattcaactacattaaccattacaatgactaaaacataggaataatttatgttggatgaaaacaccttaaaaaaaatcaaacagtacagtggagctaataaaaatactgaagaattatttaatttagaaactactgaattagataattatattaatgattattacactgcaatggaatcatgggttaaaaagaaatatgatataccagataaaattcctgatgatgtaatacaaatcattattgaattaaccagtaacattattagaagccatgctgtaagacaggacttgggaattactgatcatgaaaattttgattttgatgaggcagtaaacaatattttcacagaagacattgaaaaaagaatgaagccttacattaaaaaatctaagattcatgttttctcaatctaaacattttttttaattttttataagagttgatgattttttatgatacattttgattttgattatgcgggatgggaaagactgcaagaaaaaatattacgggtacctccaagattaggtaaaaaggtaagttatggagcaagtaaagatgctaaaacttaccttcaaagtaggataaaatacaatcgttacaatcttttaactgcaataactgcaagaagggaaacagatgaaatgtatgttataaaagcaagaggaaaaccttcaggttatgaaaaatatgttcatgatggtcgtggaagtttctcagctaaaaataaaaaagccctgcattgggtggataaatctggtaaagatgtttttgtccctaaacctaaaaaagtagcagcattcaggggataccattattatcctcatgcagttaaaactactgaatcaaaaattaacaaatatgtgtctgaaacattaaaagaggtgggattatgaaagatttcatagaagcttatgataaactaatggaaggtttccaactggtcttatctgaaatgattgaagatggcactattaaacatttatctcttatgggtgtaagtctgggaacaccagaattaccttatctggaattatgggtagatgaaccatttaaaaatattactgatactggtttaagtgaaacctttgaaggagaaataatattatcctcacaggtgcttaacaataaaaatcctaagataggtattcatgaagctacaagtatagtttcacaggcagaacgtagaataataagttcaagattacttggagacttagaatttttcaatattaaaaccaaggatttcggatgggttccatatggtctgggtaaaaagaaaaatgtgtatagtgcaggtgtaacattccaaataagatttaaaattaagaattcaaaatgtgatggaggctaaagaatatggtaacagccgcagaagaactaaaatatttaagattagtaaaagaaggagaatttgcaaaaaaagaccttagtggagaatctattgatattgaaatatcagagatggatgtatctccaccagagcaatttacaaaatatgattcagtagtaagtagggattatcaatctggtgtagctgcttactatgtacctgaaaacagtttcagttgcaacttacaaatggaaacattagaataccttcttgaagcagtattgggaagaagagaaggagatattatctacggtacaaatagtagtatcttaccttcttatactgtgatggcaggatgtgcaacctacgagatggaaattttaggtatggtgatggacagtttaagtattgaagtagaatcagaattcttaactgcatcagcagaaatcaaatcaaaaatcaatagtaaacaaccattaaaaaaattatcagagtttaactttggaaaattaccattatcattttaccatatagacagtgttaaaatgagaagatttggtgaagatgaatggactgaaatgagatgtaaaaccaataaaataagtcttgaaatcaaaaacaatgttaatactgatgatgcaagaggaatgggctcaaggtttatgtgtaaaataccaagagcagctaaaagagaaattggtttaaacttaacagtagatgatactgatgaaaaatacttggaaatgtactggggaagtgaggaaggaccaagaagataccttgcaggagaatactttgaattaatgttctacattagaaatggtgataaaaaattcgaattatattgtccaatgtgtattatcaaccaaccatctgcaacaatgaatgcagacccagttaaatatgaattaagtattgtttgtttatcaaaaacagttgaatcaacaatggaccattataaaaatttagctggagcattatttgcaagaaaagcagacagtgatcccaacccaacttatgatgcaacaataaaacttgttgataaggaaggtgctaaattaacaactgattacacagtatcattaatgaaaggatccacaactgttgatgctgaatcttcaagtaatggtgaagtaacacttactgctgaagatggagtgtatgatatagagttgactggtgaaccaactgcaactaaagtagaaccagcacatattttaattgatggtgcaagtaaaacaaaaacaatcactgtttacacagattaaatgaaatgagaatatgattattctcattcaattactttatttaaaattcaaaaaaaaattattatataaaaatgtgatatttatgcttacaaaagaaatgatcatcggcggaatcaaaaacacaaaaataatcgaactaccaatgtacgataatgaagtagcaataagagaaataagcgaccttgaatacaaccaattcacatcagcataccgtgatgtaggaaacttcgacatgatttccaccatcaaagcaaaacaaaccagccttgcagaagacaccacaaaattcaaaaccagtctcgcagcaatggaaaaaaagaaatatgatgcaaaaatgaaccttgcattaaaagtattagacaatgcagacaatcctgataaattcaccaaaaaagaccttgaacaattaaaagcaggaacattagacttaattgtaaatgaagcattaattttcagtggtttagataaccttaaatcaatggataataatatagcagaatttcgtgaagaagaatgaaaacatagctattgaagtagtaactcttcaagacatcggttatatgttagcagaaaaccaagcagatttaactattaggcagaaattattcttgaatcatgcagtacccttagttcgtgataaacaggataaacaatcttcaggtacaaatcatgcttcacattctctaaaagaccgtgtcagaagaaaaaaacaagaaattagcagaggaatagaataatgagcaataatattgtaaagttaataattgaactggaaaaccgtgttaaagctcaattaaaagagatacaagcacaaatggagcaagttcaaaaagcagcacaacaagctcaaaatgcaatgcgacaatttgattcctcaagtatggataaagccaaaaactctgctaatcagttagataaagaattaactgaagttacaaatcgcactaattctacaaaaacagcattaaattcaatcaatcccaatacaattaatcaattatctaattctgcaaaactattaaccacttcaatggatacatcgatgaatagtgcatatagacttaacacttcaatcaacacaattaattcaggtaatttactcacagcatcatctagtgctacaagattatcttcctcgatgaatagttcaaataatagtaccagattattatcttcaagtttaaaacaagcttcatccagtgcacttagtttaagcagtggaataaatagtataactggatacacattaacagcaacttcatcaagtgcagcacaattagacatggcattagatcgagctagaacaagtgcacattcaacagatgcagccttagattcaattgatggttcgggattcagtagaacaacagcatcagcagaactactaaaagcaatattattagttttaattggtatacttcaacaagtaaattcattgctaaacttccatactactggtttagataatgttacaagagatgcaagagaagcacaattagctttagaaggtttaagaacaagttcacaaaaaacaggaactggtttcggaggacttgaaaacggagctaaaactgcaggtggaggtcttggatttcttagaacagcagcaagtatgactgtaggaatgattggttttgaccttgtaaacagtatggttcaaggagcaagagaatcaataaatgcagctgcaagttttgaaagattcggtcaaagattaggaatgactgaaggagaactacaacaattccatggggctgttgacaaaatgcaagatagcttcagaaaagtagatatgaatgcagtaggtgcagccgcattagaaatgggagtgaaattaaaacttcctaaagcttcaatggatgaacttactaaaacaactgcagtaatgagttcagctttcgtaaaagaaggaagaacacaagaagatgcaatacttgcagtatcagatgcaatggatggccaattcagaagactgcaggaaataggcatatctcaagacatgctcatgaaaaatggatgggatggagatataaataataaaactggattactccaagcaatgaacaaaacacttagcgatatgggttttgaacagtccgcacaagaaattgtaacattagatgatgcttgggcagcattaacagtaactggaagcaaattaatacaatctatccttgtcccaataactcccataattataacagttgttgaaatgattacttggatggttgaagcattacaatcagcatggtcaagcatgcccgattgggctaaagcagcagtaactattggtgtactttcaacagctttagttgggttgggtattgtaattcttggttcagtaattcccgcaatagctgctagtgcgactagttttgtaacttatattgctggagcattaggtgttgaaatagcaaatatgggtttggcggctagttttttagcagttgcaggagcaattttatcaaatccattaacatgggttgttgtggcattagttgcaatagcagtagcaatatatgaagtaggtaaagcttttggttggtggaaagatgtaggaaccatgctcgaagccataaagaataatattggtagattatgggatgcattcataaatcatcctgatgtaaaagcaactatcaaagcaattcaagatgcatggtctgatttgaatgaatctctcaaaccagttgtagattggttgaaaggaatatgggatgaaatattcccagaaagtgcaaaaggtaaagttgatggaacaagagcagttatcgatgcaataggagcagtatttgaaagtttcaaagttagagttcaacttgcaatagacatactcaccataatatgggatgttttcaatggaattgcatcattcttattaagtgtatttggtccagcatggcaacttgtacttgatattgtaactccattattcaatttattcatgcaactggcaacaatttttagccagttaattactggtcaaataagtcttcaacaagcaattgcttgggcttgggcagctattcaatcaacaatcagcacaatattatcaaatgtgattaatcgtgttgttagttgggctcagtcaatgtggaataatgcagttaatactggtagaaacttccttacaggagtagttcaatttatccgacaattgccagataaaataaaaatgtatcttttagcagttgctgtaagagtaataactgcaggagcacaatgggtaagtaatgctaaaacaaaagcatcacaagtagtatctggagtaatgtcctggataaagcaattacctcaaaaagtataccaggaattcctaaacataggctcaagaatactatctgcaggttcacaattagttgaaaatgcaaagcaaatcggtaaaaaaattgtagacggaatgctttccgcaatgggaatacattcaccaggaataatccaagaaaaagtagtactagaattctttaacatgctacaaagagttaaagacaaaggaaaatcagcatatgaagcaggtaaaaatgttggaaaaaacattgtaaatggattcaatactgctgatgttgaaaatgcattaaataatatttcaacaactatcacaactccagtaacaacaaacactgaagttgaaacagatagtgcaaatgttgatttaagcaataataattcaggtacagaagaaactggagaccaatataatggtcttgttgaagaagtatcattagctagtgaaagcatcactgcaagcaacaatatgatcggaacaagcttttcaacattaactgcaggaatagcattaaatgcaggagctattcaaatgagagttgcaggagtagtaacaagcttccaaacaacacgtaatggagtaaccactgcattaacaagcatgagtaattcaaatactcaagcatggaacaatattaaatcaacaacaacccagaacttaaatcaagtacgtaactccacaatagatgtaacaaataaaatgactaatgcatggggagtaatgaaagacaatattgtttcagctgcaggaagcatacaaacacaatcatacaataaattcagcagccttcatagaagtattgcaagtttctataatcaattagccaatgcacatttcagtagtggactgcctgcaggcccagcaactaattcaacaagaggattaattggaggcagaacattacctggtggaagcattaactttggaaaatccacaaaaggcacaatagcaagttatgctgctggaggattaggacaaggaaaaggcagagtaattgacactaattctaaagtaaaacatcctcaaaacaataaaagcaaatcatggttaaatcttttagattataatttaccaacaagcgtaattaatgatttggcaagagttaatggttgtgttaatccaaatacttgttttgcaggaattcctgatactaatgtgaataaaataatgaatactgcatacaaatggaggatagcagacccatggttccttggaattcaaataccttcagattatcatgtggaagatttccgtgatggaaaacaaccgcaattaaatcctggaaactttgaaaatcttctaagaaaaatcttaactgcaagaggattccaaaaccctggaacttatgaattttattataattcaagatatagtaatcagcaagtttgggatcaagtaagatgcaactgttttgatggtgcagaaatgataattgaaatagcatctatgttgggattatcaggacacatgattcatggatcatggaatggaataggccatgtagcagctatggttaatggtcaaatatatgatatgacacaattccaaaaacgtggaggaatattccgcggaggttctggagttagttttggttcagcaagtcctggaggaagttctaaagatgtattcggaatcattacagatggaatatataatattattgatttaatgaaaacaaatcaaaatgcatacttccagaatattgaacataataggaataatactactgctgataatttagtgtcttatacatctgatgatgtgcatttaacaatagatcataatcttaatgttactgttgaaggagaagatattgatgaaaaatcaataatcacaactttaaaagaagtgataactgattccaaattaattgaccgcattgctgaagctttaattaaaagagacaatcgtattaaaagaatgagaggttaaaagataatggaaactataaaaattaatcctgaagaatgtgaaatcttcggtaatatcataagtaacaaacatggatatctggaagataaaaacgattttgaatcacataaatgtatggtttcattaaataatgtaaaacctgatgaatgggaatcttacaatgtatattcatttaaattaagtaaagatgtttcattaactaacagatttagtgaagatattcaatattgtatggaatctagtttatctagtttgtttgtttgtgaacattttgattttaatttcaacccatatagtgatttttttgaagttgttccttttagaaatggttatactttgaaagttaaagaaacatatctctcggagaatgttgatttaacttctcctttttttcttttaatccatcagaacaatcaaggagtacacatacctgatgatgcttccagtattgtgttttcatctaattatgatgcaaaaaacactattgaaagcatacttgttgggtttgtatttttcgataaagatggtaaattaattgaaaatcaggaaattatggatattgctaatgaaggtatgggtaataaaggaagatgtgctattaaaacatcaaaaatacctgctggtgctaaatatgtgagtgttgaatttgcttttcctgatggggtaagtaaaggagattacattagctttcaattaaactgtttattgtttaattcagagtatgatggttttattaaaaattaaaaaaaatgatggagggattattaaattgcctagtattttaagatatcctagtaaagttcaaaatatagaaggaaacaacataccttatcgttcatgtgatcatattgaaaatattacaaatgatttaaatactgtgggacattggggttatgcagatcctggagcaaaatataaaaatgcgattgctggaagaaatggttcaagaaaacatccatcaaccatacgtggatatgattttaaatatgatggattaattccagattcagctaaagtaacgagtataatagtacaatattcatatagaaaattagcatactctgcacagataagtcaaactgcacatggaagtttttcaaatccagaaatcatattaagtagtttaaacctgtcaaaaacaggtaatgccccacctagaaataattttggagaatatgaagttcaatttaataatttgaatctaaaaggaaaagacattaacactccaaattttgatgttaaatttgatttaccacaaaatacatctacaaacccatgttacattgaaatgaaatacttaagagtaattgtagtgtatacaactggaaattatattccaagcattagcattgaaccaaatattgttagttacggtgaaaaagtagctgtaaaatgcacaatggttgaaaccagtggaacaaaaccttcagaagaaatatcggcaaacataaagataatcacaaatggagactgtgaaatcacatatgattcaccatattatgactggaccacaggcatatggagacaagcaacaacaaatggtaaagcagaattaatattctatgtaactccaacatctgaaggattgtttacaatcacacttgatgaaaacaatagtggccattcaacaaaaacaacatttgtagtagaaaaaccccaattggaagtatgggatttctatgcaaataacaaagaaattgaaattagtacagatacagttacagatttaacatacttaaacataactttaaaaactgatgctccattagatttaacactaaatctgaattttggaggattaactgtaaaagaacctgttccaggattatcaaataatattttacaaatttcaaaatcacaatggcaaaaagatgatagtggaaacattgtttttgatacaaatattcctttatactctaaaagtagtggagagcataatattgaaatgaccagtccattattattaggtgttttcacagataaagtgaaagtaaacattcctgattcatataaatcctattattcaatattgaatttatcagaattcacattatcaaaccttgaacatggtgaaacttatgttttctcagcattaggaagactgttaaatgcttctaaaattgaaaaaggtttgaaaaacttaagagtttgtgttgtaaatggaacaacaaattcatacaccaatcaaatcagtgttaaggacatatgggaagagttatcctgtgagtttacatatgatgcaagtaaaccaatctatctaattttttatgggaatttcatagattttgactatggaactgtagaatttggtaatttatctttaatacttaaagaaagatatgcaggttatgaatatccagtattggctttatctccaaaaagatatttgttaggtgatgtaggcagcactgcaaatttattacttgaacctccagagttagctttatctacaaaacatttctttgaaggtttcaactggcaaggattagaaaacaataatgtactgattcatggaatagaaataactggagacataagtgttgaagaatcaattaatctaatttgtggtgttggaacattagatgatgatgaattagattactatttagacagcataaacatcactagaaatgacactaactttaaattcggtggaaaattccataatttcggcattccatttccagaaatcaacacaatattaaatgatttaaggtttttcttacaaattgatgatgcatttgacaatgtcactcaagtccaagtcgaaatgaaaaatgtgcaaatcacagtatattattcaaaaaatagtggagaagactgcgatttctatattaatggtgttagttgcaaatatttccttataagtatgagtcctgaaacagaaatacctcgtggagctaattttgatacagaaaaatataaaattgaaggagcagatgggaaataccctataagagtcaatgttgatgataaaaaaatcaaattaaaattcagagtttacggagatgattttgaagaatcaacagaaatcatgaaatatgtaagtgactacctgtatcctgaaagagacacattagattcaccaattctaaaaagtattagtttctttttcgcacctgaagaatgttttgattactatatagaagattcaattgatgcagaagcaatggttggaggttatgattgtgaagtgaacttaataatccctagtggtttaagtagaaatattaacccattaagaaaaagtttcgcaggaacaataaccacaattggaaaagtaaaaccagacattattttgtataaattaagtgaagatgaatcaacaagcatacaaataattgaatcagaatctggacaactaatgaaacttgaaggagagtttataacaaacttacctgaaacaacaaagattaaaattgattgtgaaaatagaaatgtattctatgaaaaatatagtgaatggttcaagatagatcctaattgtattagtgtagattctagttttttcatattggatcatcattttaattttgaaaacagtatcaattgtaaagtgactgatgtaatttactatgaaaaaggaggataaaaagtatggttgttgttttagataatcaagaaaatattcttcaatttttagatactgaattatcagaaatacatattactgatgaatatcaaggatatgaaacattaaaactatcacataaacttacaaatgttaaaagagacaagcaattattcaaacaaggaaacaaaatctttgttgataattgtttgtttgttattaatagtgaatgcacctttgattatatagacaaatctattgatgtagatgcagaagaaataattgtagaattaaacaattgtaaaccattctatatccgagatcccaattatgcttcacatgtaaatggaaatacaatcattatcagtaaattattcctaaacaaattactgaaaggatttttcaatgttacaaaaacagatattgacagtattgattatagtaaaagattaatcaatgttcaaggctcaataacaaaatacaacttattaaaagctattgaaaaacaatcaggattagtatttaaaacaaattattctttaaaaaataataacattataaaagaaatacaattactaaaacctgcaaattatggagtaacacacaataaaattgtagaaagtgttgtaattggagaaaatactaatgaattatcatatagtagtgatgaaaccaaaaatgcattaggtataatgccagtaatttcttcagaaaatactgatgaagtagattattcaaaaatacttagacaattttacaatcttgacgtaaacaataatattccaccaacattatttgaatatgatttttacatacaagacattattgattgtgctgaaaaactattagtacttcttgatgttcaaaaatacttcccaaacaagtttgaaatatcacatagtgaaatatatgaagattcatcaaaaaacaaagtctacaatgttaaaataggcatgggacaaatgatacttctacttgcagaagcaataatcaacactgaagacaataactctgaaaacatttcacttaaaattgtagattgtgcagatttaccatcacacagccatattgactgcatcataaaacaggatgaaataatacaattagcaagaataatcaaatcgtactgcataactcaaacaaaagcaccaaacagcttatcaattacaggtggaagactaagcttccaatatttgatatatgttcttgcaaaatatttaacaacaaaaaaagatgttttctttaattctaatgaactaaaaataatagacactgtttctttaacatttgtacaagaaaatattcactatataaaagattatgaaaactacgaatacatgccattcatgtacacacaaaatacaacctcttcaaataaaatcccaaccattacaccacgtcaaatcccaggatgtactattttagatgttgaaaaatatatcagcgaatcataccctattctcaaaattaaaaaaataaaaggagcatccacactaggaattgaaataactaatcagggaatagcagatgatgatcccaatacttcaatgatatatttccaacaaccgaatctaattcaggatgaaagcgaaataactattgactacaaaaataagtcaataaaattcatgaaatatgttgaaaaagaagtagaaaaacaggtaactgaaaatgtcacaacaggagatcccaacacaataaccgtaaacatgatgccatcatgtggctgttgtgcaggaacagcatataaaagatacacaaaaacctggaaaaactactgcccaaactgtggcaaaactggaacattaaccgacaatcctaaaaaagtgtacgaaggcgaaataacttgcagcatgaaaaaaggaggatgtgacgcagattactgcggatactgtggaggagacaaatggggtcatggtaaatgtaaaaaagttaaattaactcctggagaagcagaaacaacaaccactgcaacaaaaacagtcaaagaaaaagtaggagaatataaagaaataactgcagaatatactggtgatgaaagtgattcaaaacaaaatatagtaaatgtaatcacaaaacaatcaaaattcaactactggtacggcaacgtaactttcaaactaaaaggatgtgattttgtatcattaacatgtgatacaacaaaactttttgaattttcaagattcccctatgtaaaaccaagaggagaattatatattcatgctttaccaacacttgtagatttcaattatctcacagtatgtgattgtaatccaaaattagaaccatttgaaactagcgaacaatcagtagaagaagtattgattgggtgctggcaaaaattaaacggttcgggagataacacaaaatggttagagaaaaatgaaagcataaaagtagaccttgtagaaacaccaggacacaattataatgtaggggattttgtatatgtaagattcccagattcagaggtgttcaaagcacaaataacagaaataagttataatccttatctaaatggtgataaagagattaaaataggtaatgttaaacgagagagtgtaatatgactaaactaactgaaaatgaaagaaaagcattaaataatgcatgtgcaagattaagagaaacaaacctaggcacaaaaataggaaacattgaagatttcctagacatcgacatattaaagacagatgccaatacagtaagtaaagccattgatgaattgttcgacaaatgggcaaacccattattaaatattacagtacctccaccaggttttttcactttagcaggagatgctgaaggaaatctatggtgttattgtaatgatgaaaccaaccctccaatatttgaacatgatgaaactactggtgatttatatttaaatatagctagtgaagatggagcaaatagttatcaggtacatgttggcaattatattgctgttaaacatttaaatgattattataagaaaacagaaattgattcaaaattaggtggaaaatcaaatgttggacataatcatgatgaaaggtattatactgaaactgaaatagatgcgaaagtaaataatattaattctcagataaattcattaattggttttacagcaacaatagtaaattcattaccatctacaggggaagttggagtaatgtatttaaaattaaatacttcagcttctgttgagggtaatatttatgatgagtatatttgggttaataataaatttgaaaaaattggttcaactgaaacaacagttgacttatcagggtatgttacacaaacagaaatgaatactcaattagcaaataaagcaaatgttaaccacagccatacaagtgatagtatagaccttgatcaggatagtgatgatggcatgtgggtgtatgaatatggaattaatagacagtcaagtgtaaatggttttgtttatgatcatgacaaaaaattggaaaatattgatgatggtgctaataaaacagttgttgattcatcattaagtagttcttctattaatcctgtacagaataaaatcgtgactaatgcgttgaacggtaaagctaacaatagtcacagtcacagtatcagcaatattactgatcttcaatcaagcttggatggtaaaaccaatattaatacaagagattttagtttctttttatctgatgttatattgcctgaaggaagcagtattgcagataaaagtattactcactcacatgttcacgataccatacaaataccctacaagcagagcactcaagaagggtatcgtacagatacttttaatcttgaaaactttgacttatttttatcatggagtcctaacagcttaggaactaactctaatatacaatttatcttattgaacccagaaacaaacgaaaaaataagtgtagtatgcacccctcagcaaggccgtacatgggttgatatagtttgtgatggtggaacaaatagaacttacgaccaaaagggcacatatgggaatgttgcaggaaaatattttggtttaattttcaaagtaagacatgataagttaagttatgtattatgtgatgattctcaaacaattaacacagccaataagagtcgaggagcagaaattaatcctaataggtggagattaattacaaaagcaggtgcatggagtagcggtacaagtatgagttataatgtgtctggtgtgaaaatgaaaataggagtataattaaataaatgaagaggttttttttaatggttaaaaaaatattactggggaatttcaaaggccctaaaggcaatactggaccaacaggaccaacaggtcctaaaggtgataaaggaagtaaaggtgatactggacctgcaggaaaagatggtaaagatggaaacattgaaacacccaccactattttaaataaattaaaagaagtggatggagcaggttcaggtttaaatgcagatttggtggatgatgaacattctgaaacatttgcaagacaagaaatattagaaaccacaatggatgatttaaaaaacactagattagtaatgggtcgcttatcagaccttgctggagaagatggagttaaactagaattaaattatggaaattctgtttacggtaaaattatttcttccaatcctgaaattaacacaggggaaaatgtggtaattaattttattgtaaatggtgtttcttatgaaagaacaactgatgctaatggtagagcaatactgccgattagattagaccctggaagttatatgttggaaggtattgtaaaaagaggagctgctggagagaatcctcgtttagaacaaacaagattactgattgtacattaaaaattgataggaggattattttggaatgattagtgaagaatgtgaaaaatgtgcattttatgatccttgtgataaagaggttccttgttgttttgaagatgcaataataaaatgcagtattttaaaggaatatttagatgatttaaaatttaaaaaggagatgaaaataaatggttaatgaacatattagttttacaaaatacacttatttgatgaatagaattgcttattggttagtgaataataataaaaagtttaatacaagacaagtgtatagttacatgaatcgtgtagctgattatggcacaattataaaagcaattaaagagagaggtacgaattatcaacaagacagtcttattgcagagtttgttgaatgtgcaatatttgataataaagatttaagtttcctcccaaattatgtgtctgatactgatggaacaaagtattataagaattgttatgttagtatggctaatcgtgtatcagcttatgaagtattaaatggtgttagtccagctattgtttatcttgaagacccacatggcaacggaacaaccagcgacaccacagacatcacattaaaaaggttcaccgacaaatttggtggtgtaacagatatagactcttgcttgaacaaaatccgaggaagaggatatggatattattataactccaaatataatactcaggaaactattaataagatatataataagcaaggagttaattgtactgattcaagtcaattattttaccgtttaggacttgcattaggttataatgtacaattcattcatgtacgatgtagaagtgggactgggcatgtaaggctcagattgaaacattctaagtatactgggggttcttggatttatcgtgaccctgcagcagttttagatggaaacagtgtttcaagtaattggtgtatgaatggtacgattttagcgtatgatccagcttggattttctcagatttgtatcaataagattgttgttttatcaacaattcttttatttttttataaaaataagtagtaaaaaatagaaacctttatatagtatagtaaccaatataataatagaactacaaggaggtgaaaaacattgataaaaatgacatatattttctaataaatatggttatggggataatatcaataatattatccctaatgggggattaaaattaatccctctttaaaataatttataataaattatatgtcattactaatatttaaataaaagggatggggaattatgataaccacagtattaacattaattcaaataattttaataatacttgcagtagtattattatattcaatgaaaaatgaagaaaacaggacacgaaacgcaataatgcttataataaatattatagtcatcattataatccatttaatataaagactataatttttttattatttttttaaaggaggaattaaataatggaaagaagtactataaaacttgaagtaaatttaattaacaagataaaagaaatacaggaaatcaacggatacaaatcagttaatgaaacagtaaaacatttattacctgatggaacatcaacacctgaagaatacatacaagaacaaccagcattcacactaataaacaaaaaaacagttttaaatgtatcatggaatgaattaaaacaatcggaagtaggcacacaatggagtaatggggaaaaagcaacattaatctataaagataaccttggagcattaatcagatttgaagatgaatacggagaaatttatcttaattacttccattttttataaacgcagtacgaggataagggtttaattttgggggataaaatttaaaacctatttttgatataatattttaatagattagaatgttttaagtatgttataattaactcgttgtagacacgactgttgaatttaggtaaacaattataagttatgaaaaatatagtaagtgttatatttttataaattatttatggagaatatttcatggaaaaaggaactgatgttttaaaagaaggcttcgctaaaatgacaaaaggtggagttattatggatgttgtcaatgcagaacaagcaggaattgcagaagatgctggtgcagtagctgttatggctttagaaaaagtacctgcagatattcgtgcagctggtggggtagctaggatggctgatcctactattgttgaagaagttgtagatgcagtttcaattcctgttatggctaaagctaggataggtcatattgcagaggcacaaattttagaaacattaggtgtagatatgattgatgaaagtgaagtacttacacctgctgatgaagaatatcatttaaacaaaaaagaattcactattccttttgtatgtggtgcacgtaacttgggggaagctttaaggagaattgatgaaggtgctgcaatgattcgtaccaaaggtgaacctggtacaggaaatattgttgaagcagttcgtcatatgagaatggttttaggagaaatcagaactattcaaggtttagatgaagaggaattatggaaatacgcaagaaaaatagaagctccaattgaccttgttaaagaaaccgcacaactcggtaaattaccagtagttaactttgcagctggaggtattgctactcctgcagatgcttctttaatgatgcaattaggttctgacggtatttttgtaggttctggaatcttcaaatccaataatcctgaagcatttgctaaagctattgttgaagcaactgcaaattatgataaacctgaagtattagctgaagtttcaaaaggacttggagaagctatgaaaggtttagaaatgtctacattatctgaagctgacagaatgcaagacagaggaatttaacttccttatttttactttttttatgacaattgtggttattggtccactagcacaagaccagattattactccaaattcaaaaacatatgctgccggaggagctagctattttcaatcatttgtttttgaagaattcaacatagattatgttgcagttgcaaacttcaataatctggatttaattagggattttccaaatttaggtaatttaattcctattgttggcgatgatactcattattttattaatgaatatcctgaaaacgataatttggacatccggaaacaatacagcaattttgcaaacattccaattttaaaagaccagttggagtttgtttttgatgatattttagaaattgatgcatttgttttaaatccgttaaataggaatgattttcctgttgaaacgattgattatttaaaaactttcaatgtgccgatttatctatccatgcagggttttttacgcattcctgatgagaaaattgatgataaaaattattcaattaaattagaaaaacctgataatttggatgatattttaaatggaattacagctatatttttagatgaatctgaatctaaacttgtatttgatgatgataattacagcagatatggcattgatgaaattgtaattacaaatgcaagtgaaggttccagaattatttgtggtaatgaaattaaaattgaagcctttgaagttgaggatatagcagattcaacaggctgtggagacacatatatggcagcttatattataaagagattgcttttagattcaccagaagaagcaggagaattcgcttcattaatagctagtgaaaaattaatgtcattcggaccatacaaatctttaatataactttaatttagttatactatgattatggatatttataagaatattactcgtttttttaagcttttatttaaatttcatttaattagaaaactttattaattaatgaaaaaataatgatatatgatttctgaatttttttagtttatataataaaggggcaatatgttaaataattcatcagataaaattaaaaaggagtttgaaaacttacgtaatgagcttttagatttaactttaagaaatcagcttcttaattttaaaaccagagccagaacaattactatttcaaaccaatcaccaattaacatttaccagacattggttctgcaaaataataaaatgtattttgtagctaataaaaaagagaaaaaagaggaaaaatccggattttcaatttgggatcatgctccatttgatctttcaaggtttactgatggagataaaacattatctacagatttgactcctaatgagcttcaaaaaagattgttttatattaataaccaagctaaaacaatgttgcaggaacagggttacaatattctttatttggctgttggatttttggaatggagagataataccaaaccaaaacaggtaaatcatgctccattagttcttattccagttgcaatggaacgtaaaaaggtaggcaaatcctttaatttagagtggacaggagaagacattcaaacaaatatctctattaaagctaaattaaaagaaaatggtattgattttccggattttgaatttaaaaaatatggtgaagctattgaccattatttaagagaagttagggattctgttagaggaatgggtgaatggaaagttaatactaatatagctttaggtttcttcagttttactaaatttgtaatgtacaatgatttaaatccggaagcatgggaaaataatgtggatttaactaaaaatgaactgatacaggctatatttaatccaagtgttaatgataagaaagcatttaaagaggaagacattgattctcagttggaatactctaaaatgtatcaggttttagatgctgattcttcacagattgcagctatccaggatgttaaagcaggaaggaatctggttgtagagggacctcctggaacaggtaaatctcaaacaattgtaaatttaatagctgagcttcttgctgagggaaagtccgttttgtttgtcagtgaaaaaatggctgcattagatgtggtaaaagacagactgacaggtgtcggattaggcaagtttatattggaactgcattcacacaaaacaaggcgtaaaaaatttctgaaggatttggaaaaagctacaacagtaaggtctcaggagccaataaatatagatcagacaataagaaaacttgaaacattaagacagcagcttgatgattatgcagaaattattcataagcctttatatggagttcaattatcagcatttcagttatatggtttaaaagaagctgctgatgagcatttttcaagaagtgaccgtataattccattggtcaggtttgatcatcctgaaactttaactttaaaggatttggatgatattaccatatctttggaaaacttggctgaactgtatcaaacaatttctaaggaaaatccgtggagtaaatgtgctccaaaaagtttgcttcctgcagatttaagggaaattgaacaattgattaatgatacattacatgctttagatgactttttagttgaaaggggaagagtttatgatatttatgggattaaaaaaccggaaacacttaatgaatttgaaaagtctctttcagcatttgatataatcagttctaaaaattctgaattaattgatggggatatattaaaatccggagcctggaataataacaatgatgatgcttatagattaataaatgaattggaaaaatatcaaaaagtagccaaatcattagataggtttaattcaagcatattttctgcagacattgacagattaattggcgaagttcgggaaagcacccataagaaattatccagattatttggtaataaacctcatattgaactggttgaaagatattataatgttccagttcctaaatctcctgaagatgttttatttgatttggaacaggcaaaacaagtaatagctattaaaaagcaattggatgcaaatgagtcattagctcgcaaatattatggtgattactggcatttaggtgcaaatgtcaatgatttaaaagaaataacaaagtggatgaatgaatttatatctttaacacgtgatggaatcttttcacaaaatactattgatattttatctaatgatatgttcagcataaatcctaaggaagatttaactgaatatattgaatcaggaaatttatttgaaagtgaacttaaaaaattagaatccaaattaaatcctagaagtaaactaatctttaaaagagatactggtgatgttgcttttgagagatggcaggaacagctatataattggagaggacagttatccagtcttcacttatggtctcagtatttaaatactaaaaatgcttgcagaggaactgactctgagcagtttattgattcaattgaaagaagagacattaaaaaagatgatgttaaagcattggttcaaggaaactttgcagattcattactgaatattttatttgttgaaaatcaggaactggctacatttatcggagaattgcatgaaaacagaataaaagagtttgaagatttggataaaaaaatattgtccctaaaccgcaaaagaattttccaaaaattaaataataatattccacaaatatttggagctactgaaaacccagaagctaaaatacttgctggagaatttacaagaaaaagcgggcacctgccagttagaaaattattggaaaaagcaggaggaataattaaaaagataaaaccatgtttcatgatgagtcctttatctgttgcacagtatcttgaccctacaaatgaagaattgcagtttgatgttgttatttttgatgaggcaagtcaggttaaacctgaagatgcattaggtgcatttatgagaggtaaaacagcagttgtaatgggagatactcagcaattgcctccaacatctttctttgatcaaatggcaactggtgaaagcgaagaggaagtggctacttcattggatatggaaagtatcctccatttatgtaaactgtcattccctgttaaaatgctaaaatggcattataggagccgtcatgaatctttaatttctgtttcaaacaaggaattctataataatgagctgttggtatatccttctccatctcatgatgatcctgaactgggattaaaattacattataatccgaatactgtatatgatagaggttcatcatctgcaaaccatttggaagctcgtgatgttgtaaaagaaattttcaatcattttgacaaatatggggatactaaaagtttaggtgtcggaacattttctgttgctcaaaaaaatgcaattcttgaagaattggaaattgaacgtaaaaagcgtcctgaattggaaccattattctcagaaaataaggatgaacgtttctttgttaaaaaccttgaaacaatacagggggatgaaagggatgttatcctaataagtgtaggatatggttatgaccaagcaggaaaaatgtctctaaatttcggtccgttaaatcaggatggtggggaaagaaggttaaatgtattaattacacgtgcaagggaaaaatgtgtagtattttccaacttcaaggcttatgatatgcatttaacagccaatccgccatatggtgtaaaagctctaaaagaattcctgtcatatgctgaaaacttgacattgggagcatcacaaataactcagcaatccagtgaaccgtttgaagatgcaatagctagtttcctggctgaaaatggttacacagtagataaacaaattggatgtgcaggatttagagtggatttggctattgttgatgatgaaaatcctggaaaatatattttgggaattacaactgatggaaaaatgtatgcatcaagtaaagtagctggagatagggacaggttaagggaacaagtcctaaaaggtcttggttggaaactttaccatttatggtctacagactggtataggaatagagacttagggcgtaaaagattacttgaagctgttgaagtagctattagggaaactcgtgaagaagaaaaacgtaaatcagaagaagctaaaaaactggctgaaaaaaggaaaaaagaagctgaaaagttagctgaagaattgcgtattgcaaaacaaaaagagcttgaagaacaaaaagaaaatgaaaaatcaactcctgatattggggaagatgaaaatatagaagtcatacctcctaaagatgatttggactctggtgaaaataaaactgatttcgataatgttgatgattatttatctgaagaaaatgatgatgaatcagagtttagtgaagatgtgatttctgatattgataatgatgagaatattgaggttgtttcttctaaagctgacagttctgaatttaatgagaacgcagtttctgatgttgatgttgtttctcctgaagatgacggttctgaatttagggaaaaaatggattatgatgatgttgatgttgtttctcctgaaaatggtgaatcagactttagtgaggatgtagtttctgatgttgaaattattcctattgaagatgatggttctgagtttagtgaggatgtagtttctgatgttgatgttgtttctcctgaagatgacggttatgaagttaataatgattctttaaaatctaaaaaagaagattcatttgaatctaaagaaaaaacttatcaaaaatcttcaaataataaaaataaatctattaaagacgaagacaaatctaaaaagaaatcttctttatcaaaaggttttggtattagttcaattttcagatctaaaaagaaaaatatgcaggaaaacactggaatggatgatattaaatttagtaaaaatattgaacatgagaatgaattaaatcttaaaaaggatactgcagattcaaaacccgaagaaaaagcgaaagaggtaaaagttaatgataaaaacattgataataatggtataaaatctaaagatgatgaatcaaacacttcgaaatctgaaagtgacattaaattagaaagcaattcggaagaaattaaatctcaattaagttctgatgaggaagcagattctgtagaatcaaatgataataaatctaaaaacagttctattaaaagtattttctttgataatgaaagactggaaaacaaagaacatggaacaatagctagtgcgattattggcaaatctaaattggaagaagaggaaattgaaaccgtaggtggtgaaataatggagaatgaaaatcctaagttacataggccaactcctaaagataaatatgttgtagaacctgaaattgttgatgaaaattcacaagaggacgaggaaaaattatatgaaaatctgaaatttaagtctaatgtggatttggatgatgaagatattcataatgtagcttctaatattgtggcaaatgcttttgaagaagtaatttcagatgttaataatgaaaaagacaatgaagcaaatatcattgatgaagattattatcaagattatgatgatgaaaatcaatatgctcaacaagatggcaatatttcacaggaaacatcagatacatctacatcagttaatcaaaatggttattatcagggagtaagtggcattactaatcctcttaaaaagaacaatgtttaccataaaacaaatgacagtaaaaacaaatctgttaaagattctcttgttgatttaaaaaacgaagtaaaatatattaataaatcattaaaagaaattgaaaatccaacacctgcagaatatgtagctgtaattgacagaactgaagagtatgatccgaatgattacataactcctgaacatgatgaagatgaatatgtgttttcccaggatgaaacagaagaattgacttttgccgaagctgaagaaaaaaggtatgaacaggaaaagttaatggaagcacttaaaaaagaaatagccagtgatgagaatgttatcattcctattcatgaagaaaaaagaaggcagcaaattcaggatcaggctttggaggacattattcaaacagctaatgaagactatgctgaaattgaaaaagagagatttaaaaataacaatacattaaaagcatttgatgacaagaaacttccgggaaaagttaaacttaaggatgaaattgtagagtataagcaggctgaagatattggtttaacatcacaggaagacctgtttaaaaagtctagtaaggaagtagctaagtctattgataaaattgtggaagtggaaggtccggttcacatcagtgaagttattaaaagggttaaggacagctgcaatatgaaaagagctggggctaatttgaaaaaggcagttaatggagctattagtgcatctgaaaatgcaggaaacattattaaaattggtgactttttatatgattctgcaagtaatgacgtaagtatcagaaaaagacataaacctaatattgatttaatttctgatgaggaaatagctaaaaatattgaaagaattttagttcataaacagtcactgtctgcaaaatccctgccgaaagaagtttcaaggaattttggatttaaatcaacttctaaaaagacagctaataaaatcaacagtgttttggatttgatgatagctgataatagagtcaagttggataatgatattgttgagttaaaatagtgtagaatcatgtcaacaaaagttaaatctccagaaaatttacctaaaaaaccaggtgtttacataatgagggacgccaatgatgaaattatctacattggcaaagctaaaaatcttattaatcgagtcaggtcttattttagagaaaaactggacaggcctaaaactcaaattttaatgagtcattttgacagtttagagtatattgtaactaattctgaaaaagaagctcttatattagaagccactcttattaaaaaacatcgtccaaggtataatgtgcagcttaaggatgataagagatatccttatgtcaaaattacaaatgagaaatatcctaggctgattataacaagaaacattacaaaaaacggaatatattacggtccgtttacagatgtaacttctgttaaaaaaactgtaaaattcttaaaatcattgtttaaaattaggacctgcagaaatatggatggaccatgtctgaattctcagattgatttatgctacgctccgtgttccggcgaaatttcaaaagaggagtacgatgaaataatcaataagattgatttgttttttcagggaaaatattctgttattgttaaaaatcttaaaaaggaaatggctgaagcagctgaaaatgaacaatttgaaaaagcagctgttttaagagatcagataacttccattgaagagattatggaaaaacagtttgttgatttggttgatgatgatttagaccaggatgtaatagctattgctcctaatgataatgaagttgtagttattataatgcctatcagaaacggtaaaattgttggacgtgatgactttttaatgagcggatcacagtatgaatcaaattctgaaatattatttgcatttattcagcagtattacggattcaatcgccatattccaaaacagattcttttaaatgaacctattgatgatactgaactgcttgaagagtggttaagtgatttaaggggcaataaagtttatattaaagtgcctatgaaaggcgtaaagcttagacttgtcaacatggctcaaaaaaatgccgaaattatcaaacatcagaagaaagctatggaaaattcattaattgagcttaaaaaatatctgaagcttgataaacttccgagaattattgaaggttatgatataagtaatatttcaggtaaatttgctgttggttcaaaagtttcttttaaagatgcaaaaccaaataaaaagaaatataaacgttttaaaattgaaactccaggacctaatgattttgctatgatgaaagaattgttaacacgccgtctaaaaatgattgacacagatgaagaacctgatttgattgttattgacggaggtaaaggtcagttaggtacggcctgtgaagttttggatgagcttaatttagcccatattcctattattggactggctaaggaatttgaagaaatttatattcctaattctaaaagaccaattattattcctaaaaataataaggctttgcatttgcttcagcaggttagagatgaatctcacagatttgcaattacttatcacagaaaattaagaagcgataatataagcgaatcctcattggatgatattccgggcattggtaaaaaacgtaaaatcaatattttaaaggaatttggaactatggataaggttaaaaatgcttctgtcgaagaattggctaaaataaagggcatgaatgagaaagtagccactaatgtttatgaatattatcattaatcatctttatttgattttttataaaattctattttttttcaattagatttaaatatgatgaattttaataagtttaatacagtaaaaacaatttattgggaattagatactatggttaagtgtccaagatgtggatatgaaaataacgatatttcagtatattgtgaaaattgtacatatccgattaaaaatccacaaactgctaattcaaataataaaaaagacaacggatggaatattagcacaggtaaaaaaatagctattgttttaggaattgtggtaatagctttattattattttcatttatttataactcaactcagcctgataacaaaagttcattaaatgttatttccgctgatgaaaaagtacaggaaggttccaattatccttatcaggcacatataatttacaatggaacctggtccggtaaagtgggagatccaaattatatccgcgaagtatcaggtcgtggagatgaatcatacaatttagactgcgcaccatgggacaaagtaacaatggtaattgaaaaatcagacggcagttccaatgaacttaaaatagaacttcttaaaaatggtaatgtagtagctgaaaactcaactactagttcaaccggcagtgtggttatcaattataattattagtttgaaacttcattaactttagcttctaacaattcaataagttcttcagttttgtatattcttatttcttctttatctggttggaatatttttataaatgcaattaaatcatggcataactgatcatattgtatattgaatgtattgaagttggataataaagcaattactttttcctggtttaaatcatcattatcctttagtattctttcaatatttgcaaaatgtgtttcaatcattagtttgtcattttctaaagtgtcaatatattcttgaattttgttgctgttagtcattttaatcacttattttaaaatatatttaattaaaatatatatagcttcaattataaaattatttatattattgttggggcataaaacatgattaaagttgacaatattagtaaaacatatgaattagataacaaggataaagttatcggaattaaaaatatcagttttgaagttaaagaaggagaaatccttggaataatgggaagaagtggttctggtaaaactactcttttaagattgcttagaggagttgaagaacttgatgaaggaagcataacagttagtgatgtaactgttcgtgcaggtgattctcaattttattataatcaacttaaaaaagaaacagctattcatcttcaaagatcatttggtatatggcctgaaacagtccgtgaaaatgttttaaggaaattatatgctcgtaaatattttgatgaagaaagtactgattttaatgtagctgaaagtgaatttggtgatgaggcagataagatactggatatggtttctctaactgataaggctgatcattatgctgctgtgctaagtggtggtgaaaaacaaagattgattatagctagacaacttgcaaaacagccaaaagtattgcttcttgatgaaccagctacaatggcatgccctaaaacaaaacaagaaattcttgatgctgttaaaaaaatcaataaagagttaaatattacagttgttgttgtctctcatttacctgaaattcaaagatatttggctgatagagttattttgcttgaaaatggtgaaattaaaaaagacggcaatcctgatgagattattgatgagtttttaagtgaaatggaagaacctgaagatattgaaaacatttcaactgatgaaactgttattaaagtagaggatatctataaaagattctatttattctctgggggagaagttctacaaattaaggatataaactttgatgttaaaaaggaaaatattataagtcttattggtcctagtggagcaggtaaaacagttttgcttagaatgttggctgatttggaattgcctgataaagggaaagttgtttatgaactggatggtgactgggtagatatttcaatgccaagtatgcagcgtatggatgtaagaagaaaattaggttttatgtatcaggaatttgccttaagttattattcaactgttttaagccagttagctacccgtttaggttataaaaatcaggatgttgtaaaacaagcaaggaaaaaagctgaaaaattaggattaggtgaagaattgctggactcactttatgctttaattgacttgcctgaaagtgaagcaagagaccttttagctaaaataggtttgatgcctgatattttagaagatttattccctaaattccctgaaacagctactaaagaggcagtaaaagatatttttgaattgcttgatttgcctttggatattttatatagaaaatcatatgaattatctggtggtcaggaagttagggtaatgcttgctttaattttaatttcaaaacctgaattcttacttttagatgagccgtttggagatttagacccgattactttaagaattgtggctaattcccttaagaaaatatctaaagaatataacatcactgttataatgatttcacacaatactgactttgttaaggaagtaagtaacagaactcttcttatggaagacggtaaaatagtagatgatagtgaagatgttgataaagctgttgataactttattaacttatgtcatgctgactatttaaaggagaataattaaatgtttgatattattgctgttcctgttgacggatctgaatatgggtataaggctgctgatgtagctattgaaatagctaagaaatttgattctaaaatagctgccattcatgttctggaggaattctcttttagtagctatggtgaatcagaagataatggggataaaattctggcaaaagttactaaaaaggctaatgatgaaggaattgatactgttgagcatttattaactgctgatgctttaagagatatgaaatttatcattgatcaggcacatgctgatttggttgttatccatgcattaggttcagatgataaaagatttgtttcttttgaagaaaatgaagtatctcaaaatcaaataggttctgttagtgaaaggcttttaagaacttctgatgttccggttgttttagttaggtaaaaagttgtataaaagagtttaaatattataacgaacttagtattcataacataaactattttagttttttataaaaaaggagacttttaatttatgattgtaaaagattggtgttcattctgtggagaatgtgcaggagtttgtccgagaaatttaatacaagttaaggagtatagcttagtatttgatgaaagtgagtgtagagaatgtagtacatgcgttgatgcttgtcctattaatgctttggagaaagaagattaaggagattattctatgattgaaactgatgtattagtgataggtggaggaccagcaggttcttcagcagcaaaacatgcagctcttggtggggcaaaagtcattttacttgataaaagatctgaaatcggtgctccaaaaagatgtgctgaaggtgtttctaaaaaaggtcttgcaaaacttggtattgaaccaagcccacgctggattactaaagaaattgatggtgtaagacttacttctcctgatggaactgatgtctggttaacagaagaagaaattgaattgcctgaagcaggttacattcttgaaagaaaagtatttgataaacatatggctatggatgctgcaagagcaggagctgaaatcagaatcaaaactttagctactggaatggataaaattgaagatggctttattgtttctacagaatctatgggtaaaactgaagaaattaaagctaaaatagtaattgctgcagacggtcctgaaggtcatgttgcaagatgggcaggtcttaaaggcagtgcaaaagctaaagaaatggaatccggagttcaatatgaaatggtaaatgttgaatttgacagagaagcagtcattgaattctatttcgggtcatgtgcacctggtggatatgtgtggattttccctaaaggtgatgacatagctaatgtaggtttagctattctccagcataaagcaacaaaaccagctattgaatatttggatgattttatagctaaatgtcctgcaactaaaaatgctcaggctgttgaattaaatgttggtggagatcctgttggaggaatgcctaaaaaaatgtatgatgataacattttggtttgtggagatgcagcaggtcaggtaaacccattaaccggtggaggaatcataagcggtatgactggaggaatgtatgctggtcaggtagctgctgaagctattaaagaaggagaccattctaaaaaattccttaaaaaatatgataaaataacccgtgatgatttatctcatgaaattgacaaatacaaaaaagttcaggagtatatgttaactttatctgatgaagaacttgacaatattgctcatgcattccaggatgttaactttgagaaaatttcaactactgaacttgttaaagctttagtaaaagtatctcctaaagctttattgaaattaggtaaatttatttaaggtgattttatgattctagttactggtggagcaggttacataggtgctcatactaataaagccctaaatcaggcaggttatgaaactgttgttgttgataatctttctaaaggttatgaaaactttgttaaatggggacattttgaaaactatgactttggaagtaaagatttaagggaagtttttgaaaagtacgatattgatggagttttgcacttcggagccttttcatcagtagctgaatctgttgaattacctcaaaaatattttaaaaataattataaaaatacaattaatcttttacaaataatgagggaatttggagttaataagtttattctctcatctactgctgctgtatatggaaatcctgaaaaggttcccattacagaagaccaggaattaaaaccgattaatccatacggtcattccaaattcataactgaaaaggcactggaacgtgaagctgcaaaaggagattttaattatgtggctttaagatatttcaatgccgcaggttgtgattttgattgtgaaattggagaactgcacgaaccggaaactcatttgattcctttagtgttagatgcagctattggaagaagagattccatttctatttttggaaccgattataatactccagatggaacatgtgttcgtgattatattcatgttaatgatttggctaaagctcacattgacgcttatgaatatttatgcaatgaaaatgaatctaatgtatttaatttaggtaatggaaaaggattttctgttaaagaaataattgacatggttaaaaaagtaactggaaaagaatttgcagttaaattagacgaacgccgtgaaggagatccggatattttaattgctgatgcaacaaaaattaaagataaattaggttggactcctcagtatgatttggaaactattgttgaatctgcttggaactggcataaaaaaatatatcaagactaggttatagctatggaaaatgaaaatagcgtaatttcaaaagttgatgtacgtataattgtatctggattggatattgctgaagttgtatctaaatctgtagataatactcagcttgaaagggattataatataattgtttcttcaattatccctacaaataattttgaaatagcaaaaaaagtagctaacggtggagatattattctcattggaggttatggccaggatgagaattacaatttacttttcaatgatttaaaaactgattttaatcatgtcggtttattcgattataataacattattaaaaatgaaactgttgactcaaatttggctgctgatgaaatactgaattccattatacgtgcagctttatcttattctttaaatttagttaatgttcatactttagaaaataaattattaaaattaactcataaatacaatagcttacttgatgattacaataaactcattgaagattatgatgatgtatctttaaaaaataaggaattgcaagaaactattgatgatttaaaatctgattttaccgctttcaagtctcgttatgaggatatttactctaaggaattccttgaaatttataatttgaatgatttgtggcaggaagcttttagagaagaccttgcagatgcaaaaaaagttacaatagctacaaataagtttaaaccggagaatattattgttggtcagggttatattggtgcccaatcaagacaggacgcaatagactggctgaaaattatcaaaacagctttaatatttgttggaaatgatgaagaagacttgaaacgagatttaaataaaacttcagaagttgaagatgattatgatatctcaaataattttgagaatttttgggattaaatcactataattttatactaataaaaagaaagtttataattaataattatatgatatatgggagattgtcaatgcaaggagaaatgcaagataaatgtggtgttgtgggaatacattctgtagatgattctaaggatgtttcttctttgatttattattgtttatatgctcttcagcatagaggtcaggaatctgcaggaatggctacttttagtccagataaaggattaaattattactgcggtatgggcttagtgactgatgtttttaaagattatgaaattaataatcttcagggaaatatggctattgggcatgtaagatattcaactactggtgaatctaaacttgaaaattcacaaccttttgtgactgattttgatgatggatttatagctatggctcataatggagatattgtaaactctgatgagttaaggcgtgagcttattcgtgaaggttatgagtttaaatcaggtactgattctgaagtaatttgttacatgttaagaaaagagcattattctaatggtaaaagtattatagaatccattgaagcagtttctaaaaaattagttggatcatatgcattaactatacttgttaatggtgatttatatggagttcgtgattctgccggaatgaaacctttagcaatagctaaaagaggagatgattttatcatagcttctgaaactgttgcttttgatgtaattaatgctaaattcataagggatgtaaaacctggagaagttatatattttgaaaataatgaaattcaaagttacatgttggaactggctgatacaacttctcttgctcattgtatgtttgaatatgtttactttgcaagacctgacagtacaattgatgaagttaatgtatatcagacaagactaaatattggaaaacagttatatgaacaattcccaattgatgctgatgtaattatccctgtaccggattcttcaattcctgcagctatcggatattcaagagcttccggaattacttatggtgaaggtttaattaaaaacagatatgttggaagaacttttattatgcctacacaggaagaacgtgaactggctgtcagactaaaattgaatccaattaaagaagctattaaaggtaaaaaaatagttttaattgatgacagtattgttcgtggaacaacttccaaatctttaattgattttgtaaaagaagcggaacctgctgaaatacactttttagtgggatgtcctccagttgtagctccttgtttttatggagtagctatggccagtaaaaaagaattgattgcagctaattattctattgaagagataagacagcaattggatattgataccttaggatatatcagtttggaatcattggtaaaagctattggaatgcctaaagaagatttatgcttaggttgtttaaatgaatgttatccaacagagcttcctgatgatattgaagctgaaacatactataaaccttaagatattatggttgaattattatctcctgcaggaaactttatttcccttagagcagttttagaaaacggagcagatgccacttattttggtcttgatgactttaatatgagggcaaatgctaaaaatttttctcttaatgatttatctgaagtttctaaaattgctaaacaatattcagccaaaacttatttatgcagcaatgttattttaaacgaagacagggctgtagaattaaaaaataatttagaagaaattgcagcatctgaaattgatggaattattttatctgatataggattaatagaggatgttgtagataacggacttgaagcacatataagtgttcaggaaaatacttccaattccttcatgctgaaaacacttaagaagttaggtgctaaaagagctattttatcaagggaacttagtttggaagatattaaaaaaacagttaaaaaatctccgattgaaacagaagtgttcatacatggtgcaatgtgtatggcaatatccggcagatgttttttaagttcaggtttgtatggccgcagtgcgaactgtggagactgtttgcagccatgccgtaaaaactggacactgacttttgaagaagacaacaacgacagcgtaataaatctgtcggaagttaatgaggaatcatttgtaatatcaaaatcatatgatggcagttatagaactaactttttttcaccaagggatatgatgatgatagaacatgttcctgagctgattaaagcaggaattgattcatttaaaatagagggaagagcaagaagtcctgattatggtgcaatggtaactaatgtttatagacaggctattgataaatattatgaaaatcctaaggagtacaaaataaatcctcaatggatagaagagcttaaaagtgtatttaaccgtggatttgatactggattttactttaatacaccatatgaaacaagtgaaaataatcagtcaaaattcattaaaaaagatattggtcaggttgttaactattttaacagggtaaaagttgcagaacttaaagtatgggatgatctggctgttggagatgaaattttaatacagggaaaaactaccggctccataaaacataaaattgattcaatgcagattgacggcaaaaatgtcaaaaaagttgaaagaggcaataatgtaggggtagctattccgacaaaagtaagagctaatgattttatttataaacttgttgaaaggtagatatctatgaataaaaggcatttggttgatagtttaagtttatctcgaataatttttggaattttatttgcctgtagtgttttttatttaaatggtaatctgataattatatttgtcatttacctttttgctgttttaagtgatgttttagatggaaaattggctcgaagatacaaaatagataataaaaacaacggggcaaaggtagatgttttatcagattttgcatttatcatgttaagctcttttgcattgtgttatgtaaatttactgccgttttggtttttgattataataactctgaaattaatggagtttttcaaaacaagctctgaaggtttagaatatgaaaagtttggaactttagtggctttaatgttttatgctcttccgggaataattgttttatttaacttctttaaaatttctataattataaatttaatgttatgcatatttattacagtatgtgcaattatctcatcaggtctaagaataatacataaaaggagaaattaaatgattaaaaagatagctatttatggaaaaggcggaattggaaaaagtacaacagtagctaatttatctgcagtttatgcaaataatgatttaaactgtttggttattggatgtgatccgaaagctgatacaacacgtacattgtgcggtagaagaatcccgacagttgtagatacacttaaaaataacagaaaacccagtgaagaggatattattgtaaaaggatacaatgatattttatgtgttgaaagcggaggtcctgaaccgggtgttggctgtgccggacgtggtgtaatagtagctatgaaaagacttgaaaacttaggtgtttttgataaggatttggatgtagtcatttatgatgtacttggagatgttgtttgcggaggtttttcagtgcctttacgtgaaaagtatgctgatgaagtaataattgtaacttccggagaatacatgtcattatatgcggctaataatattgttaaaggaattaaaaaacttaaaggaaatttaagcggaataatctgcaactgcagaaatgttgaccatgaaaaggaaattgtcagcgaatttgcatcaaagataggaactcgtattattggaactattaatagaagcaatttaattcaggaaagtgaattagatgcaaaaaccgttgtagaaaaataccctgaatctaaggaagctagtgaatatgaatccttagctacaaatattatggagaataaagttttcacaacaccggaacctatggatgatgaggaatttgaaaaatttttcaaatcatttttagaataaatttataatatctcttttacttttttaaagccaaatactattatttttaacaatatataaaatatttaaatgcatatacatttgtttgtataagaagattgtttttatgatgttttgttattcatgttttttttacgatatttgtttctacattttttaaaggaataagtatattgagaaataatatttttttattattttgggaggtagaaaatgcttaaaagtaaaattttaataatttcaactatgattttattcatactatctatttcggcagttaatgcagaaaatgtaacttccagtatgattaatgacacagtaaataattagtttcacgtaattgatggaaaatatttggaatataataacagtgaaaatgggaaaaatttaaatgatacttctaatgtgttatatgatggaaaagatggaagtgttttagaaaataaaaacagtaatgatgctatttttaagtatgatgggaataatactgttgtatctaaagaaaagcctaaaatgaatgtaattgctgaggatagtataatatttggtgaaaatttaactgttaaagttgaattacctaaagatgctaatcctagttgggtgctgatgtctgttggtgaaatttattattatgttaaaattgacgatgaaggcgtatcattatggaatatgaccggtttagaagcaggtattcaatatattaaaattggatatcggggcaataataaatatgaagcagttgaagttttccatactgtaaatgttattaaagctaatctaaatcttaatgtatttattaaagatgttaactatggtgaaaatttaactatttatgctactttaaatggtgtaaataatactaatttaactggtaatgtaattgtaacaattaataataaaaattattctgtagtagttattaacggtaagggaaatgtttctgctgataagctacctgctggattgtataatttcagtgctacatgggctggaaatgataactataatggaactaatatttctggtggctttaaaattaataaaatagattctacaattgccattaatgttgaagatattaaagttggtgaaaatgcaactattattgttaatttagatagtgatgctacgggcaatgtaactattacacttgataatcagaactatacagtagctattaatgaaggtcagacaattaaagtaataggcggacttaaagcaggcacttatgatgtatttgttaaatatataggtgataacaattataatagtgctcaaaacacaactaaatttactgtattgaaaatatctgattataatatggatgtcactgttcctgaatttaaagagggagtaaattctactgttggtgtggatttacctaaagatgcagaaggtactgttactgttgaaatcgaaggtaaaaaatacactgcaaacataattaatggaactgcaaaagtaaatattcctggattagatgttggagattataatatcactacaacttactctggtgatgctaaatatgtttccatgactaaaaaaggaaacataaccgtaattccaaatatggatgtaaacttatatgttgatgatgttgtaatgatttatcatgatggaactcgtttagttgctaaattaacagattaccaaggtaggccaattgttaatgatattatatattttactattaatggtaaaacttatgctaaaactactgatgataatggtactgtttctatgggacttaatttagattctaaagtatatacagcaactgtgtcatataatgaatctgaggtatacagtaaaatatccaagaatgttactgtaactattaatccgactgttataagtgaagatttagttaaaatgtatcaaaatgatactagattctatgttaagttcactgacagcacaggaaaagcattaactaagactactgttaaatttaacattcatggtgtattctacactaaaaagactgataaagatggtgtagctgatttaggtattatgttaagacctggtgagtacattttaactgcttacaatcctgtaactggtgaagaaaaaggatttaacataacagtaaaatctttaattgtacaaagtgacttaactaaatattacttaaacaattctaaattccaagcaactatttatgataaaaacggatctttagcagtaggtaaaaatgtaactttcaacatcaatggtgtattttacactaaaataactgattcaaatggtgtagtaagtttagcaattaatttaaggcctggagaatacattattacaacaatgtatgaaggattagctgtaggtaacaatatagttgttttacctactttagttactcgtgaccttaatatgacttatggagatggcagtaactttactgcacagacattagacggtcaaggtaaaccattagctaatcaaaatgttacatttaacataaatggtgtgttttataataaagttactaatgataatggtgttgcttcattaactatgagattaatgagtggaaaatatattattacatcttactggaatgacttccaaacaggaaatacaataataatatcttaatttaagagattttattaatctcttctttttctttttttattgtcacttttaagatatttttaatattataatcaaattataacttttttgatgtttaaaattaattatttttatttaatttggatttatattaattaatattttgttaatgtgaaaatatagtaattaaaatgagtattatcttaaaaatagattatgctttaaatatatgaaatcattaaatataaaaaataaaaaaaataaattataatatgattaactaattaggggacacataatttgttagatataaaattattcagagaaaatccggaattaatttttgattctgagaaaaaaagatttagaggaacagaaactgctgaaaaagttattgaatatgatactttatggagagaaggggaaaaaagattaaacttcttacgttctgaaaaaaacagattatctaaatcatttaaaaaagctaaacaggaaggtaatttggaagaagtaattgcccaatctaaagaagtagctaatgaaattaaggaattaggacctaaaattgaggaatataaaaaattacgtgatgattacagatataaagtaggaaatatcattgatgaggatgtacctatttctgatactgaagatgacaataaaattgtaaaagaatacggtgaaattcctgaatttgattttgaaccgttaaaccatgttgatttaattgaaaaaattgacggtgcagatatgaaaacagcagctcaaatagctggtgcaaggttttattatttaaaacgggatattttacatcttaatttggctttaattcagtttgctttaaatgaattggaatctaaaggttatattccacttcaaactccgttttttgttaaaggagaagtggctgcagaaacttctgaattaggagaatttgaagaaactttatacaaagtggctgatgaagatttatatttgatagctactgcagaacagactttagcggcacttcacagagatgaaatcatcgctcctgaagatttgcctattcagtactgtgccctttcaacctgttttagaaaagaagcaggatctcacggtaaagatacactgggaatattcagggttcatcagtttgaaaagattgaacagtttatttacacaactcctgaagagtccaaaaatgctcataaaaagttgcttgaagtaactgaagaaatatatcagaaattaggtctacattatcatgtagtagctattgtgtcctcagcacttaatgataatgcagctgtcaaatatgatcttgaagcatggttcccaggttccaaggcttacagagaattagtttcatgtaccaactgtaaggattatcaggcaagaaaaactaaaacacgtttcggaaaagcaggttccggagatgcacaaacattacatactttaaatagtactgcaatagctactgaaaggactatctgctgtttacttgaaaattatcagcaggaagatggcagtgttaaagttcctgatgttttagttccttatatgggtggaaaaactgtaattaatgcagttaaataaaccctctttttttaattaatttttttcttcatagcaataaattcttcatcggttaataatcctttgtcatacatttcaattagtttttcaagattaacagttgattttgaagattcatttattttagaactgttaatttcctggtttattagctcatttaaaaatttttgtacttttaataatatttccggacggtattcatggattaatctggaatcgtgggtaactgcaacgtcaagaagtgatgaggtgattacttcattaatttcatcactgtaaagtacacatttaaaggtttctccggaatctaatacaaagtagtcatcatcgctaaatagggatatatttctccattttagaataactttagtgttattttctctggatactgcaatatcaatatccacatatttttttgaaatattgatggttgtataacagtatttagcatcctgtgttttaattttctcagtttttacctcagttttcacacctgaagaagctgcatatcccaatagtccgaaaccaaatgttgccagtgcttttgtacctcctccgtgtttatctgttgtaattggtgttttaatagtttggtattcggcagcactaatttgttttttgtttttgaatgtcaacccttcactattgaataattcctctatttgtggttttactttatttaaaacagccttttcaatatctttaaaattttcttttgtttcatttaatattttttcaaaataagggataatattttcattaggattacgtattgcatattcaattagtaaatacagtatatgtgattcttcgtcatatgaaatgttaaaatggtcttttataagaatttttctaaagtttgtattgtaatgttcggataatggaataagaatctggtttatatagagtagctggaagttttcataagacaggtctccgaaataattttcttttggttttggaatttcacttccgcaattttgacagatacttgagtcgtcatgatattttttaccgcaggtagtgcaaaatcttaaaacatttgaattataagcaacatcatcaactatttttttaattagtgatgttccgcttggttggcttgtgtcatatccgcaaaaacgacagtatttccattcattcagtatctgttttttacaatttggacatttaattagggttactaatggaagtatgtcatgttcattgtttttttcaattttatttccacaattcatacaaaaattgtcgctttcttcaattgatgctccgcagttatcacatttaaccatattaccacactttatatatttttttaattttttaatttaatatagtttgtttatttttattcgtataatctcaaactttatataatagatatatccaattatttagtaaaggtgataatatgctttctaataatatggaattagaattaaataaacaagtaaatgcagaattgtattcaggatatctctatttgtcaatggcttcttattttgaagatgacgatttacctggttttgcaaattggatgagagtacaagctcaagaagaattggaacatggaatgaaaatctatgactatataattagaagaggaggttctgttaaattggatgctattgaaggacctcaaactgaatgggattctccattagctgcatttgaacatgtattgtctcatgaacaaactgtaacaggtcttattaataatttagttgatattgctattacagaaaaagatcatgctaccaataatttcctgcaatggtttgttgaagaacaagttgaagaagaagaaaatgcaatggaactggtaggtaaagtaaaaagagcacaaaattctgttgatttaatgtatacacttgacagtgaattagctagtcgtgtttacactccgccggcagataaggaaaattaaaaaggtaaaaaatttaccttttttataagttatagacttcctctggaggtactataactatttcatttttaattaaagcatctattaaagcatttaaattatcagtatgtaaaagtaaaattgctttatcttttttatcatgagtaaatgcatataaatactctaaatctaagttattttcttttatagtttttaaaacagatgataatcctccaggtgaatctgtcatttcaatagctactatgtcagttgttttgactagatagttttcttcaagtattttttctcctttttgaggattatctactacaactcttaatatgccaaaatcagaagtatctgcaagtgaaagtgcttttatatttatatcatgttcagataatgtttcaagaacatcatataagcttccttttttgttttgtaagaatattgataattgttttactttcatattgttcattttaatccccttagtgtaaatttcttttatctataactcttttagcttttccttcatatcttggaaggctttttggttcaactaatgttacttttactcttattccagtttcattttcaatagatttagctattttgctttgaatatcgaccatttcctttactccatcaaagaaaaggtttttggaagcttccacttttacttctatttggtctaaagttccaggtcttgtaactataattaaataatgaggctctacatcacctactttaagtaatgctttttctatttgggatggaaatatagctactccttttactttaatcatatcgtctgctctaccggttattctgctcattcttgcacttgttcttccacattcacatggctcataggtaagtgaagtcaggtcttttgttctaaatctgattataggcattccttctctttcaaggtttgttaatacaagttcacctttttggttttctcctaatgttttgccggttgtggaatcaattatttcaggatagtaaatgtcttcagctatatgcaatcctttttgagcactgcattccactcctacaccaggtcccataagctctgtcagtccgtaaatgttgtatgcaggtgctccaaagagattttctaatttttgtctgatttcttcactccacatttcagctccaaatccgatagctttaagattcatatctttgggattgattccatcatcttcagctacttcagccaagtgaattccatatgacggtgttgcaattaaacaggttactccaaagtctttcattatttcaatttgtcttctggtctgtcctgttgatatgggaactattgttgctccaactttatgtgatccgtaatggacaccaaatcctcctgtgaataatccgtatccgtgggtattttgaataatatcgttttcaccaacacccatcattcccaatcctcttgcagttgtttctgcccaggtatctaaatcttttctggtgtatccggatactacaggttttccggtagttcctgaagatgaatgtatttcttttatgtctttcatgtcaactgcaaaaagaccataaggatagctttctcttaaatcatcttttgtgatgaacggcagtttttcaatatcttttaaagtttcaatatcttctgggaaaactccacaatcagtatattttttattgtaatatggaattttgttaaaagctagtttcactgttttttgaagcttttttaattgtagttcttcaagttcttcccttgacatacattcgattttctcattccaaaacataaattggcctcattttatttttaataataatatatgtttcttattagctttaaatgtttatatgtttttacaataaaaaacagtattttattaaagttaatatttattaataagtaaaaattcaggtttttaaagaaattaaagaataataaaaaaaagaaaaaaagaaaaaattattaatttagtgttttactcttcattttttcgtttataataaccgtaaccaaatattagcaccattacaacaatgcagataataagtgatataggcatatctccttttgtagatgaactggaagatgtgtctttagatacttcataagattttccggattcctgttcagaagctgaaacttcactgcttgaagaggatggattttgggaactgtcaataccaatacttgaagatatttgagagttggatcctccatagcttataatactggattgtgttgtacttgtagcttttgatgaactttgactttcttcatttgaatctggattatttgaatttgtcggaacaaatgaattggcaaaaatgttattttgagtagcctgataaagttggtcattaaatttagccagtaaatctggattaatatattgtgtagcccattttaacatagctatattaccacagctacagtcacagcatgcaacaccgtttacaattatggaatttgcccacattgttgctaaattttccagtgttcctttatctgtttgccagtaaccgttatatgcagcagttaaaagggttcctgcagatgaaataaatgcataattattgtttccgctttgtaaccagtcagttactcctaaattgtatttgtctttgatgtaaacattatatgattcatcccacatccagttgtttactgcatttggtcttgttacagcccatccaaataaattattcaggaatttatttgagatataacgtgctccgctgtatccttcattcatcattccaagtatccaatttggattgaagtatcgggttgctgtttctttagacaatacagtttcaatggaactgatatatggtttgtctttattaccatacattaacacattcatattaggagtttttccattaatatatgaaactgccattgaaagaccgccccagtaatcaaagaaatcatcattatctgcaacgccgtaaacatttgtattacggctgacgataatgtcatcagtattattgagaactcttgcaaatactacaggatttgtttcgccccagtaatttttagagtacatatttcccattctgcctaagtaaaatttagctaaatcattggtattgttccatgtccaacttaatgaaacggatttggcaatacctgctccataatctccatttggcggtgcaaatacgcgggtaatagctacttctccagcatatgtattattatagcccaaatctttgtagtatataaaatcattaacccaatgacgggctacataattttcatcaaaagattcagatccgactccataatatccaatgccttccattactttatccaatgcttctttcatgtcttttccatatttactttccatcaatgttttattattaatgatagttaaatatgatctggctaaagctactctaaatgcattgtctaataaggaaacctgggtactgtataaatccctaaagttaccgcttgtaatgacaacaatatctattctttttttagcccatccctcaggtctgaccaaatcttttaacccgacaaattttggcattattttagttttggtaccgacactgtcaccatcttcagttttacctccggcacttggagatgaagtataaacaggttgcatacctaacagatataatactactgaaatcaatgcaccgttatctcttgctgtttcaacacaccaaattcccattgcaattttttgtgttttttcattaagagatgacagtgtaagcaatgtcagtgttttggcatagttatatgcttcttctgttggcagttcctgtgattgatcatggaagaaattcccaccagttggaagtgaattaatattaattacatctccatcagatacaacagggatatatttaccatttaatccattaataaatgatgttaattcattgtttatggaagcatagattaaagaaatataataccttgcataattcattgcagcaattaaactagggttgtctgaacctaaaacattagctactgtagtactgtttgagaatattaatgcggctactatttgttcacttgtgtttaatactttatctctttctaaggcatttaattcagaatattttttagaaaagaggtattttgcaacttcatcaaatattgttgtggttattccatcatatgtaaactcctgggacagtgcagcaactacgctacgactgatgtcagttactgtccaattttgaccaatagcatgcaaacctagtgggtaaagggtattttgaacttcaaataaaaatttatctgcagctttaaccacttcatttaaatttaatttttcaaattcctcctgagttaatcccatagattgaatataattatttttttcaattaataacttaatgttggaagctattgtatctttttgagttttatcggtagtattttcatatttatttattaaattagctattgcagttaggttgccgtagagactggtataagctaaaggtgaggttaaatgagtaatcataactgcaaatcctcttctttttgcttctaatccttctcctaatccgtcagaaatatagaaatatatctgtggaacgtcaccaactacaattgatccatagtcagttgttgacagtaaaacttcttttccaggtaaccattcatgtgttgcatgtcttccaataaaaaccatagctgaggaatattctttttgcatataataatatgcagccagatactggtgtgtaggtgctactgcagaactatgatatagtaaatctgatttagcttcccatcctctttgaggttctggagctatgaatatgttaccgaattttaaaccgggaattacaaagtatgctactccattttttgtaactgtcataatgtttccaggagcttttccccatccgtttaatccaggaatattcaatgctttccattgggatttaagagataaatattcctgataatcgctatcatttccgctttgtaagtatttgtttaaagctgcaacgattttatctagaagcatgactccactttcagtataattttcaggcaataatgatttgacgccattataccaatcactaattatatctttcattggtgaggtataattaatagctattgcatttctagctaactgaccaatatatgcaacaggaccttcaataacttgaactttagaaattggttccaaactattaaaccagttttcatattctgcaactggcaataatacgatatttggctgattggataatttttccaattctccaggagcccaggttgctacattaataccgcttttaatcatcatgtcttcaagttccttaacagttgttgggagttttcccacattatatccctgtgatttaagttcatataatagattataaacacttgtaattgaatctaaataacttgatccgatattttgttttcctggaggatagttgaagtaaactaaagaaatctttttgtcactgttaactgtatattgtaaatttatccaggaaacaattcttttagtaaacaaatcaatatttttttcatgagctttaaaaccgcttaactgagctccggtttttgaagaaatttcatgggtaactcctccaacaaatgtagcttcaataataccctgtgcttcaccaattgctacatgccaccatttatcactacgatttccaggaagtcctgtagcacttaattcccattcttcattgctgacataatcagaatggaccgcacgaaatactggaactccagcagtttcaaagtactttgttgtattatcaaataaatttcctccaataccatatgccggcattgaaattattgcattgacattatttgtatatttcaacggattatttaaataggcttcataacttggagcattggtaaagtattttaccattacttttaactggttttcagacccgccagctgctacaacgggaataacattacatcctttagcttctaatgatttgattaatgcatagtatggctgtaattgaccgttgcttacatacatattactttcaagtaaacccacagtatatggtcttgaggaatcaaaatatttctttttatattcttcaagtgtcatgtactgttctctaaatattccgtattcataggttttactaaaacgcggatcggaatatttgcattcgtatccggtaatatttaaagcccacaatatttcatttatttgattttctttgttattgtaatttttatataacactgctttgttaaattctgcattaactaattttccatctccatttgtaatatattcataatatatatcgtaattttgccctcttttagtcattgaaaagtaattgtttaaaaattcttcagtatatatgcttttatctgaaaatattttttcatgatttattgttgaatttctaaccaagtgtaaattctttgcttgagagctactggatgtttctaaaaataaaaacagttctttatttgatagatttggatattttagtagtaaattagtaaatactgaatcagcatcagaagttaaccagttaataataacaatatcgctagtttcaacaagattgtataattcattttcattcattttacaaacttgattacagcttctaacctgtatatctacatctttgtatgtgtttaagacatcacaggcagcatcatttaatatgtttgtcccaggattatcgcttattagcaatgcctttttaggaaggttattttctttaattacattactataagatattttataagatgggaagctgcattcctgagaattattttcacagatactgttttcttccaagttgatttctatgttatcagcagttgtttcagttatattttgaatttcagagtttgttgcattttcctgtgcaaatattgccgttggacttaatgatataattattgctaatattattataaatggtattataggtgaaaaattttttttattacctaaattcatatattacctcctattgaaacataatcagcttatttgtttaaatcaccatatttctattcttttttaataaaaaataaaaattttaaaagttctgtttcaatatttatttttattgatttaaaatttaataaatttaactatattagtattacttctctgataaaaaaatagatttaagtaatacttttattttagctaaattttaagtattactttttttgaaattattaatttataagtaatactttaaatacctatttatattacattttttataataaagttcattaaacaatttttttcattgtttaataaattgaatccttataaaagaggttatagaaagatgaatgttaaaaacaaatttttttttatattggttgcattgattgttggtttgttaacaattaatggtgcatttgcagaaacagctgattcaatgcctgaaattgatcagggtactgtttcaggtgatgcagaattaataagcacaaacccttggagtaccacaggaagtcttgaatatacaattcctgatggtgtgcaggaaattacttctgctaaggtaattgtaaatatctattcaggtagtggaaattcggaaacctatgctttacactcaaatactacattaaacacagcaggaaatagtaaggtattgggatatgaaaatttaacttatgttggtaatcaggctggtgatccgaatgtgtatgtgattaataatcatactacaaaacagtattctgattatcaaatggtttatgatgttttaggtgatttaaaatatttaggtcctaattcaaaaattaaaatagatgtatctagcactccatttgaaggtaaagcttttgatggacgaataaaaatgattggattatttattgcatataatgacggggacagcgatagtatcacatattggttaaatgtaggaatgtcatggactcagggcactgtaagcaatttaatttatacaaaaaattacactggtgacataggggaagttaactttgaagcaataatgttgtctagcaataacggagcatataagtttaatgataatcaactgtttattccagaagacactattgtgaaagattattatatatataataaatgggatgttacagattatttccaaaaaggtgataatagtgattttacatattctgcattatctcagggatatggttctattaaatcaagtgttcaattacttaaagtgattaacagagaatctcctgtggttactactaatattgcttcagaatataaaaattctatttatgctggtgttactaataatttaactattacagttaacagcattaacaaggatttaactaatgtaactgtttatgtttatgataatggccgtgttgttggttcttatttggttgattttgtaaaagctaattcttccaaatcagtaaatataatagattcttttattagaccaattgatgaaaatactgttttaggaaacaataataccaatgttgtttacagagttattgttgaagataaaaacggtattttaaatgacaccaacagcagtaattttatggtggtttataacggtaatttaggaaaagatttggcatatcctgccatgaatgctacaattacacgtgtttatgatattactggtgatgtaattattttaaataaagatgattcatcatatttaggatccaaaagtacaaatggaagcgacacatggaatattgattttaaaggggagttaaaagaaggattgttatatgtttcatataattggaataagcaagctgatgtaagtgattggatagttactttcaataataaaatcattacaccaattgcccattaccgtgaccagtctaatttaggagcatacggcaaacacggctacggacttgcagtttataatgttacagatttaatcaataaaggattaaatacttttactttaaataaaacaagtggtttaactgctgtttatccaagttctttattacttttaactaataatgaaaatggtgctagtaaaactgtttatatgagtgaaggtgcagatttactttctaaaacaaataataaaaatttggatgtcggagcttatactaaatttaacattgactccacttcaatgattaactccacattatatgtttttgcagcaggcggacaaaaaaatgaaggaaacattgtttttaatggtgaaataaaaagtgatgtatggaataagacttcaaattcaattgattattatactttcaacaccgatggtttaactaaagacaataacactgtatttttccagtctacaggttcaactattcttgcattacatcagatacttgttgtagaacgtgaaaacatacagttagcagttgaagatcttgaaaaatattatggcggatcagaaagacttaatgctactttaaaagatggtgctggaaatccgatagctaataaaaccattacatttactgtaaatggtaaaaaatacaataaaacaactgattccaatggatttgcatcattggcaattggcctaatgcctggaacatatgatgtaacaacaatgtacggcaatatgtctgtttattcaaaagttgttgttaaaaccactattgaaggtaaagaccttgttaaaatgtataaaaatgaaactcaattctttgcaactttcttaggtactgatggcaaaccgttatctaacattgatgtaacatttaacattaatggtgtattttacacacgtcaaacaaatgaaaatggtgtagctaggttaaatattaatttaagacctgatgtgtatattttaactgctattaattcagttactggtgaaagtaaaggatttaatataactgttaaatctttaattgagtcaaatgatttaaccaagtactacagaaatgattctaattttgaagtaaaaatttacaataaagacggaactcttgcaataaacaaagaggttacatttaatattaatggtgtattctatcaaaaaaccacagacagcaatggtatagccaggttaggcattgctttaagacctggaaattatataatcaccactatcgttgacggtctggatataggtaataatataaatgtattgccgactttagtaacaagtgatctttccatgaaatatcttgacggcagcaactttactgtgcagacattagacggtcggggcaatccgttagctaagcaaaatatatcatttaatataaatggtagattctattacagagtaactgatgatgaaggtatggcgtcattgaatataagattaatgcctggagaatatatcattacttcatattggaatgatttcgaagttggaaatacagtaaaagtagattaaaatttaaaagagaattttacaattctcttatttttttaaaataaattttatatagtttaaagtagaaatggtaaatacgtaattaatgtattattgattatattgaggaaataaatatggatatgatgagtgtaatgtggcaatttggtgtactggctgccgtaatcatatttggaataaaaattggtttggcgtctggtcttgctaacttgtcaaaaaaattatttgcatgtatctgtgtcggttatggcggtggtgttttattatgtacatatgttgcatcattctttgctgaacagattactgaagctatttatagttataatactgttttttatataattatggcatctatcatgattatcgcgggattgtttactataagagaatggaaagttcatgataaaaatacaactactgctacctgtttagcggttgttgctccttgtccatgttgttttggagcgattattgcttctgttttaattgtagcacctactgtaggtttttcatttatgggtttaagtaaatatgttgcagcagcattgttagttgttatgattgtaacctattttgtatccaatactatcattaaatttatagataagccttatcctattgtattgggaaatttcatgttatttttaggtgcttatttcttgctgtcagctattgtaataccaagtattgcccaagcaatgcaggggcaatttggcggagtaactatgattgattctcaatctttaattttaattttagttgctttagttgctttagtgattgtaggtgtagttttatataaaagaagtgataatttattaaaataaatatttaggtgatattaaatgagttcaatacctggtacagaatatttaagcggagctttaaatgttatatctcaaagtttaacaattcctgtaatggttttattattaataattgctgttgtttctgttattgctttaggtggattcatatctgaatacacatcaatgaaaaaagtaggtgtcggaaagataagggatttaatatttaaaattaatacagcagcttctgttgatgatttgatgaatgttatatctggttccgatattccaaaatctcaaaagaaagttttaactgagattgcaaaatcagaagcactagatagtgattctagagaagctttagctcgtaaattagtagaacatgaagaagaaaaaattgataaaagtttaagaaatacagatattattacccgtgtcggaccaacattaggattaatgggtactttaattccattaggtccgggtcttgcagcattaggtgctggagatgtaaatacccttgcagatgcattaactattgcattcgatactactgttgtgggtatcggttccggtgctttatgttattttatttctaaaattagaagaggttggtatgaccaatatctttctgatttagatgcgttatctgatgcagttctttttttcatgaataaacagtgattttatggttagaagaaaacaaagaaggagaaaatcttctgatgatgacatagatcctatggcaggtacaacaaaccttgttgatgcaatgctggttcttgcattaggttttttaatatttgttgtaattagttggaatatgcaaagcgttattttttccgacatgagccaagatcaaaagcaggcagttatggaatctatgaaacaggtttcagaagttacacaaggtcaagaattaaatgatactccagacacatctcaaagttctggacaaggtttcactgagctgggaaaagtttataaagatccatcgtcagggaagctgattatggtagagggctaatccttctacatttaacttcttttttttaaaattttaatttatcagtatttctttaacatttttacataaaaattaagcaatattttcttcttattctgtcagtagcataaacataataaattataaatactcaatcaattaaataaaataagataaggtgattaagtaatggaattttgtcctgaatgtggagctatattacttcctatgaataaaaaattaaaatgcaagtgcggatatgaaagatctttatctgatgaagttaaagaccagtatgaagttaagggagaaacaaatcctaaagcagaagtaatagttactgataataagaatgtagcattgcctactacaacaattacatgttataaatgtggcggaactaaaggttactggtggacagtacaaacaaggtctgcagatgaagctccaacaaattttatcagatgtgcaaaatgtggaaacacatggcggtcatctaactaattttttaaatattattaggtataaagtattatactatgaaaatgcttcaaaagacattaaggtcagttgtagataatccgaaacatattttcaaactggctgttcagggaatatttgtaggtatttttgccggaataatggtttgtttatatagatttcttttatactcatcagaaagtattttaagaaattttttggaattcatcaacggaaatatctttttaattatagcatggtttatcatattagctattttaggattatttacagcttttttagtaaaatgggaacctgatagtattggcagtggtattccgcaaatcaatgcagaggttaaaggttttttaaacactaactggttgaaaattttaacagctaagattagtgccggagtcttaactgcactgggtggtctgtctttaggtcctgaaggtccttctgttcaaataggaggaatggccggaaagggaatctccagaatttttaaggaatcaagaacagatgaactgagacttattttagccggttcaactgtaggtattacagcggcttttaatgctccgttagctggagtgatttttataattgaagaaatcaatcatagttttgataaaacactaatttttatagcattgactgcatcagttgttgctgattttatatccaaatcattttttggacaggcaacagttctgaatttcccattacataatcttccgctgtcatcttactggcttttgattgttttaggactgcttttaggtattttaggttatgtttacaatgttggaatgattagggcaaatgacagattggctaaaatgtctaatattccacttgaaattaaattcatatgtgtatttttaatatctggtgttgtagcactatttattcctgaaattcttgacggaggacatttcatgctggatatgcttgatgtagctattccgccattaggtattttgatatttttacttgtagccaaatatctcttttcagtggtgtctttttcagcaggaactcctggaggaatatttttgcctctactggttttaggagcatttattggagctatttttggttctgttgtaattcctatttttggtcttgaaagttatttgatatacaagtttattgttatttcaatggccggattttttgcagctaccgtaaggtctccgattacaggggttgttttgctttctgaaatgtgcggatcaacagaatctctggtagctatgctgattgtagctattattgcatatgctgttcctatgctgctgaataaccgtccgatttatgagtctttatttgaaagattactggctaaaaataatcatgattttataaaagaccattcaaagcatattttatcggaatatgttgttccttctggctggaagtatacaggtaagccaattaaggatattccttttcctaaaggatgtattgtagtttcaattaccagaggtggagattatatactggctgatgaggatattactataaattatgcagatcagattcatatgctgatggacagtaaaaattatccttttaaaaatgatgaaatgggtgaattaatgagtaaggtgatacagtgaacatgatatttaaaagaaagagcgttagaagttttactgatgagaaagttagtacagataaaataaaaaatttaatcagggcaggaatgcaggctccttcagctttcaactcccagccatgggaattcattgtggtatctgataaaaaggatttaaaagctgtttctaaaatgagcagatatgcaagaccagctgaaaatgctcaaaaactgattattgttttgggaaatacgaaaagggataatgttgttatgcctatgattcagcaggatctgtctgcctgtacacaaaacatactgcttcaggcagttgctgagggtctgggtgcagtatggttaggattttacccgattgaagatagagtaaatagtttaaggcagtattttaatattccagaacatattattccattttcagtaatagctattggttatcctaaagaaaataaagaacctgaaagcagatatgatgaatctaagattcatttaggtaaatattaatagtaataaaaatatattttattttagtaaattatgaggttaaataatggtaagtgtaaacttagaagctaaaaaaaccgtagatgtaatgattgaaaaacaagatgaattaaacattgctgttagtcaattgtcaaatggtgctacaatcattgattgtggtgtaaatgttgatggaagttttaaagcaggtgaactttacactaaagtttgtcttggtggtcttgctgatgttggaatttctattcctggtgatttatctgaaaaattcgctcttccttcagtaaaaattaaaactgattctccagctatttctacattaggatctcaaaaagcaggatggtctgtatctgtaggagatttctttgcacttggttctggtcctgctagagcaatctgtaaaaaaccggctgaaacctatgaagaaattggttatgaagacacagaagctgatttagctattttaactttagaagctgatgtattgcctggtgaagatgttgcacaatacattgctgatgaatgtaatgtagatgttaaagatgtttacttacttgtagctcctacctcttctcttgttggttctatccaaatttccggaagagttgttgaaaacggaacctacaaaatgttggaagctattaaatttgatgtaactaaagtaaaacatgctgcaggtattgctcctattgcaccaattgacccggacggacttaaagctatgggtaaaactaacgatgcagttttatttggtggaagaacttactactatgttgaatctgatgaaaatgatgatatagctgatgttgcagctaaattaccttcctctgcagctgacggatatggtaaaccattcttcgatgtatttaaagaagctgaatttgacttctacaaaatcgataaaggaatgtttgctcctgcagaagtagttattaatgatttaactactggtaaaatctacaaggaaggatatgtaaacgtggatttacttaaaaaatcctttggtgtagacaactaaatttaattatcttttatcagataacttttcttctttttttattttttctggtttgtttgaggctttttttaagttttcccgaatattttatacaatatgtttaaatacttatttttcaataaataaatattaactcacagtttgagtgatttttatttaaattaatttaaaaaggaggactttaaaatgagtttaactgagattttcaatgattctttaaaatatccattttccgatatgaccaaattttgcataattggtattgtaatggttgtatcttcattaggttctttagaaattggaaatgcaataatttcttctgttttaggtattgttgctgctgtagcatctattataacctcaggatatagtgtaagtgttgtaaaaaaggctcttgtaaaatctgatgaaattcctgatttggatttgcgggaaaatattattgacgggttaaaaatgatagtaatgcttattgtatactacattattccgataataataactcttattgtagcttttgcaactggtttctttaatcagtatattgaagttgcaacttatgcttcccaatatggttctaattttgtaaatatggtttctgaagatttaatgatgtctttagtaagttctgcagcaataactattattataggtataatattgcttgttattttctcattattattttatatgggaatttgcagacttgccaagtataacagtttgtctgaaggtgctgatattcctgaagcagctcgtgatttaaaaaggattggtataggtaaagttattggttggatgattttattatttgtcattgtagctattcttacctttattgaaacatttatttcatcaattccatctgtcggtattttaatttcagcatttttaatttcaacatataatttatttattgcatacagatcagttggtttattatattcagctattgaataaaaccaattttttttcttttttttacgattaattttaaatagttaattatcaatattatttcattgagagtgttttagatgaatataagtgagatttttagtgattcatttaaatatccggttagtgatattaaaaaatttgcaatattcggtattgttgttgttttagctactcttaatgtttcaatagctaacagttcagttttacagataattttaaatgttgtttcatttgttgcaattattttaattttaggctatgggttagatgttgtaaactatgcttttaggaagtgtgatgatctgcctgattttgattttaaaacaggctttgtcaatggtttaaaattatttgtaattcagttttgctactttatagttccattaattcttgtatatattacagcttatttttccggatttttacagtctttggcaggaataataaaatcatattatgaaactggcatctattcaatttcaaattcatttttaacttccatgtcaattacagttgttacagcaattgtgctttttgtaattttcatgttgttttccagtattggaatggccagattatctaaatatgatgatatttttgaggcagtaaatatttctaaagtttttaaagatttaaagaaaataggaatagctaaaagcatcggatggttaattttactgatgattgttggctttatcataactcttgtcggagctggaatttcagtgattattccagttgcaggttctattattgcttcatttattgttatgtcctatttctatctgttttattacagatgtgttggtttattatattcaaatatataaaccatttctttttttaatctaaaatttaatatagctttactgttaaatagttacatagaatatttttatttttagaggttgtttaatatggatttgggagaaaatattaaaaaatcatttgcatatcctttatgtgactataacaagtttgcaatgattggagttttgagtgttttttctgttttgtattcagtttgttcttcatttgcagggaataatcctggcgtaattgttatatctgttttgattagctctatatttttcgtatatcttatgggattttctgtttctgtaattgaatgtgggataaatcttgaagaaaagattcctgattttaaagtaggcagggatatttcaaacttttttaaatatcttgctttaagtattgtttatgggattgttcctggaattattatttttattacaattcttggaagcgggatattaaaaatatttactgatatctctccttatattcaatatggaaatacagatattcctccagatttgctttccagcttcatgtttgcttttttgattattcttttagtaacagttgttgtaacagttattcagtcaatttttactaatttgggagttgcaagaatggcagctaataacagtttttctgacggattggacttctttgaagtttttaatgatatcggaaaaatcggctggtttaaaactgttggatggtttattgtattatgtgttttaaatatggtatttttcatgatttcaatgggaattatgatgattccatatgttggagttattctagctgcatttttcatgatgacatttatgaaattatttaattcatattcagtaggattattatattctgatgcttataaaatcagtaaaactcaggaagatattaaagaaattccgaaagctgaaaacatcagtgaggaaagtgatgttttagatgaatatgaagaaatcagcaaagataaaaaggaagatacaatagacagtatgtatggtgaaaaagatgagtaagaaagtagttatattgcacggcagtccacgtgtaagtggaaatagtgatatattagctaaagaatttaaaaaaggatcagaagatgcaggaaatgaagttaaaaaaatttcatttccaatgagatttattaattattgtaaaggctgtttaggctgtgtatcttctggagaatgtgttattcatgatgatatgtcagggattttggaagatatggtagatgcagatgttattgtatttgcaagtcctatttattttaatacaattagcggacaaatgaaaacaatgattgacagattaactccaaaagccaggcagttaaatgataaggattattatttcttattttccgcagctagtgataatcaaaaatcattggaacctgcagtttgtgaattgagaggatttttaaattgcattggtgttgaatctgaaaaaggcattgtttttggtttgaatgctgaaagtgaaggtgaaattaaccataatgaaaatgctttaaatcaggcttttgaatttggaaaaaacagttaattttactgtgattgatttcacaatttttcactcttttttatagttaacttcgctttaaatactttttttaaagatagtattaaatattgtttaaaacataatatataataaggtgaagtaaatgaaatttaaaataaccattaatgataatgagtatcatgcagatatggtggactgtgatttagtaaatcagatagctgatatgtgcccttttgaagttactttcaaacagcatcgcaatcaggagtacttcactaaattgccaagtcaggctaatgatgatggctgtccattaactacaactattttaaagaataaattatactattatcagcaatggaatgcatttgtcatcgtttatgaagatacaaatgtcagtccttacgaattaacctatgttggtgaatttgatgaggatgttagtgaatatcttcaggaagcaggaagaaacatttttgttgaaatggatgcagaataactctattattaaaaagctatattacatatgttgtatataaatagtatgtgatgtggtgattttttatggagattactataaatttaaaaacagtttctacaattgtagctattgtagctgtaattattggcataattgaagggttaaatgtttttagtttatctggtctggttccggattttgtattttacggatctttagcaataattatagctattttaggtcttttgggagtttatatttctaaaatggatattagaatagctgcaattcaatatataattcttggtcttggtctttttatagctattggctattatggcgtgattggttgtgtcatatttattgttgctggtgttttagctattgctgaatatgtacaaactaaagaggaagttacaccagacaaaaagctttttttaattcctgttttaactattgtcataattgttttgtttttgcttgccagtgcagggttaggtgttttagatagtatggctgcttcagattctgtatctttcagtggtttgagtgttgctatatctaatgattatggtgttacctccggtgatttgacaggaacattaaatgttgataaggattttgattacttggaagttaaagttcgtttttataattccaataatttaacattatatgaatcatatgcatataccggaagtaatgttcatcctggaaaatattcagttgatgcattttattatggaaatgaaatgcctacaaaagcagtaattgaagtatataatgaggttaatggtgacccgattcatacccaaaatgtaaatattaattaaatgttatccaagtaggataacacttttttttattcttcaactggttcataaatcagaccgattccgcgggttttaaataattcggctaatgcaattatcaatgaaaatatgaggtttgtaaggaaaaacattgcccaccagagaggttccggtgatgtaagtgtatttattcctgaagttccaataatcatcatagctatcatggtgattgcaaacagcacaaatgcaattacacattctattatcagcagtccgatatagaataaaacatatcttgcagggcctattgtcatgattacttcttttatttctttaaagtcaaatgcttttttgaagttgtcatgagcagccatatttgataggcttatgaaacttacaaaatataatatgattgccaatatcagggatattgttgctccggcagtttggattattcctccggagatgttgtctaaaaatggggtagtggtaacagccagtattattatggggactgcaaagtatacgaatttaacaagaaatatttttactccgtttattagcatttctttcaggttattaaattcaggcactttatctgttccgttaatcattccatgtgttgagatttccagtattctgtattcatatcctaaaaataaaaatattggtattaatgttagtaatgaaggtacaattaaactggcgaattttaaatttaaattagcatcctgataatggattaatattaaaatatatgccatccatatgataaaagttgaaaataatgttagtccaaagtaaagtaatgattttgagtttttaattgagtatttaatgctgtcattgtatatgtcaagtatcatttttttcctccagtatttgcagcaactatgtaaaatatatgttacttatgtaaaattaagtttacatcatatataaatgtatggtttatgttacatatctggagtaaaattttaatgtagaaaaaaagttttaaaagaaaagaaatgaatcttttctttatggtcttaaaccggatccgccttggagagttattgtttctccggagatatagcttgcagcttcagatgctaaaaataagcaggttccaccaatatctttttcagcatcaccaaatctttgtaatggtatgccttgtattgttttttcataaatttcaggatattcttccctccactgttctaattgggcagtcattacaagaggacatacaacattgatgttgattccgtcgcaaccccattctgttgcagctactcttgacatacctctgattccttcttttgcagcagcatatgatgactgtccgtctcttccaaacaatcctgcaccagatgcaaagttgattacagaacctttgctttctttaagatatggataagcatatttcataaaattaaacactgcatataatccggagttaattgctaaatcaaagtcttcttttgtatgttctacaagttttaatccggatttggaagcttgtgcattgtttattaatacgtcaattcttccatattcatcagtaatctgtttgattgcatcttttacctggtcttcatatccgccgtcagctacaataggcaatacttttacatcatatttgtcttcaagttcttcttttgcttttaaaagtgtggattcagttctacctgtaattgcaaggtttgaccctgcttttgcaaatgctgtagctataccaaatccaattccttttcctccaccagttattattgttacttttccactcatatcgttgttaataaatactcgcctcttaacataaatataacgaagtatatttatcacgatttataatatgctttttgtattatataaaatttgcttattgatttttattaaaagggattgtactgatttattttcatcagtggcggattatgtgtcttatttaattttataggataaaatttaaacatatgtttaaaaaaagtagaacaattttataaaaaagtaaattaaaagatttctattaagactgtgtggtgttgttgtcatttgagaaatctgctttgtttcggtcaaaatcacctgtagcttcttttatggcattgccgtcatgtatgatttcaactttgacatgatctattgctaaatatttgggactgttgtaaaatgcaaaacaggaaccgtattcgctgttgtctacagtatttaacccttcagttgtagaagctaatgcatttccattactgtcataatatgttgttttcagaaggtaaccctgggtatttgacggaagattgctaaatatagcatttacattgtaataataatcgctttcctcaccggttgctgaaatatcagtaatggttattgagatgctgtcgggattgtaaaatatattgctgctgaaaatagccagtcctataattataataactataactgcaacaggaattaatattttgtttttaggaaggttaaatgaagctttgtcgctaaatattttagaatccatatcattatttgatttagttttatctggagcttcattaaataatatttcatctgcatcttttttaggagtttcagcttcttcagttttcataacttctttgggagtttcttcatctgtatgattattgtcaactaaaacagaatatccgcattcattacaaaattgtgcatcatcaggcagttcatttccacatttcggacaatatttgctcattttgttttcacctctattataaattgaatctgtattaatatgtatataatttgttattgatatttgtttttaaaatttttcgaaaaatttatttattattaatgtttatttttaattaagaggttttttatatggtagaattaaaaggaacaaaaactgaggcaaacttgaaagcagcttttgcaggagagtcacaggcacatactaaatatgaatactatgcaagtcaggcaaaaaaagatggctatgttcagatttccaatattttttcagaaacttcacacaatgaaaaggaacatgctaaaatctggtttaaactattgcatggaggcagtattcaggatacagcatccaatcttaaagatgcggcagaaggtgaaaatcatgaatggacaagtatgtatccgacttttgcaaaagaagctagagaagaaggatttgatgaaatagcttacttatttgatgcagtaggagctattgaaaaagaacacaacgaacgttacgatgttttactcaaaaaagttgaggaaggcagcgtatttgtaaaagaagaagaaattatctggatttgcggaaactgcggacatattttcaaaggaaaagaagcacctgaaaaatgtcctgtctgcgctcatccaaaagcatactttgaaaaaaaggcagataattatctctagatttttaaaatctggacttttttcttcttttttttattgtaaaaaggatttaaatttaaaaaaaagttaaaatttagctatttgttaatagctattaattttttagcagctttcatatcattgctgtagatatggccgctggtggagtggtaatggattcctccgaagtttactttttcacctaataactctttattaagctcttctttcattttaattccgatatatgttataaaaaacatatttgaatagaaagctccaaagatgtcgttggacctgaataagcagtggattgttaattcattgttacggacaatacattgcaggaactgtaaacatggaatgtcttcacggtcctgatccaatttagggtcatatgtaacagctactgcacggttacttccaattgcatgcaacattctttttttcatcacttcaaactggtcaacatcaaaatgagccaatattcggtttggataagtgtatacaaaaccctgatcgtcactgttttcaaatgacttaacatattcatagagtgcatcacttttaataggacagccttcaatatcgtactttcctgatttgatttcgtttagcatcatatcagtagtcatatgctggtattttgccacaaatttcaagtttaacggatcatcaattacgtaaaaattacctaaactttcttttaaatggtggttgctgtctttatatgtttcctttccctggtttaagatttttttaacaaaatccaaataacattgattgatagatagcataataaaataattccttataattagttattttaattttagtttcttttatgatataaatttaaatatttttgtttataaataaatttataattagatttattaaaatatgcttaattgaaatatagtttacatcgctattttatttatgatggtacttatgtaattatatgataatttttgtatattgcctttattttcgaaataaatgttatatgtgtatttatattagtaaatctaatgtattattgtataaaattatattccatatatatttatacgatattataaaattaaattttggaggaacaaaaagtggtcaaatgtgttaataagtcaattgtacttttttcggtatttttgttattattaatgattgttccatctgcttttgctagtgatgctgttgataaccagacagtcattagcagtgatgaacagattgaaatttctgctgttgatgacggtggagttatttacagtcatggtgaagatactaacgttcttacaggttctaatgatatatatttcaatgcatctgctgaaagtgacgggagaggaacacaatccagtccatacaagtacctgcagtataacagattaacttcaggctgtactgcccatttcgcagacggtacttatgagctggattctaaaaaaggaatatattcttccatgactttcatgggtcagagtgctcaaaatactatcattaagtttaatggtattgcttttaatgttggagatggctatactttaactttaaaagatttaacattggatcatgcaactgttaagaatttgggtactgttagtgcaactaatgtaatatttaaaaacggtgtagctgttgatgatacttcttacggatatgataatgcatacggaggagctatctacaattatgtcagtactgattattacggttatgtgactaatgtgcctaaaaatacattgtataattgtacatttctaaataacagtgcgatgtatgggggagccatttatctgccttacggggaattatctctttcaaattgtaagtttattaataactctgcacattggtttggcggagctatagcttctgataaggattctaaaatttctgttgtcggcactgtttttgaaaactgccgttctgtagatgatgcaggaggagctatttatgcattttctactgatctggaagttagagacagtacttttaataattgttctgcaaactttgcaggagctatctgtagtttaaattctgaaattttaatttcttattctaattttacaaataatcttgcaagatatgaaggtggagcagtatataaaatgtatggttcaggaactgttataaagtccaactttactaaaaatgctgctttaaacggaggcgcattatttagcgataactgtacttcttttgaaattaaaaactctgaatttgcatcaaatgcagcaacaggatttggaggagcaatattttccaatgcaaatcctaaacttacagttgatggagttacatttactgacaataaagccagttacaatgccaacatgttaaatcagtctaatttcagtcctattgtatcaagcaccaataattactcattatttgtttacaaatcattatttaatggtacattgcctgcaagatataatttagctgaaaatggttttgtaactgatgttaaaaatcagcaggattcaggtaactgctgggcatttgcagcacttgcttcacttgaaacctgtgttttaaaagcaagcaataaaacatttaatttttctgtggaaaacatgaaaaatttaattgaaatgtattctgcctacggctggaaaatggaaactaacgagggtggatataacggaatgccgatgggttatttggctagctggttaggtccggttaatgctactttggatccatttgatgataagggaactttatctccgcttttagacagtgaaatgcatattcaaaacatttatgttttgcctgcacgtacaagttacactgataatgatgctataaaagaagctattttaaaatacggcggattatatgcttcatattatcactcagcaggttatcttaattctaaaactaatgcttattatgatccatacacaggtaatggaaaccatgcaattactgtagttggctgggatgacgattattcaaaaaataatttctatactgctcctgcaggtgatggtgcatttatagttaaaaacagctggggaagttcctggggagataatggttacttctacatttcttactatgatagagttttatttgctgtaaataaagataatcaggcatttacctacattttaaatgatactgtaagatacaccaaaaactatcagtacgatgttgcaggaatgactgattacttaataaccggtaaaaaaactgtatggtataagaatatttataatgcaacaggtaatgaggcaattgctgctgtatcaacattcttcaatacaactgttgattacgaaatttctatttatgtaaatgatgtattgcagcttacccaaaacggcagacatgaaggaagcgggtattatactattccattaaaagaatatgttcctgtagctgttggggatatcttcaaaattgttgtaaaacttgcaaatcctcaaaacggatatgctgctgttcctatttcagaacaactttcaacaaccagatgttattatgctccaggtgtatcatacttcagtaatgacggtaaaaaatggacagatttatatgattactcagcttcagcttatagccacacatataattctcaggtagcctgtcttaaagcatttactgttgctgatatgcagaatacaacagttactttaaataacattgctcctaaagttcaggagttcagtgaaattatagctactgtaactgacggtaaaggcaaaatggctaaaatcggtgaagttattttcagcattaacggaactaattatacagctggtgtagttgacggtgttgcaaagattaatgtatactttgatgaagttggagattatgtaatttcagctaactataaaaataacggattgtataacggatctttcgttcaaaaaaccgtcagcgttaccaaaaccgatgttaatttaactgcttatattggcgatattgtttatggtgaaaaccctattgtcagtattaatgtaacttcagtagctggtgttaatgtaacaggtgatgttgttttaacaatcagcggcaaaaaatatattgttaatgttgtcaacgctttggctgtatttgaaatacctgaaatgttggatgccggagaatatcatattgatgtatcttatttgggcagtgaaaaatataatactgctgatggcactgctgattttacagtagctaaaaaagaaatcaccatgaatgtaactatagataaagattacagagacataacagtaaatgttaacttgtctgaaaaacttgatggaaatttaacagttcttgtaaataatacaccttacacattatcttacactaatggaacaggttcattaatatttaaaaacttaacttatggaaattatacaatcagtgcagttttcacaaaagataactaccagacagttaatgtatctgaaaatgttgaaataaactccatcaaaacagttttagaagcagaaaatgttgtaatgtattataaagacggcacaagatttgcagttgtcctgagagatatttacggcaatccgttagctaatatgaatgtaaccatttcaataaacggcagaaactatgttaaacaaagcgatgaaaatggtactgcttctttaggccttaatttggagagtaaaaattatactgttgttaccacatttggcggaaattccaaatacttcggaacccgttcaaacaatacagtatctattttatcaacacttatcagtaaggatatagttaaatactacagaaacggtacacagttctatgcaactgttctggatttcaagggaaatccgttagccaatacaactgttatgtttaatataaatggtgtattctacaataaaaccactgatgaaaatggtactgctaaattaaatatctggctaaggcctggaaaatatattattacaatatttaatttggttactggtgaacaggcaggcaataatgtcactgtattgtctaaaattgttgaaaattatgacctggttaaatactataaaaatgcttcaaaattctcagttaaaatcttagacagtcagggatatcctgttgaaggaactattgtaacattcaacatcaacggtgtattttactacaaagaaactgatgcaaatggtatagccagtttagctattaatttaagacctggaaaatatgtaattactactatgtatggtcagtatgatgtaggaaacaatgttactgttctgccgacattacaaactagcgatttaaaaatgaagtatcttgatggttcagcattcaatgcaagagttgtagacggtcagggaaatccattagctaatcagattgttacatttaatgtaaatggtgtgttctataataaagttacaaatgatgagggtattgcatccttaaacattaggctaatgaaaggggaatacatcattacttcaatatacaatggatttgaaaccggaaatacaattaaaattcaataaggttttttaaataaaacctttttttctttttttgttatataatttattttaaatatatgtatttgcaataggaattatcttattttcaacagttgctttaaaatatttgcaatgtctttaattaaataagctaattttttaataacttatcatttaattagctgattttgcaatttaattaataaaaaaattttgacaaaaaataaaaaaaagttagagttcttacattatgaactctaaaaccatataaatgaataaaagtgcaaataaaatccacattgctttggatatttcttttgctttaccgaataagactttaacaataacaaatgcaaatacacctgcaataatacctgttgtaatactttgggtaagtggagttacaataatggcagcaagtgcaggaatcagatcagaaagattgcctgtatcaaggtttttgtacagtccgcacattaagatacctacaacaacaagtgcaggagctactgcaaaggttgggatgattgtaaatatcggtgcaaacggaattgcaagcaggaataaaataccaactacaatagctgtaagaccggttcttcctccttccataatacctgtagaactttcaatgtatgtaactacaggtgaagtacctaaaacggaccctataataggtccgagtgcatctacacttaaaacctttttaagtcttggcagtttgccgttttcatcatatccgtcaacttttgttgtaagtgcagttaaggttcccattgtatcaaataaagagattaccagaaatgtgacggcaatgattataaagtcaataaatgctcttactccggtaaatactccgctagcttctccgaatttaaatgcaacattaccaagtgatccgcccagattgctgttgattatagctgttggtattaatgactggtcaggtaaaacaggacatcctgccagttctaaaacaactccgataatgtatgttgcaataattccgattagaatgtttccttttacatttttcttcattaaaaccattatgatgacaaaacagattaatgccaaaaggtttccgagagtaaaaatagttgaagcgcttccaagtcctattagctgtgtggcccagtttgcatctccgatatttattacctgtgaagagtatgacaggattccgaggttgcttaaacctaatgcaaggataaataaacctatacctattgatataccgaatcttaaagagtcaggaattgaatagaataatttttcacgtagggaagtaagtgagataaccagaaagattatacctgagacaaagatagctaaaagtgcatattcccagctgtatcccatagtaagtactacggtatatgtgaaaaatgcgttaagacccattcctgcagccagtgcatatgggtagtttgctatatatcccatcaatattgtagctattgcagctgaaagtgcagttgcaataaatactccttgtatgtccattccagtttcacttaacattgcagggtttacaattaatatgtaagccatagccagaaaaattgtaatacctgcaatgatttcagttttcacgtctgtattattttctttaaatttaaaaaaagcatctaacttagacatattattatcttttttaaataatgctttataagtttttatatttaagttcagtttctttcggtttttttaggctgtatattcaaattgtaatttatttttagcatttatattcatttttaatttgcttatttaaaatttgtttcattttctaatttcttcaaaatattcttcgggttttgtcaaagtattactggctttttttgaacagcttcgggaattgtacaattgtgttaaaattaatagaatatattgtgttaatatagagatattcttgtaatattctaattattatatagttgtctgcaaaaatagtattgttttgtttaattttacattttttagataaagcttaaatttgtttatcatatcagcaattttcaaatgaatttttagttgtttttatataaataatatctaaaacatggacaatttatcatatcttataagacaatattaccacaaagtatatattacatgctaatataaaatataaagcaaggtgcagattattaaaaattaggtcttatttttaaaaagcaactttgaaaaaatgtggtaactgtgaatagcaatgatgaattattgaaaaaatgtagctatgttgcaatttctagctacaggcgaaaagtactggaaaccttaaaaaacgatgtcaaaataccaacaaaaatcagtgaagaatcaggagtaggaataaaacatgtcagcaatgtactgacagatttaaaagaacacaacctaatagtctgcattaatgaagacgcccacaaaggtcgtctgtatcgtctgactgatgagggtaaaaatgttgtcagtatgattggagaaatgggatggtaaactcctttttttaaacagatgtaaacccgtctccgcccattatccattttttaccatttgaatcttcaaccagtgcagattccatgtctcccatataattgtattcaacaattctgtatttttttctttgaagaatttcatctaaactttgggtttctccggttttcaggataaaagtatgatgagcagctgaagtatttttatggtgaatgtttatttcatacctgattttaatgccatactctcctgcaggaacattgctggttttcaggacagctattccattttcatcagttgtaaggttaaaggaatttgatccaaatgaaatggaaatgttctgattagctatcggatttcctttggagtcacataactctacactgtatgcatcaccgtctttaagagtgtctgatgattttacactgaagccggtgctttcatgagtatctatgcaaataactgatataaatacaatccccaagataattgcagcagctgctaatatttttaccaggttttttcattcatgcttgttatttttatactttttaataacaatatttaaatactaattaaacacaatattataacatagacctgatttaataatctgcaccaaaattattaaagttatggcaggtctttgtaggaagtatgtttctaaaaatgtactcctacttaaaattcaacaataaatgaataactgattataattttaatcataaccttctgattccagataatcatcaatatcaggattgtctccgtattcatagtggtcataataccagtctggatcatttttggcaagtgtatcgggtgatgtatccactcctctgtaatgtgatgaagggctctcatagctgtagcttacatagttggatgtgtctgaatcatctgaaggatagctgtctgttgatgaaaagctgatgagactgttgagggttaggattaaaattgcacatattattaaaatagctattatcttattttgctgattccagtttttaaaatcattaatcggattcggactggaatttctgttggcaatttgaacatcgttatatacttcataaaatccgtaaacccaaaccaaaacggataaaatgccaaatatatttgaaaaaaatgccaaagcagcaaaaagtactctgagtatcagtaatgttaatccttttttggtatttcctgcatagattgaaccaagtcctgtcagtataaatgtcagtaccagtgcaatgtatatgtttttgttttttattttctttccgcatttggaacagaaagttgcattatctgcaagttcacatccgcagttattacaaatcatctttttaactccttatggtgattattcaatttttgatatataactttttttaaataattttagtaatatttatatacaataaagatacataattgttattaacgtgttagaattaatggattatataatgttttaattaatttctgaattgctgaaaagttattatcggtccttaaaatcaattaaaaaaatttatatgtttattaataaaaagttgattagctttaacattgcagaaaaccatctattaaaataaggattgtgactctttttcattattatgataatcttggaaagatgaatcgcaaaaaaccatctactaaaacaaggcttaaatgagtttttatcataaccaactatttccagttgatttttataaagtgaattctaaaaagattattaacaaattgttgcagtgttatatatgaatgttgaaagtttacaaatcatttctaaatttatgaatgattatgaatatgaaaaagctatgaaattatgtgatgagcttttaaaaaaagataatgaaaacacccatctctgggctttaaaaggatgctgtttaaatcattttgaaaagtatgttgaagcaatggagtgttacaacagatccctaagtgtggatgatgaaaacccttttatctggtttcatgtaggtaaaattttaatggaatatgatttatttgatgatgctctggagtgttttaacaattcattggaaattaatcctgctgatgatatggcgctgtattcaaaaggtgagtgcttaatgtttaaaaaatcatatactgaagcaattatctgttttgatttggctattggttttaatcccaaatatttgaatgcatggttaaacaaaggtcttgctttaaaattgtcaaataattttaaagaggctttagaatgctttgataaagttttgtttattgatcataaatcaaaagatgcactttattttaaagcagactgctattttaatttgggagatttaaactcagcattgaaatgttgtaatgaagcattaagtattgacggggattatttaaattctgaaatcttattgataaaatcagttgttttaatggatcttggagaatatggtagtgtcattgaagcagcagatattgcactggaaaataatcctgatgattacgatttaaaaatgttgaaagcacaggcactagcttttgccggagaatatgcggaagctctatggcttgttgaggaacttgcagatgaaaatcatggagatatggaattgtggaaattaattgagtatattaaaatgcatatttgagaagaatttgtttatttaagtaaatttcataatttctctttgtatgcttgcttaaataagcttataaagtaatcaatatcttcatcattagctattttcatttcataatcaccaataccatggtggccaatattggaaacatctcgggttttgttaaatggatctatgagtttagtattttttaaattaatccaaccttttaattgtcctttaaatgcttcaattgaaattataattttattactggttttaaatacaatatataatttagttgtaacaatttcaatatcttcaaattcatttaagattctttcttttaagttttcgtataattcttttatattatcaggtttattattaaaacacatttcttcagtgtatttaataatttctttattaacatcttcttttttattcgttgttttaacttctttaattgatgctttattctcagaaatatttaatttatcatataatactgtattatttgaatatttggttaccttccataattcaaaagccaaatcattaaattctattgattttaattggtatgtggtgtagtttggtgctataaacattattttagattgtgtaaaatcaatatcttcttttccataattagtattgaatttctgattgtattttaggacaaattcagctttattatttaaaagtagtgatagataactgtaaccctggtcaataacactgtaatttttactttttttatattcaataattacaaatgagttagtttcttcattgaaagctagtgtatcaattcttaagttatccagttgaaattcactagctacaaattttaggttaaatacttcttccatattattttcagttaacttttgaaggtctctttcgtatttaaactcagttttcttaataggttttagattattggcatcaatttgataaagtggcatggttaatattatattttatcttaatttaaatttttagataaaaagagtctgtaaaattttacaaacttatatgttttttgtccaattttgcattgggtagtctaaggttattggatagggatggtttactttgtttcaacttgtaaattttctttttaataattaattaaaatagaatatatgaattataatgatatattccaaaaattttgtagaaatcgtaatattaaatccagtaccaaaaaaggttatgattctgctttaaggttatatgaaaattttcaaggaaaatctattgaagatttatttgatgaagcacgtttagaagaaaatgaaagaattcctcttaaagatagaaaaataaaaaagagattaattgaatttagaacttttttacttaatagtaatttatctcctaatacttcaaaaacatatttttcaaaagtaaagacattttacttacactttgagtttgaactacctcatttacctcaagctaaatatgataaaatttatgagaccaattatttagacttaccaactcgagaacatatacatgaatcactacttatttcatcaattgacttaaaagcagtgatacttttcatgtccagctcaggaactgcaaaagctgaaactttaagtttgactgtagaacattttattcaaggtactcaggagtatcaccatggaggatccattaaatttattctagaaactcttgataaaaaaacaaatgttgttccaacattttatttgaaaagaattaaaacagataaatattattatacattttgctctccagaagctagtttagctattgtcaaatatttaaagacacgtgagaatttaaaattggaggataaattatttgattttacatcctcattattgttaacccgatttcaagaaataaatgataaaatggagtggggatttaaaggaaaatatagattttttagaagccataccctacgcaagtttcatgcatcaaatattggcctttctgctgaatatattgacagtctgcagggacgcagtaaaaacgaagttcatgaaacatatattaaaacaaatcctaaaaaactaaaagaaatctataaatcagctatgaaaaatgtgatgatttatgaaaataaaggtccagagataaaaaaacaagaatttaatataataattaatgtttttttatctggaaaggaatataatattatttaaatctttttaagaaggtttatctttttggttttggaaccttcttttttaatttcaatattttggaattttgcatagtttactttaacaccatcatctaaatctatttcaatattttggtttgcaatgtgtgctagaacttcatcatattcttgtgtttcttttaattgtttttgaagtttagctttttctttagttgcacgggttacttcttgttttgatgtagaattgttaatgatattgtcattattggttattttctgttctattgctttttgggttttatgtaagtagtctgttctgattcttgcaactaatgatggttcgtatctgtgcatataaactaaacagttgaaaccgttatgtttgccgcttgagaattgccagtatattgggcattttttgtatgtccttttgtggtcgttaaagaagtttttaagtaagtattgtcttatgatttctcttgatggtttttttgattttgatagtgctcctgcaatgaaatctaagttttcttctagggtttttttaccaaaacaggtttcaacaaatttagtaaaatatcctacaatatcatcatcgaaatacgcagtgtctaaaactggaattatgttgtcatcatctggaataaatttattgtagttagtgatgttaaatttacctccagcgaattgtagtccttttttatctagtgagtaacgtccaaacatgcatcctactgcaaaagatataaaagatgtaattaaatcattctttgataacagattcattgaaattgaatctttggatatattataatctaattcattggttaacttgtatagttttataaagtatttatttaaatattcttcattgcttttcaatttattaaaatcaactttttgtaacttattaaattttacaattgatttttcaatttttctttcaccaaatattaaaagaggatggattgtataattccaacttatttcatgattatcccagttatttttttgaatgattatattttcggatacaattttgttgattttatttaaatttgaattatcaagtatgatgggtatattactaattgatcctattccaaaatctaacgttggggataaaaaggataatacttccattgttacttttgaatttaataatgcaaataaataattaaagtaaatttcattttttataatgcagtttgctccttttgaatcaaataaaaatccttgttcattatatctaaaagagatatcactactacttaatgtagaccatgttaatgattttttaaaatgaaattttggatttcttattgttgaatgtttaaaattacgtattttatatccattatttttccaattaattattaattcattatttccaaaccattttctaaacttccctcctttattgtaaggaaaccatttttctttaacatttttggtttcttccatagaattacaattaaaatttatattattgaattccacttcaaaccattttcttaaaaatttatcattatttccagtggaaattcctgcttttggatatgcatattcaattaattttttatttttaaatgaatttgtaacatttaaactagcccaataagctataggggaagttggaatgttagaatattttttactatttgagatatatttgtaatcaacaggattagatatggcttttaaaactttatttctttgtgtatccatgtttcctttaaaattagataattttatatatattccattgtataaaccattagttttattttcattacaaaagatatatgttgctactgggaccattgcaacttctgtaaatgcattatattctagttgaattaatgaagaaatttcaagatttttcaaaatgtattctcttaatttttcataagtttttatgaacatccaattaaaaggagtaataaatcctaaatatgcatttgattttgtgaatttagtgtttctataaataaacatggaaaataaatcttttgaataatctttgtagtattttttagcaaaatcttttaaatttttctcaaatttattcatgtaaggaggattagtcactacagctgaatattttttagataataattctgcttgattaattaaagccattaaatcattactaattatatttgtaatattgatatcagtgagtgttgatttagaattatcaattatttcatttaatgatgttcttaagttgttaaaatcaatatttttcacttgaattaaagaaccaaattcttttccagactcaaatatttcttttaaataaattacatcattaacaattttttcatcatgtttttgtataaactcaattattgaatcagtgatatttccagattcctgaatagcataaacattaggaacaatacctttttgaagtatttttctatcatattttctagctttcattaacactgcaaaataagctagttgatatgctctatcatcaatatccaaaccaaaaatattattttttaaaattaattcaggaatatctcgttctaaataacctaactctttataaatttcaaaaaatagatcgaatgcataaactagaatgtgtccagatcccatacatggatcaaagaatgttaattcttcaacagaaatattctcagatcttatttcatcaagtttgctttgagtttcttcatcttgttgtgcttctccaagataatattctaaatgttcttttaatgaactgtttggatttctttctatccaatatctacctaaagagttatcaaccatatatttaacaacccaatcagttgtaaataactgagtagcagcaggaatatcctcttttttaatattgcttttgttaatgttaattacttgattttttttctctgaaatataatactgatataaccaaccaataatttcaacctgttttgtgaagtcctcttctggaattgtgtcaattaattgtcttacaacaccttcttcacttgtaaatgaaatatttaacagtaactctaaagaatcatctgttgttttaaataaacctgggagaatttcatttaatttattactttgcttaataaataaaaatcggaataattcatctaatttattttcatctttcaacttgaaaactggtgaaactatggataaaactattttaaagaattttgcggtaaattcaagaaataaacttattgaagatacaatttatagattaagtctacttggaataactgaagatgaaattcaagaccctattgaagctgatgggatgcaaacattccaaataggtggcacaaattttagtatttatgatgatgacataaataaacgaaaagagattattgaagatattgaatctaaaggtttcaataattttgttgaagaagttgcatacacatggtttaatcgtataatagctattcgttatatggaagtgaataattatctaccaactaaaacaagagttttatccagtgaaacagcaggtaaaatagaaccagatattttaacagatgcattagatattgatttagattacactcaagaagaaaaagaattaattttcaagttgtaacattttatatacaattatgtttttgtaaaaaatcatttttataattatctctatttatagaaactttgatttttgtaatgaatacggatataatgcattaatgaccccctttgtatggatgtttattaaaaactatgagaatctaaggaaatttatcattaacaataaatcaatttcatcattaattcaattagaatactcagcattttcagaagctactgtaccaatatgtacttttgtattatctaattttgatgaaaattatgcaggaacatatttgaaattatctgagtttactggtggaatggatgttcaaaaagaaaaagttcttcagattattaatggtgatgaaattcttaatgataaaaacaagtttataatgaaaaaagaaaactttaattcaattcctggaaatccaatttcatattgggtaaatgattcgattatagatatatttaagaattctaagaaattagggaaaatagtagctccaaaatgtggtttaaaaactggtattactgaaaaatatgtccgaaagtggtttgaagttgattataataatattggttttgacataccaaatagagaaatggctaaaaaatctatgttaaaatggtttcctgcatccaatggaggacaatatagaaaatggtatgggaatatcgaagatgttgttttttggtatgatgatggttatgaaattagaaatttatttaatcctaatggtaaacttaaatctagacctcaaaacatgcaatattattttaaaaaagggttaacttggtctgcattaactagtaaaaaactttcattaagactttcaccaattggaaatataataactggtgcaggttatggattatttaataatgaatttagtttattaacaattatggggtttcttaattcaaagatagcaacttattttagcagtattttctcagaaacattaaattttgaagtggggatattaaatagaatgcctattcttattaaagaaaattctgaaataaataagttagtctcagataatataacaatatctaaagaaaattgggataattatgaattttcatttgattttataaaacatccttttatgaattttaattctgatttgttaaaagaatgttatgagatgtacgcttctgattttaagttaaaattcaatgaattgaaaaaaaatgaagaacaaataaatgtattctttattcaagaatacgatttaaaaaaccatattaaaaaaaatgttcctaatgaagatattacactttttaaacctaatttaactgaagatattaaatcttttatttcttatgctgttggttgtatgtttggacgttattctttagataatgaaggtttacaatttgcaggaggagaatttaatattgataattatcataaattcattccagatgaggataatattatcccagttttagattctgaatattttgaagatgatattgttaatcgtttcgtggaatttgtaaaaatatgctttggagaagaaaccttggaagaaaaccttgattttatagctaatgcactagctaaaaataaaaaaccttcaagagaaaaaatcagagagtatatgcttaaaaatttcttcaatgaccacaaaaaaacatacaaaaaatgcccaatatactggcagttctcaagtgggaaagaaaatggtttcaattgtcttgtttacatgcaccgatatgaaccaagcttagttgcaagaatcagaacagactacttacataaaacacaaaaagctattgaacaagcaatagctaactgtgataatattataaatcactcatcatctaatactgaggttacaaaagcaactaaagaaaaatctaaacttcaaaagcaattaaaagaaacacaagaatatgatgaagctcttgcacacatagcaaatcaaaacatcaaaattaacttagatgatggtgttaaagtaaactatgcaaaattccaaaacatagaagtttcaaaagaaggaaagaaatctaaaaaaattaatttgcttaaaaaattgtaactttataatacaaaattggaatcactagcgaatgttaaacaaggtttagctactgcagataataacagattcctaagatattggtgggaagttgattttaataatattgggttttcttcaataaactgcgaagattcaaaaaacactaataaaaaatggtttccctacaacaaaggtggggattatcgtaaatggtggggtaatcaagaatttgttgttaactgggaaaacgatggatatgaaataagaaatatcataggtcctaatggtagagttagatcaagagcccagaatactcaattttatttccataagtcattaagttggtctaaaatttctagtggaaaagttgcatttagatattacccaaatggatttatttttgatgtagcaggatgttctgtattcttagataaaaaaaatataaattatatatttgggtttttaaattctaatatttgtggagatattttagatttaatatctccaacattaaattacgaagtcggtcatgtcgcttcacttccaataatatttgatgaatctaaacaaaatgaaatagaaaacttagttataaccaatataaatattgaaaaagaagattgggatgaaaatgaaacaagttggaactttaaatcacatccatttgtttttttcaaaggagattcattatctgaaaagtataatttctggcaaaaatacaaaacgaaccaatttaattatttaaaaacaaatgaagaaaaattaaataaactattttatgatatatacaatgttgatggtgatcatgaaattgaagataaatatatatcccttaataaaaatgatttaaaaaaagatattgaatccataatatcttattcagttggatgcatgtttggtcgttataatttaaatcaaggaggcttatgtttcgcaggaggtgaatttgatttaaataagtatcataatttcattccagatgatgataacattattcccgtattagacacagcatactttgatgatgatattgtcggatatttcacaaagtttattgaaaaatgctttggtaaagaaaaactagaagaaaacttagatttcattgcaaaagtattatcaaactcatctaaaccttcaagagaagtattaagagactattttttaaagaatttctttaatagtcataaaaaaatctataaaaaacatcctatttattggcagttctcaagtggtaaagaaaacggtttcaattgtctaatttacatgcacagatacgagccaagtttagttgcaaaaataagaactgattacctgcataaaactcaaaaagctattgaacaaagaatagctaacactaacactatcattaataattccacttcaaaacaagaggttgctaatataactaaggaaaaagttaaacttcaaaagcaattaaaagaaactcaagaatatgatgaacttttagcacatattgcaaatcagaacattgaaatagatttggataacggggttaaatttaattatgaattattccagaatatagaaattaaaaaagaaggtaaaaaatctaaaaaattaaatttgcttaaaaagatataaaattaaatcttttttagaagattaatttttttatttttcattccttctcttgaaataataatatcttgaagcattgaataattttcttttattccatcatctaaattaaaagataaatttaaatttgaaacatggtttaatgcttcatcatatccaattgtttcttcaagttgtttaattaatttatttttttcttttgtgataattgctttttcagaacttgaatcagaagtatttagcaaattttcacaatctaataatctctgttcaattgctttttgggttttatgtaaatattctgttctaattctagcaattatttgtgaatcaattctatgagaatagattaaacagttaaatgcattattacttccactagaaaattgccagtagattgggcattttttatataatttcttatggtcattgaaaaaatgtttaagtaaatattctcttattttttctctacttgttttattattcttaattaatgcattagctataaactccaagttttcttcaagagtttcttctccaaagcaaatttttacaaattcaacaaaacgaccaaccatgtcgtcttcaaaatattcagtatccaatattggaataatattgtcatcatcaggaataaacctagaataattctcaatattaaaatttgaatttgtagatattaaacaatcatcatctaaactatatctaccaaacatacatccaattgcatatgaaacaaatgattttatatccatttcataatttgaactatttattgaaacatgtttatcctcaacattataatttgaatcaatatcatatatttcactaaaaatattatttaattttgtttcatttgatttaagttgattaaattgttcttttttataagattcccaagatttaaatgagttcttaagattattttcattaaattttaataatggatgtttcttaaagttccatgaagtttcataatcatcccaatcatctttacaaatcttaatattttccaaaacaatattatttatctcttcaactttattttcatcaataataatgggtaatgaagcaatatggcctatttcatagtttaatgttggtgaaattaagtctaaaatatttccacaaacatttgaatttaaaaaaccaaaaatataattcaaataatcatcaacaaatacagaacatcctgctacatcaaaaagaaatccatttggataatatctaaatgcaatttttccgcttgaaatcttagaccaacttaatgattgatgaaaataaaattgggaatttcttaaaacagattttttaaagtttcttaattcctcaccatcattttcccaattgataataaattcttgatttccccaccattttctaaatgatccacctttattataaggaaaccattttttattagtgttttttgaatcttcgcagtttattgaagaaaacccaatattattaaaatcaacttcccaccaatatcttaggaatcttgtattttcaccagtttgtaatccaactttaatatctcctaatgaacttaagtttgtattattaaaacaagctattaaattatcatcaatccaatatgctattggacttccagggattttatcaaaattaaattgttttattatgtacttgtttttatcattaaaaaacaatggattcacaatatcattttcaacatcagataatttcacatgataaaaagtactgttgtagttcatcaagtttatttttctaaatactgttgctgatgttccaaatgcaattttcattaccatattatccatgtgcaataaatttgaaatggttgttgtttcaattaatttctttctgaacttctcaaaacttgacaaaaacatccatgattgcattgtaaccatacaattaaatccataatcttttatcatttctaaacctttttctaaaaatacagcaaataaatctgttttagttaaaggaaatttagatttaatataatcttttaaatttggattcataccattatttcccatataaggaggatttgttactacaacatcatattttttagataataatatggattgattaataatatttttcaaaagattaatttcatctaaatacttaagtttagttaaattattatttgattcaaatttagaaattaaattatttattttttcaaaatcaataggttttatagttaatatgcttccaaattcttttccatttttaaaagaagatattagataattgaaagcatcttcaattgttctgtcttgtgaaatcaattcttcaataaactctttagaaattgaatttgtctcttcaattgagcataataatggtgaaataccttttgttaatattctacgattatattttctagctttcattaaaactgcaaaataagctagttgatatgctcttttatcaatatctaaaccataaatattgttttttaagattgattcacaagcatctttttctgtgaatccttctgaaacatatatgtccataagaacttcaaaaacataaactaaaatatggcctgaacccatacaaggatcaataacagtaatatcttctggttttaatatttcagattcttttctaattgtaattaattgttgttcaacttctggctcttgtttcgcttcatcaacataatatttccattttgattttaattcattattaggatggccttctaaccacaatcttcctacagaattttcaaccatatattttacaatccaatcaggtgtaaataattgtgttgcagcaggaattctctctttagaaatctttattcgttttttaagatttgcaaaagtttcatcttttaattctgtgttataaaattgatataaccatcctattacttcaacttgactttcaaagtctttttcaggaattgtatcaattaattgtcttacaaccccatcttcattggtaaatgaaatgtttaataatagttctaaatagtcatcggttttttcaaataaacctggaagtatttcatttaatttattacattgttttataaataagaatctgaataattcatctaatttattttcatctttaagtttaaaaattaactctttatcttcttgagtgtaatccaaatcaacatcaaatgcttcagttattatatcaggttctattttacctgcagtttcagaggataaaactcttgttttagttggtaggaaattattaatttccataaatcttatagcaattatacgattaaaccatgtataagctacctcttcaacaacattttcaaaacctttttgcttaacttcttttactaatctttctctttttgaaatatcattatcatatatactattagttgatccaccaagttgatatgtttctattccattggctgagcttattggttcataaatgttatctttatcaattccaactaaactcattttatattctacatcttccattaacttcttacgagaattaatggcaaatgttttaattgcagttttatccataatttcaccaagtttaattaaaactatatatatctatttggtgatattaaattgttgctatgtttatcgggaaattcaaaacagtcaaataatattttgaattaacaagacaaaaccaatgaaaaagattggaattatttatataatatatttaaaaatgcaaaagaatatggtagtattttagatattaaaaatattaattttgatgaattatttaatgatataggtacttatgaatcagataaaaataatttaaatcaatataaataccaaaatgaaattcaattaatgaaaaatattatccaacaatcaaaatttcttgttaaaaattatgatattgttgccacaaatcctccatacatgggaaatagtggtatgaatccaaatttaaaagattatttaaagaaaaattatccaaattcaaaatcagatttgtttgcagtatttattgaaaaatgtcatgatttctgtaatgaaaaaggttttgttgcaatgattactcaacaatcattcatgtttttatcaacatttgaaaaattaagggttgaattaattaataatcacaccataattaatatggctcatttaggagctcatgcatttgaagaaattggtggtgaagttgtacaagcaacaacttttgttaataaaaataatttaattgaaaattacaaatcaacatttcacagattaactgagtttaattcagaaagcaaaaaagaagaagagtttcataatgatgaaaataaatttatattatcacaaagtattttcaatttagcaccttcttttgaatttattttttgggaaaatcacaatatcttaaattcatttaaattatatcctccattaagtaagtatggtaaaccttcaagaggtttagcaacatataatgacaataaattcttacgatattggtatgaagtatcttttaataaaataggttttgggtgttcttctgttgatgattctataaaatctaaaaaaaaatggttcccttacaataaaggtggggattataaaaaatggtatggaaacaataactttgttgttaatttctataatggaggtgaagaaattaaaaaatctggaaagggtgcttttagtaatattaattattattttaaaaaaggattaacatggtcaagaatttctagtagttattttggagtgagatatcatgatgttggttttataattggtgatgctggaccgtctgttttaatgaatgatgattcaaatattttttatatttttggaatattattgtctaattttacattaagaataatatctgctttaaattcaacaatgacttttcaagttggtgatttaaataaagttccaatcaatatgaataaccatgaaaaagaaaatattgaaaaattagtaaaatcctgtatttatatttcaaaagaggaatgggatgaatttgaattatcatgggactttaaaaaccattatgcaataaaatttagtcaagattcatttgaaaatactttttttaaatatatggattttaaaaataatcaatataataaattaaagaaaaatgagtttatattgaataatttaattaataaaatttataatattactgatattcaagatagtgtagtgtctattaaaaatgaaattacattaactaaaatacatttagaagaatttgtaaaatcatttatttcatatgctgttggttgtatgtttggtcgttactctttagacaatgaaggtttacaatttgctggaggtgaatttaatattaataattactctaaattcattccagatgatgataatattattccagtcttagattctgaatactttgaagatgatattgttaatcgttttgtagaatttgtaaaaacatgctttggagaagaaaccttagaagaaaaccttgattttatagctaatgcactagctaaaaataaaaaaccttcaagagaaaaaataagagattatctccttaaaaactttttcaatgaccacaaaaaaacatacaaaaaatgtccaatttactggcaattttcaagcggcaaagaaaacggattcaattgtctagtttatatgcacagatatgaaccaagtttagttgcaagaatcagaacagattacttgcataaaactcaaaaagctattgagcaggcaatagctaactgtgataatataattaatcactcatcatcaaaacaagaagttgtaaaagcaacaaaagataaagctaaacttcaaaaacaattaaaagaaacacaggagtatgatgaagcactatctcacatagctaatcgaaatatagaaattgacctagatgatggtgttaaagttaattatgctaagttccaaaatgtccaggtttcaaaagaaggtaaaaaatctaaaaaaattaaccttctaaagaaactttaattttacattttccgggcaatacttcaaaacttttattattaattcaacacatactaataacagtgattatattatgaagtatagtgctggaattatgagtcattcattttggtatcttgaaacaaaaaacactgctgaatatctagctgaagatatttcaaaaaaagagttaatggagttatctttaactgaaaatatttatcaggtagatagtgaacgtagagcacgtgaattgactaatgtatgttatcgtcgattaaatggattttctaatgatttattaatatatttatcaacttgtgatcaaaattcaggtaaattattagttttaatttcaattttaagaaatgataaattattttttgagtttatgcatgaagtcttcagagagcatattattttaggaaattacactataaaagattcagatttagatatttttttcatgaataaatctaaccaaagtgaagtaattgaaaattggaaagatacaactcttcgaaaggttaaaactaattataaaaattttttaattgaagcagaccttttagaaaaagaagaagggaattataaaattattttaccatttgtagattttaaattaaaagaattattaactcaaaataatttaacaccatttttaaatgctatatctggaggaatctgatgaatattgatgagaagcttagtaaaattgaaccaaaaattaaagagccttcatttcttgagaataaaggtttaagtaatgaagtaggttattatatttttgattatgatccgaaatatgaacttaaagttcgtgaagaagtttcaaggattaaaaataaaatcaataattcaagttatgcatttactattaaagaatttgatttatatgaaattatcattgatattttaaatgaaagaggttatttagaaaaagtttttaattttgaagaaaaaaaagggatagaatttacaactaaagcaattatcagtcttttaaaattaaattcagataacaataatgttattgtaaactatattttagagagaactccagataactgtgttgtatttttaactggtgttggaaaggcttatccaatattaagatcacataatgttttaaataacttacatcaaaagttagacgaggttccagttgttttatttttcccaggacaatattctggtagagaattagttttatttaatactattgaaggaagtaactattatcgagcatttccattgattaggtgaacatatgcaaataaaaaacatgtttgaaaaggatatcgacagggatatcaaaggagtaattaaagtcggtcaaaatgatgatgaaaatatttatcaggaactggatgaatatgttgttacaaatgaactattgaaacattttactaagtttttttcaagttataataagggaatacaaagtcccactgatgatattggtgtttggatttcagggttctttggaagcggtaaatctcactttttaaaaattttatcatatattctagatagtaatcttaaagttcatggaagaagaccaattgattttttcaaggaagatggaaaaatcaaagattcaatggttattggagatatggaagctgcaacaaatgttagttctgatgtagttttatttaatatagattctaaatcatcatcacaatcaagttcaaataaagatgatattttaaatgtatttgtaaaagtttttaatgaaatgcagggctattgcggaggaatgccctttttagcagattttgaaaaaaaattagatgcaaaaaataaatttgaagagtttaaaacagaatttgaaaatatcaatggaatggattgggaagaatcaagagatgaattctactttataagtgatgatattatacaaagtgttgtaaatattggattcatgagtgaaaacgaagctaacaattgggcttcaaaagcagaagaaaactttaagtattcaattgaagattttgcaaatgaagtaaatgaatactgtatcaataaaggaaataatcatcatgtaatatttttagtagatgaagttggacaatatatagcagatgatactaaattaatgctaaacttacaaactatagttgaagaattaggaattaaatgtcatggaaaggcttgggttgttgttacaagccaacaaaacattgatgacatcaccagagacataaaaggaatggatttttctaaaattcagggaagatttaaaacacgtttatccctatcctcttcaaatgtagatgaagtaattaggagacggattctagcaaaaactgatgttgcccaacaaactttagaagcagaatatccaagctttgagcctattttaaaaaatattttaacttttgaaaaatctgcagaaatgaaaacatatgaaaatgcaagagactttgcaaatatctatccatttgttccttatcaattcaatcgtgttcaggatgttttaacatcaataagggaacattcctcatcaggaaagcatatggctgatggtgagcgttcaatgcttgcactcttccaagaatctgcaattgaaattaaaaatggttctgagggccaattagttccattcaatatattttataatgctattgaacaatttattgatcatactaacagtcaggtaattaataaagcacgggacaataaggaattgtatccttttgatgttgaagttttaaaagtacttttcatgattaaatatgtaaaagaaattaaatctacatctaaaaatttaaccacattgttaatttctaacattaatgaagacagactggagttacaaaataaagtagataaatcattatccagattacttgaacaaactttaatccaaaaaaatggggaggtttattcatttttaacaaatgaagaacaagacattaatcgtgaaattaaaaatcagatagttgataatggtgaagttttagataatgctgcaaataggattttccaagaaatttaccctaaaaacaaatatcgttatagcaatagatataatttccaatttaatcaatcaattgataataaaaagattaataatagagaatttgatattggaatgagaataattactccgttttatacatcagatttaagtgattgctctcaagctacttttgaagaaagtaatatgcataatattttaaaaggattatcagaatctaacaatgaagttgttgtacatttactttctgatttaacagtatttgatgaaataaaagaagcactgcaaattcaaaaatatttaactaaaaaaagtgctgaaatgaaggttgaactcagaagcagaaaacaagaggaatataatgataaaatagaaagaatcaaattattccttgaatcttctattaaagatgcaataatttatattaaaggagataaagtagatattgctgaaaaaaatgttgaatcaagacttgatgaatcaatgggcaagttagttgataaagtttataataaattaagttatatggactttgcacctgataaaagtgatattaaaaaagaattaacaaatgaatatcagcagacactgatagctagtgaaacaaaagctatgaatgcagtaaatgatatggacagttatatttcagatcagtcaaaactacataatactcttacactaaaaagtctaataaacagatattcaaaagctccttatggttttgtcaatttggatgtgcaatggttacttgcttcattatttgcacaaaaaagaattgtcttaacaattaatagtgatgaaatttctttaagaaatactgatgcctccaaaattttagattatttaacaaaaaatgaatacttagaaaaactattagtatctgaaaaagaagttattgatagtagtaaaattaggaaagttaaagaagttttaaaagaggtttacagtttgaatttaactcatgataatgatgaaagaatcatggatgaatttaaacgtgttaatacatctaaaattgaagaaattgataaatgtcttttagaatttagaatatcaaataaatatcctggcaaatcaatattggaagaatcaaaagaattatttaatgatgctaacaataagaaaaacacattgcaattctataactatgtgtctgataatgatgaagaatttttggatttggctgatgatttagatcctgttttagcattctttaatggaagtcaaaaagctattttcgatgaatcctgtgaagtatataaagtttatgaagaaaatattaacttaatcaatgattctgatttatcagatgttgcatctgaaatttacagaattatttcaatgccaaacccttattcaaatattagaaaactacctgaattaaacaataaattcactacacattttgatgaaatattagaagataaaaaaacaattattttaaatggaataaaggaagattatgaaagtatcaaattaagactaaatactgatgagttgaaagctaaatttgaaaataaatttatatctgaatttgattcacttaaaaataaattggattcagaaaaaaatattgctattattgatggaatcacaatggaatcagaaaatcttaaaaacaattgcatccatgaaattgatttatttattaattctataactcctatttatcctccagaaggtgcaataaataaaccagtatctccacaaccaattcctgtggaagtggatgtggacattaaaacaataacattatcacctaaggttaaaatcgaatctgaagatcaaattgatgaattcttacaaaaagtaaaaacagaacttaaaaataaattagaaaatgcagatattattaatttaaaactatgaggttatttaaatgtcagaatcaataactaaatgtttaaatgaatggaatgcaacaattgaagcattaggtcaaggaaaacaatcaattttaattagaaaatatggtacaaatgttgatgactttcttttatttccaacagtaagttatgcccttaaagataattatttagatagtttccaagaagattataaagattttgttagagaaaatgcacttccaaataaaaaggattctaaatttgaagtaaaatattatgcaaaagttgaaaaagttgtagaaaaatcctcaactagaattggttctttaaataattatcatatctggacaagagaccatgtaaaatcatacttaggtaattcaaaggcacaagtttggattttaagagtatatgaacttgaaagtccccaatatttaaacaggacccgtggaatgagatatgctaatgtagatatggaagttaaattggatgatttaaaacctgtattgtctgatagtgaatttgaaagtattttaaaagggatttaaatgaatcttgaggaaattgaaaaccggataaattcaattattgatgaggcatatcatcgccaaattgtcttttggtatgatgaaaatcaggaatttatagaagatattaataatattcaattaaataatgctaagttacatatcttgaaagacaataatttgattaaaactaaatatcaaatagaatttgaagataaaaattctaattatcttgtttatgctccattctcccaacctgatgataatgaaaattatttagcggatttaatccattatgcagttccattttctgctgataagattgaaatgattggacaagaattagggatttctcctgagttttatcatttgcttaagaagtattctttattttggaatgctaaatcaagagttaatgcatttaaagatttgaatgtttcttttactgaattaaatattaaacaagctattttagcagttttatctaatcagaaaactttaaattttgattatattgttcgtgaagtgattatcaataattttaatgaagaaaatgaaattataaaaaactttgaaaaatataatatcttagaagatttctgggagttaatttcaaggaaatttaaatactcagaagacaatccatctgtgaaaagacttgttagattcttaattttaaattatactgcaaattcatatcgaggatcaactccaaaatcatgggatgaatatttagtttctgataaaaacaatgcttccatatttattagtgaatttatgaataatgcaaattattctgaatattatgataggatagctagagaattagaatcaaaacttaatattacaagcttaagtaaaacaaacattgattcttatataaattgcgattcatttgaaagattcgatgaaaatataattaatcattacactgaattattatttgaaactaaagtggacttaggtgctgaatttaaagagattttagaaaacagaaagaaaactcatttttatttaaaatatgaggataattatgaagttttaaaatatgcaaatttatttatttctttaattaatgagtttatgcgaagtgaacttccagaaaaacctgaagaaattattaaagaatattctgaaaaatgggtttacttagattcatattataggaaattctattatttctatgataaattagatgatactgagtatcttgaagatttaaggcaattagttgaaaatttatatgtaaaccgttttttaagtgtaattaatcctaaatttactaaaaaattagctgaaaaaccaatttctgagttagacattccaaaacaatggaagttcttcaaacaacatattccaacttcaattaggaaacataaaactgcagttattatttcagatgcatttagatatggctgtgcagttgaattattcgcagagcttgaaaaagatccaacaagaactcctgagattaaaccaatgttatctactattccatcatatactgcattaggtatggcatcacttttacctaataaagaaattgtttatgaaggtgatacaatattagttgatggaatgaattgcaggtcaactgatgagaggaataatattttaagttcaaatgttaatgaagtaattgccatatcttacgaagatgtggataaattaaaatctaaggaatttaaagaattaacaaaaggattaaacttaatttatatttaccacaataaaattgatgctagaggagaccatgctccttctgaaaatgaagtgtttaatgcggctcaagaaacaattgaagatttagaagtattaattaaaagattaagaaatcaaggtaattttgctaaaatctttattacagcagatcatggatttatttataaacgtgacaaattaaaagagcatgataaagttaatttagataaattcccagaaaaaaaacataaacgttttattttatctgaaaaacctttaaaaatagatggtgcagtttccttatctatggaatatctaaacatggataagtatgttaatgttccgataggtgcagatgtatttaaagcacagggtgctggacttaattttgttcatggtggagctagtttagaagaatgtattgttccattgctggaagttaaagcaggaaaaggtgctaaaaaccaaaggactgtagaacttcaattaatttcaactaaaaatactattacaaattatgatgtaatgttaacatttttccaaaaagaaaatgtttcacaagatgttttaccattggaagcttcagtttacttcattgatgaggaaaataataaaatatctggtgaacaaataatctttgctgataaaaactctgattcagcagaagatagggaatttaaagaaaaattcagattgttacaaaaacaatatgataaatctaaaaattattatttaattattagagatttaaaagaggatgttgaagttgatagaattccatttacaatagatatggcttttcaagatggatttgattttttttaggagtgatattcaatgactgaagaatatgatttacaagatgatttgaatacaaagttaaaacattactttgagggtaaaattgtaagaaaagatttgacaaaaagagttaaagaaggtgctaatgtaccggtttatgttttagaatatttattgggtaaatattgttctcaggatgatgcattagttgaacaaggggtgcaaactgttaaaaatattcttgcaaataattatgtaagacctgatgaggcacaaaagattttatctaaattaaaggaattaggttcttattcaatcattgatgttgtaactgtgaaattagattataaaacagatacatattatgcgtcattttctaatttaggtcttaatgatattccaattaatccagagttcccacaaagatatgaaagacttttgggaggaaatctttggtgcatggtaaatttagaatacgattttgatgaagcggattttagatcacaaactattaaaattaggaatttacaaccaatacaattaccgaatattgatttagcggacatattatcaaatagaaaaaatttcactaaagaagaatggattgatattcttttaaggtcttgtggtatggaaccaacacaatttgataagcgggttaaatggttattaatagctagattaattcctttagttgaaaataactttaacttatgtgaattgggtcctagaggaactggtaaatcacatatttataaagaaatctcaccaaattccatattagtttctggaggtcagacaactgtagcaaacttgttttataatatgcgtgataaacaaataggtcttgttggaatgtgggactgtgttgcttttgacgaagtggcaggaattaaattcaaagaccaagatggaatagctattatgaaagattttatggcatcaggttcgttttcacgtggtaaagaagaaaagaatgcaaatgcatctatggtgtttgttggaaatattaatcagagtgttgaatcattattaaagacttctagtttatttgatccatttccttcagagatgggtactgatacagctttctttgataggatgcattgttatattccaggttgggaaatacctaaatataggcctgagttttttacagatgattttggatttattacagattatttgtctgaatttttccgtgaaatgagaaaacgttcatttactgatgcatatcaagaatatttcagattaggtcgtgatttaaaccaaagagatacaattgctgtaaatcgtatggtatctggacttgttaaattagtatatcctgatggtaactttgataaagaagatattcgtgaaatattaacatttgcacttgaatctagaagaagagtaaaagaacaacttaaaaaaattggtggaatggaattttatgatgtaaacttctcatatattgatttagaagaaaatagagattgtccagtaggtgttgaagaacaagccagcagcactttgattccagaaggtgacttaaaaccaggacatttgtattctgttggaccatctgaaaatggaaaacttggtgtttataaatttgaaactgaaatgatgaaaggcaatggtaaatttacaccaaatggaataggttctaaaaaagatgtaaatgaagcagttaaaatagcttatcaatatttcaagtcaaatgcaggttcaattagtggacagatttcatacaaggataaagattatgtaatgcaggttaaagatttacatggagttggcatgacaagatatttaactttagctacttttatagcattatgtagtgttgcaacaaatcgtaaagttttaccttcactagctatattgggtaacttctctttaggtgggactgttgataaaatacaaaatttagcagatacattacaagtttgtttagataatggtgctaaaaaattattaattccaatgagttcttatgtagatattggattagtgccttcagatttgcttgttaaatttacattgattccatataatacgcctgaagaagctgtaatgaaggcatttggaattgaataagtgtattatgatttaaaatcagatatttttgcaattattatcaaatcatttataaaaatatttataatatcataaacacaatttattattatcatctgtgtttattgttatttacaataaaattgtgtaatttattattcatggaaaaacaaaaacaaagttataattctgttgaatatttaaaaaaattagatgattaacgattctgccaggtaaaaaaatgtcaaacatcaatctttattcaaaaatatgtgaatatcatataactaataatggaaagtttactcagaaatttaatgatgaattatctaagcataacttaaaaaagcacgaaggatggttgattattaaagaattattatatgaagtttcaataaatgaattaattaatgaaaatgatattttcaatagaaaaaaagagttaattaatttattagaaaatatttataaatgtgaaaacggattatatgattggcaaaatgagtgtttatttaagtttcaagaagattttacaagtatttttaataataaaagtttttcagaagaaaataaaatcatttctaattatattaataaaatttttttaaaaatttttatttcaaataataaccaagaaatttattatttacataactatttgcctaaaaactgttataataagttgccccctatctggctggaagatgatttaataattgattataaagaactttctgataaagtattaatttataaaaatgatacaaatccagaagttaataatatttttacaaatgaattaatggaagctattgttatattatcagatagtgtgtttaaaaatcttgataaaattgtcttgatttctgtgccttcttctaaagttaatgttactccacaaactaaaaaatcagttgaaatgattgaaaatgattttaagaaaggcctatttgagttttcttctaaaaaacttcttgatttaaagtataataatatccttaagagaactaaaaatatagtttcacaaaaggattgtggcgcttattatagaaatgttaaaaataggcatttaaaaacaatatcttgtagctatgatcttcctaattctacaggttttattatattagatgatatagttactagtggaactactatggactcatgtaaagaaattttaattaatcacggagcaaaggagaaaaatataatatgtcttgcaattgcaaaaacaattgattgtagacatttaaaatatcataatggaaaagttgttttatgtgaagatatttaagagggataacatgattaaatataaagaattactctttttaaataaaataaatcgagttgggaaagtaacaatatatacaaagtactgggatatgttaattaattctaaggacatggatgatttatttaataagcttcataagagtaataaaattagtgaagataaattaattaaagcaaaaaatgaagctgaaaagatatatgattctgtagtaaatgattctgaaataaatgttattacagtttttgataaagaatatcctaaaaaattatttgacatggaaaatcaaaaacctctttatctatatgtaaaaggcagtatggatgctttgtctaaatctaatattgcaattattggaacaagaaaaccatcaaataatactgaaatttttgaaaaaaaattagttaaaagaattttagatgtttctaaaagggtggttgttagtggtttggcattaggttgtgataaaatagctcatgaaactacagttaatgaaaataaaatcacaattgcttttttaccatgtggattaaatgttataagtcccagtagtaataaaaaattagcaaaatcaattattgaacagggtggatgtttagtttccgagtatgaacctgataaaaaggtatttaaaagaagctatgttgaaagagataagattgtagctgcattttcagatatagtttttgttctacagtgtggggaaaaaagcggaacaatgcatactgttaatgctactatcgattttaaaaaagtaaatcatagagatttatatgtttatcttccagaagacatgtctgatggagattatagtggaaatatttctatattaaaaagtaataatggaacaaaagtgtctgatattgatgaattttgcgaagaaattgttattttagaaaaagacaataatttaaataaaaatgctgattatcaaagtaaattaatttaaatgtttgattaattcaagtttgaaagttatattattattcctccacctaattatgaatatttttttaggtttattaatataataaacaaaaaaggaatttgaatttaaaaaaatctttaaaattttataatcctaataaaaataattatatactattttaaacatatcataatacatggctgaagaaagttagtaaaagcagttatactactaactgaagataaacctaaaaaaggctcttaaaattggtaataaagttttagctaaaaatccgatggtcttacaaatcttaacaagactgactgaaccttcttaacagcacactaaactattatacagataaaaaagagctaatatatattaaaaatgatatttaaagtagttggcaggttttttatggaaaaaagaagaaacaccattcatggatatgatgaaaaagacaacacagaaaataatgaaaatttattaaaacttaaaaatttaaaagaaagctgtcaaagtaatgttttaaaagattttatggatgattatttaataagtggtttcaaaaatgaatttattgatgtggacatgattattaaagaaatagataatcattctaaaaatcaagatttaataaaaattatatatattgttcatttaatctttgaacaaatgaatgtaaattctaatgagtttccaattgatgaattatgtgattataaatatgaaagtgtcaatggtgaattatttattaaatttttaactcgtgaatctgaaaatcagttttctaaaatgtatgaaattgttttatttaataatcataaagataaaaaaattggagaaaaaataatcaaatcttttgaaaataaaggttccataatggttatgaatatacttagtttattaaatatgcaaataattggaaaaaaacaacaaaaagaaaataaagaggagaaatttgatactgtaggtgcgttatattcttctgatgcatttatggattcttatgactggacaaaacgtgattggggttaaaatagtttttattattaaaagtttctaaataggacaaatatttctaaaaacaatttaatataaaaaaaatctgttatactattaataaaaacaattatgtgctattttacacgcattattttatatgtcgaaaaaaagaagaaattatttaaaaaggtcataaaatgaacagagatcagagagatagaatagaaggtaactgctgctgggcatgcggcgcatatttaaatgacggcagagacagatactgtcctgtttgcggatgtcccaatgacaattacatgcctccgttaaggaatgtcaaacctcccaaatccaaagaacaggaagataaggaatggaacagatgctgtatgctgatgtttgttgtttttctgattttatgtattttaggtaaagctatgcaataaggagtttttaaaatgaattcaattcaaaaagcgtttatgtcaaactgttgtgaaaggtgtggaagaactttggatttcagcaaggataagtattgtccttactgcggtcatcccaattttaattatcatcctgccacgggggtttcacacagctcttctaaaacaacaaaacgcaaaaaacaggataatacttctacctgctgtattctgattgcagtttttttcataattgcatatatctacagcttttttgtttctggttaggtgatactatgaaaagagaaattgattttgaaatacttgccgaaaagataaatgattcagacttgtatgaatttgtcgcattcagtaatgatgttcctgtaagagcaattaacagggatttggattccattaaagaggccctaaacagtcatgataaaatatttttagaaatcggattttacggatatgatgatgagtattgtgatgaaccttatttcatgtttgatgcaaatgaatccatagatgatttaaaagatgattactatgacaaatataaattcatggttggaggatatggaatttatcttgacaaggatttgaatgtggaatacgggtattatacaacagaagctcctgcatgcggtcatggtgcaggatatactgaattttatgattttaaagatgccagagatgatgatattattaaagaaaaaatatattcccttttggacagcagcggtatctggaagtaatatttttaagctttagagaatttcctaattaaccgtcccatttttttaactaactttttgtatacattatagcaacatttatatatcaactccaacagaataatatttacttgtgtttatcttgattaaaagatatacaaactaggtgaaaattatgaagaattttgaatttttaaaagattttgacagtgacatgtatgctcttcttagtgaatttgaaagggaagccgtaaaaaatccaaaaataacagaatcatatgttactccttttttggaaaaggtggtaaatgatatactccaaagaaacaataatgcaattgatgatccatatgttggattttctaaaagagtcgataaattatatgaattaaaaattattgactataagtttaaatgtatgttgcttgaagcatatcagatgagaaatgcaatcacccacaagtcaattgaagattttctgaaatccgacaataaaatacccttccagctccacagaagcctttttgacattgcatggaaatacttccagctgtgcaatgaaaattactattatcccggaaaacctgaatacacaccgatttacaatcttaactcaaaaacaataaaatccacaccaaaaccatcagataacagaaatttcagccgctgcataatatgcggcagagctaatgattccaaaaactccaatttttgcataagctgcaacaatgaacttgaatatcaaaatgaaatcatcaatctgaaaaacaatttaaacatcagtcattttactaaagaggaagttaaccagatccattccagcatgtataccagtcagctgcttattgaacttacaacaaaaaagcttcttaaaaaaacaaacagatactacagtctaaatgaatcagaatatgaaaagcttattgaatttacatatgagtgctatgatatggaaaagactttaactgaatttttaaatggcaaatacacatcaaaacagattaaacagtcaaaatattataaatgcggtcaaaaaggcatccgcccctttgtggagttttataaaattgttgaaaatcagatattcaaggattttctaaaccagatttcaatgaaaatccctattggtgaaattcttgaaaatacacagataaataaatcccagataaacaactggtatgacaaaaacaaagacagtttcataaaaggagagcacaactcagaattcataacatataataagcttctgatggagcagtacttaaccttaaaaagaaaacagtatttaaatgatgatattaaagctgaactgcagataaatgatgaaattatcagtttctggatggattcatttgatatggaatcagcactctttaaaaatagtcttaatgaaatcagaatgaacatctttttaaacaacctgaaggaaggcaaatcaaaagaagaagcacttgaaatagctgaaatcaccgattttgaagaactgcttaaagataaggattttgaaaacgaatataaaacagaatactatgaaaatcgtgtagacaagcttataaaatctctaaaaacaatgagttttgataaagctcttaaaagatcaggcatatctgaagacgactataacagatggtatgccacaggcaaaaagcagtgcctgcttaaaaaggatgaggatgaattctgtctgaacttttacatcaatgtaacccgtgtactgatgaacaggtatctgaagctgagaagtgaaggcaaaacaaaaactgaagcctgcaaaaaaataaacactgacttaaatgaagttaaaagatggtgcaactggaatgaaagcggcttatttatagatttcaaagaaaacaacaagaaaattaccgctaaattaataattgatgcaattaaagatgggaaatccaaagacaaaatagctgaaagctcagatataacagtcaatgaattaaataaaatcattgatttaggatcacaaaacgatagaatctacagagaagtatatgaagaatatgaatcagtttatctttcaaaacacctggaagtctttttaaaggaaattaaaaataaaaacttgaaaaaagcacttaaaacttcaggaattgaaaaatcagaactggacagtgcatataattcaggcaaaaacggagatgaacgcttcactaaattttacaatgactacctgaattttaaaataagctgttatatcacacagattatcaggggaaaaactgtcagtaaagctttaaaaaattctaacttaacagatgaagaacttaaagacaatttaaaagaaattgaaagcagaatccttgataaacagatgaacagtgttattggtgaaattgcaaaaaacagaactacaagacaggcagctaaaaaagccagaatcagaattgatgaaatttacagatggtatcttgaaggcaaaaaaggcaatgagaaatttaaagactttgcagacatctatcatgaactttatgttgaagtgggatgtgaaattttccagaatttcttaaacaagggaaaaaccccaaaacagattcttaaaatcatgaatgaagacataaccagagaagattatgagttctggattaaaaacaatctgataagtgataaaaatgttgaagctaaactctacacagaagatgaaattaaagaaaaaatcgaaaatgaaggattcagacaaaaagatgagaaatctctttcaggtttaagtataataggttgttagttatggttataaaagaattgaacaatgcaaaaaaagcatatcagagaaaagactttaaagcagctgatgaaatttactctaaaatctatgataatcatcagaaagatttcagcagatgggataaaaaattttatgcattaacattatacagatgttatgttcaaaatccagttaatcagaataaacttttagatgcaggcaaactgattaccaaattagttaaacagtcaaatcactccaaaaaagatgcaatgtgtccgtatacattagcagtgcttaaaataatgaaaacccttgaagatcctgaagctgttttggaatggtcatctaaacttaatcctgaattattaaatggagatatttcaggaaattattcatctaaaaaagaaacatggtataaattaacaacaaaagcactgctggatacctgccagtatgatgaatgcataagcctgtcaactgaagcactgcttaatttaagcgaatttacacatgataatgaggtctggtttaaatggagaatagctaaatcatttaatcagttaggtgaatatgaccagtctgtagactatctgaatgacattaaacagtttaaaaatgactggtttatagataatctgatggctgaaaattatttctttaaaaatgattgggacaatgccttaaagtatgcctcatctgcagcacttgccaaaggcgacactgataaaaaagtcaatttatattcactgattgaagatattctaaatataaaaaataaacagaaggaagcagatattcatgcatacctggtttatacaatcagaaagggacataactggaatattgatgaaaatctggaatataaaattgaaaaggcaggttttgatttggacaatgaggattattttactattgaaaagcatctgcatcatctgtgggaagaatatctctataaaaatcaggaattaaaaaaaggagttattgtttcagtactgcccaataaaaaagcgggctttatcagatgcgatgaatatcctgacaatctgtatttcagcatgaatgagtttaaacataacatcacattagcaaaaacaggccagaatgtcactttttatgaagctgacggctttgataaaaagaaaaataagcaagttaaaaatgctgtaaatatttatctgaatgggggctgaattatggaattttgtccaaaatgcggttcggtgttatttccagacgaaaataatgcattaaactgttcctgcggttattttacttatttggataatgaccgtgaatataatattaaagaaaaaatatctgaaaagtcagccaatatagcagttgatggaaatgaatatgaaagtattgatttattatatccgaaagatgttcatttaaaatcttatgactggagacacaaagactggggttaaaaaggtttggttttatattgttataaaatgggtttattaaaatagaggttttgttttcctctattttagtttttctattgttttgcagtctagttttgttattttggcaatttctttaactggatagttttctttttgcatgttttttgctatttttagtttttcttcttcttttccctctagtttcccttctatttttccttctatttttccttgttctaaccattctttttcatgtgatgttacatagtcgtgaagtattgttatttccatttttatcacacattttacttgatttttcaaaatctggtgttaaaaagtgtattgatacattatattgtaaatttattaaaatagaggttttgttttcctctattttagtttttctattgttttgcagtcaagttttgttattttggcaatttctttaactggatagttttctttgtgcatgttttttgctatttttagtttttcttcttcttttccctctagtttcccttctatttttccttgttctaaccattctttttcatgtgatgttacatagtcgtgaagtattgttatttccatttttatcacatctattactttatttttcaaatcctgattttcaatgaatttatctgcaagtactatcagtatgccaagtacagaatcttttaattcatcatcaatatcagttatttttctagcaagttccagagtttttactacttgcactccggcttcgtgtttggttttcattaacggcaatatccctaatgcaagaaactcattgcaggttagttttatgttatttttaactttataagttatattacttaataatttgtctccgtcatagtctttaaatgatattgcttcaggtctaaaaaactgcccaggggagtattcaagaactacctgatttttatcgatttcaggagtcactacaagatttatttttacctttaactgataatcatatccgattctggctacatatagaaagattcttcttaaaatgtttgcaatattggatttagtagataaaaattcataaagaattattttatcctttttctttatgccgtaatctattctgagaacttttggtttcaggtttattagctcaacatttatttcatcacaaaactctgcacctgtaatttttgcaatatactttgtggtgttttcttttagaaatttcagtgttaaatcctcatgatggtatccgtgatatatcttattttttttcatactaatccattggtctttaatatttatataaccatcagttttttattaaaacaataattaaagcataaataaatagttttaaatgaaataaatacttcataatcatgaaaacttttttataaaaatgtattaattactttatttaaattaataatcagctaaaatatgtgaggtgtttggattgggcactgaatatattgaaaaaggaatttcatttgtcaatcagaagaaatatgataatgcacttgaatgttttaataaacatctggaagctgattcaaaaaacagcattgttttaggtcttaaagcactggctttaatggatttgaacaggttagatgaagctttgatatatatctccaagtcattggacattgattcatcaaattatgaatcctgggcaactaaaggggaaatctttagaaggttaaataaaaatagggaagctctgcactgctttgatttgtctttgcagattaatccgaaacagtcaaaaacatggacaaaaagaggttttttattaattaacagatacggtcagtttatagaagcaattaactcatttgataaaggactggaattaaatcccaaagataaaaatgcaatatattttaaggcagaagcttattttgcacttaaaaattataaaaaagctttaggagcatgtgatgattatctgaaaatcacttcagccaatgtttttgattcaaacgtttactcacttaaaacaaagattttaatgattttaaacaactttgaagaggcattagctgttattgatgaaggtttgaaaatcagtcccgatgatgattccatttatgcaacaaaagctatgattttactgagggcacataaatatgacgaaggcatagaatgtgtcaataaagctttggagttaaattcgagtaatgtcattgcattaaaattgagaaataatgttttaaaaggtaatttaagatgaaatgttaaaataatctgtaactaacgagaaaaattcttaatagctaaaaaaaacatatttactattgcaggtgtatttaaatgtctgaagatcataataaaaaagaacacaaacactgtcctttttgcggacaccatgtagatgaagatgatatgatttgccctcactgcggattattcatcccataattattttttctaaaatcaattaaacaactttattattatctttatataaattaatcattaattaacaatatttacctgtttttgtaaaatttaggtgaggttagctaatggttcaatgtcgtgaatgtaatagtgaagtttcagataaggcaaagttctgccccaaatgcagaactcccttaaaaagtaatgaagatgttccaaaaagtcctaaaatagtcagtgataagaaaggtggtttcaatcctattttgattattggtataatagctattgtagctattgctgcattaggtgcaggtctgcttttaggtggtggaagtgatgattcacctgctgctgtaaataatactgctgagagtgatgatgttgctgaagatgtaaatcctgctcctgcaagtgccaatgttacttatgtctgttctcaaaagtctgacaagtttcatttgcctgagtgtgaatgggctcaaaagataaatcctaaaaacaagattacttataattccagagatgctgctgtagcagatggaaggattccatgtcaggtttgtaatccttaaagtttattacctaagataaacataatttaaatacaatgaggtttttaaaatgaattgtcctaactgtggagctgaagtattatcagataatgaaaaattttgcagaaaatgcggttttaaattggttgattcagaagttaaaaaagctactgtaatttcagaagatattccaaaaacacggtgccgcagctgcaataatatgatagacaacaatttaagaatttgtccctactgcggatcaaatccaaattcatcttcaacatatgcatcatcagcatccaaaacaaacagcagcagctcaagtgacagtgactgctggggatgctgtggtttaattgtagttattgtaattatattgtatattataggattgatattttgatttatgaccacataatgaatatctgcaaatatttatgccatcagaaacctgaaaggtcatttttctacaaagaaaagcagtttccagtttgcagcagatgtacaggaattgttataggtgcggctgcagggtttgttttagctagtttaacccaacctaatttaatttttgttttaggatttattccattaattattgacggaactacacagtattacggtttaagaacaagcaataacactttaagatttgttacaggtttgttatgtggcttttcaatacctttcgttgtttttaaaacagaatcagttatactcaattatttctaaattttccaagctgtcatctatcagctcttcaatgaattctgaagggttatttttatcacttattaagtaaacattatttttagagcgggttaaacctacatagaataatctgcgttcttctgaatatttgtaatcataatttttggtatttacataattcaaaacactgtgggtttttaattttgatggaaaacctaaatagtcatcaaccatattgattataatcacattatctgcttccagacctttagatgaatgcagggttctgtagtaaacattattcattgatttgtctgttttgtctaaaattcgtaagaatttgtcttttttcagattgccttttttaaccagatttctgtgttttataaactggttgatgttgttgtttgttctgcctaagattaatacatcttcggattttttagagagatcttttataagattataaatcatttctcttttttctataggatttttttgaggatagattattttaacaggttttttcagatttttaggagacttaagagatttcctaatttgtttagggtttttcataatgaagctacctgctatgtcaatcagctcctgagggttcctgtatgttttttcaatgaatattctttgaggattttcaaaatactcttcaaaatgtgagaaaaattcaatgtttgttcctctaaatccgtatattgactgccagtcatcacctacaactgtcagatgtgcatctgttttatcctgcaggcttttaatcagattataattggtatatgtggtatcctgatattcatcaaccagtatgtatctgtaatgttttttcagcccgtattttttaatcagcttgcttgattcatttatcatgtcattaaaatcaatctgctggtgcatatccaagtatttctgatagtaactgtagaaatcttcagcgatttttaggaagatgtcatggtccttgtcatcgttactgcttctgaaatagctgaaataatcttttgtaaaattgttgcccttaaataaatttataaaatctgcaagcaggggtttaaatgccacttttgtaaatgcttctttcaattcattcaataactcttttctgtcatttcttctaatgatgtagctttcaatgtttaaaaaatatgaatcgcaaaattcaagaatatcttttaatgtatcagtatttgcattggccagataatcatttattatagccaatatttcattgttttcaataactgacactttatggtgctgcttaatgactgatcttcccagactgtgaaatgtccttatctcaacattttccggaagctttccttttaaatccctgacagaagtatttgaaaatgacagacacaaaatatcttcaggtctgacatgctttttagctatcagatattttatttttgcaattaaagtaaatgtttttcctgttcctgctcctgcaatgatttgaacatttttggaatctaaaacacaggctattttttgctgtgtgtctaaaggtttgctgtttactgttttaaaaaacttatcattagccagcagctcctgtctagttttatcatccaaatcatcaatacttttgtagtcttttttcaagtacttgccgtttttgctggctattttttcaggttctgttttaatatctttagtgaatgtttcaataactggctttttatttgtttttttcttttctggccgtggtgtttttttaacttccttagtttcagcagtttttatacagccgcacatcgggcatttgctgccatttagtatcattgatccgcattcactacaaaaatccataatatatattttttattaacatttaaaaatagctttcctaagagtgtctgaaaagtatttctgttttatacatattttaaatactagtttaattaaaaattataaatgaggtgttttattgaatcaagatgaatatataggaaatattgttaaaaatggagttatagcattaattataggatttattataactggcattttatattctgtaatgtattcaataaacggaattgaaatgtatgccggttttataattttaggagcactctacgggttcctgtttataaaattagacatttttaaaaatgaactggatttaatcataacaaatgctgtttttgcattctttggttcatatgtaagcatacatttaatatttacaagtgcattgaaaatagctatgaattcttcactgctgacttatcagtttataggaatctgtattattgcagctgttgttgttaactacatccgtgacacttatctggaaattaatcctttagggtcaattaacctgaatttgggaaaattgcctacagttatctgtcctgaatgcggtgttgaagtcaatgccgaaaatatattctgttctgaatgcggccataagttcagttttatacattgtcctgaatgcggtgcaaaattagatgaggaaggtgcattctgtcaggaatgcggttataaattagaagatgactctaaaaaagaagaagttaaagaagataactctaaaaatgacatttccctaaaaaaagaagttaaagaagataactctaaaaaagacatttccctaaaaaaagaagttaaagaagataactctaaaaaagaagataaccttaaaagctgttccaattgcggaactaaagtaagcgaagattccaaattctgtcccgaatgcggaaataaaatcagatgaataaactatgaaatattgtccaaaatgcggcagcgaaataaaaaacaatatgaagttttgccaaaagtgcggagccaaacttcctgctgaccacataaatttaaacaatgaatactgcaagcattgcggttcagcaattcccaagggagccaccagatgcccaaaatgcgacagatatttagatgaagctgcaaatgacagccatagtgttgctactgtaataggatatatcttttcttttttagttcctttagcagctgttgttgcaggcatttacttattaactcagaaaaatgaaaacgtccataaacacggagcatgcattatcatcatagctgttggagtcatgtgcatcacatatttatactatattaaatttttataaaattattactattttttaactttttttaaatcattatatacacaagtttatatactatattttataaattaataattatcaggaaaaaaaactatttttaaatcaaaagaaacatgaattttttataaatttgtaaataaaaaacttgatattataaaaggaatgtttaataaaatgaaaaaattcaataataaaagcaggtactttactgatgaattaaataaacttggagaatggatgaaatggtttttattgaccgttataactttaattatcatctctcaagtttctcacatgtttttaacatatggtggataaaataatgtctaaaaaaataatttatgatgagtctcttgattctgaaatacaatttaagaaatttgtagctacacaggcacctgaaaatcatgaaatatctgatgaagatgtggaacatatggaaatggctaaccttattgatttggaaatacaagatcatgaaaattttatgaatcaagtgagggatagctattgtgaatatgattcctatgatgattatctaatagaagaacaatatatggataaaattgaagaaccttttgatttagaacaggaatatgataaatgggatgattattcagattgtattgattctgatttagaatataaagagtatcaacaagaacagttcagaaaagaagattctattgaaggtcctatgagctgttttgaacatggctattatatggatgaatccagcaattccaatcatgaagagcctccatttatagaggaatatgactttgatgaactaaaaatggaattggagtatgaaaaaaacagctatttggttgaaaatgaagtaactcctgaagatataatgtctgaaagaattgaagaacataaaaaagaagaaaaagaatatatggatatgttaactttccagcaggaagattttaatccatttgaatattatcctgatcctgatgctggatgtaatgatatttcaattgatgcccaatattttgagtataaacaggcagaacttaaaaaggaaaactctattgaaggtccaatgagctgttttgaacatggctattatatggatggacctagtgattctgattatgaagatctttcgtttatggaagaatatgactttgaagataatttaacttttgaaatgaaagaagaaatttatgggcctgattttgaatcagagttacaagaagacaaagaaaaagaattcaaaaaaaactagctgaatataatgcaaaaaatccaattaaaaaatgataaaacatgtcttatgataatataatagctgaaatcaaatccaatttaaccggaaataaagataatgacaaagattatataattaatcagtttaaggttttcaactcaaaggaaatccatttggaacttggcagattgctttgggagttgatgagtgatgaagaacaaaaagagtataaaaaagctgttattcaggatatacctgttgacgaattcataaaatcagtttacagttatctgaattatggggattttgaaacagccctaaaagagcttgaagattacatggaaattataccatttaaatttagggaaaatcctcaatttgattatttttactttaataatcctttggaagaggagttattcagaaaatattttaaaacaccaaaagagctgaaagtaattccgtttggtgaggaatatccgagagtcttttacctgtatggtgttgtgcttatgaatttatctgaatttgacaaggctgaaagtgcacttaaaaaagctctatcctataatcctgtttctggtgagattttatctacattatctgcattatatgacggaaattatgatttgaataatttgaagaaaacagcagttgaaattttaaagttcagctatgatccaagagaaatagctaaagcgtatagggatttgggatactgctactatgaaaataagaagtgtaacatatcaaaggcattatatgaacaaagtttaaactatgaaaatcatccgagggcacaaatagaactgcaattaataaacagctatctgcatattgatgaaacagacattaaaaaagttttaaatgatgaaaatattccggcaaatattaatgatgatattttggaaatatcaatgtttttagctttggattttgaaaagaaaaatcttttaaatcagtccttgtatttttatggtgttttatataacttaactcatgatgaagaagttttaactaaaattaatgatttaaaacatagattataatttttttatttggtttaaaacttccaatccaagtttagttatttcatatattcttccttttttgtcttcttcattaatacattcaactaatcttttgttttttaagtctgaaagtgcattagatacttgtgtagttcctaaatctgtttttagtgcaatttcagaaggcaacatatacttattttcaagacattttaatattttttgacgtgtttttgatatttttataaatccaatagctgaataaagttcttttttgttcatatgtattatttaattaataatgaggttataactttatatatattattggaaatatataataagcttattattagcttaaaataaatatttaactattatgtttttaataaaatattaattaatatccatttttaataacaacattaatatattacatattaataaaatataattaattaaattataaggtatttcaaatgttagttcgtaatttagattatttatcaattccaaaagaatttaagaaagttgaaactaatatctatgataataaatcaatagcattagtttttgttgaaaataagggttattcattagttttaaaagatgatgaacatattgattctgtatttttattaaaaactagtttaactccaaataatattaatgaaaataatgataaagaagattttataaatgttatcaaaatgctgttagaaaaagtttatagtgagtacacaataaaagaatatgaaaaacaacatcaagaacatgtatttttaagattaatggacatgttaactgatggagataatattgagttaatttctgaagaaaactctaaaatttattctgatattgaaaaaggatttatgaaactagaattggatattatggataccaaaatcaattctcttaatgaatctattgcagatgtttctaataatttgcagcatacggttaaggatattgaagaaaaagattggggtaataaacttaaaaaagctcttgattcacaataatgaagtgatattatggttaaatgcagtaattgtggtgctgaagttacagattctgctttttgtttccaatgtggtgaaaaagtatcttcacctcagaccgataaaaatatgtgcccaaaatgtggcattgctaatgataaaaacactaatttttgtagaaactgtggacacaaaatagaaaatggagcatcaatatctgaaaaacaaagagaatggaatgctagaagagatgaaataattgaaagatatgataaacttgcagaagaatttggaattaaaaatgaagattactttttaacaagtgttaaaagatataatttcttagaaccaggtactactaaacataaaaaaattaatgctgttttaggatataatcctggattatatttaggaaatgaaaccatcattgatggatttttcttaataaaagaagataaatttgtttttatggaaattgataatagggattttaaaaaagttaatgcaggaataaataatttttattttgataaaattgtctcaatgagagtaactaaaagtcttggtgatgaaagtaagtacgaagatattactaaaagagcttggacttctccacatgatattaaaagatctattcaaaatgatattcaaagtttaaaagcaatacgatttaaagacttaattataaacaatgacagtgcagatatgtttgatagattattaattaaattagtcgataatacttcttatgaaattagacttcctagttatgattttggtcaaaaattagttgatttatttgaaagtttaaaaggccaaccacaaaaagtcattattgaaaatcaaaattctcaaccaaataaagctcaacttttaagtgaatatcaagaattattaaatagtggtgcaattactcaggaagagtttaaaaagcttaaaaatgaactaatattttcaaataagtaaaaaagggatgtcaaatggttaaatgtcaagtttgtggtgaagaaattggaaatgcaattttttgtgaaaattgcggatctaaaattccttctcaaaaaaagaataaaaaagaaaaggttataaataataataatgaaaagcaggaaaagaaattttgtgctaactgtggaagtgaaatggccagtgaagataaattttgttctaattgcggaactcatgaattaaaggcaaataatcaggtaggcaataatcttgttgctacttttaatcctggaactgcatttttaatatctatatacactaccggtgcgggacatatttatttaggattatttaaaagaggcatatcctttttaatatctcaaatagtgcttgtagtattagtagctatatttacactactattgggatatctatggtatatgttagctgtgattgtattattattaggtattttagcatgtttaactttgcatatatattcaatttatgattcatataaatcaattaaaaaaataactaatggtgaaagtgttgaagatataatgtttttcaataatttcatgtaaatttttactttaaaccttgaggtaaacaatggtaaaatgtccaaagtgtggaaatgaagttagtggagatgatttttgttctgaatgcggacttaaacttaatcatacttcaaaagaaaataaacattactgtccagagtgcggttttgaaactagtataaaagataaattttgccaaaaatgcggtgcaaaaataaatggtaaatctgataatgatgatttgttaagttttaataaaactaatctttatcccattattttaggatttatcttccttttaattgcaatacttttcgcaagtaggcttgtattagttctttgtttatttgcagcggggtttctttttgaatttaaatcagacaatgcatttcttaatagtattttagttgctgtaattccaggtattttatttattatcacaatgcaaaatatatattatttattgatgtgttttatacctccgatagctggctgttttatagctgccacatatagaagaaggtaaatacacttaaatattttcaaatactaaaatcattttaaggagaaaatatgtttaagttaattgttgaaagtttacaataacaagaacaaacatattatttaatagtagacataaagctattgttagatatacatataaagaaaaagaaataaatgtgcaagatttgggaaggataatatgatagacgatagtcgagaaagagaactgaaaagattaatattccttgaaaaattaagggaagtgcaaataaaatttgaatttgcattatcttctggcaatgtagagtacaaacaatatactacttattttaatcaaattatcgatattgtaaataaccatagtattgattactataaacttgactattcaaaaattaaagcacataacaaatcaaacaagagtataacttgggaatacgtgcaatctacagataatgcttatgacaaatatacttttgccaagaaagtgcacgaacgttgccttgttgcattagataatatttctgacattaacctgttacttgatttagattactatcttggcctcataactaatgttaaaaacttttattttacttttgataaagaagaagccattcagagatcttttaatcatagatataaacgtttcaatactatttttcgtgacgaagtcaaagctcttgcaatggattatatgaaattctatgacataaatagattttcaaaagaatcattttatggtgatgaaaatattagaatcaatcaggaacaaggtctggaatttgtagaaattggcaaattgatttgcgataacaaattaaaagaagctcgtgataaagttattgaagtgggcgtacacgttaaaggtgttccttggccagagtaaatattaaaatttgttgatgtttctgttatgaatccactcacggtgttttccaatagctactctgattataatttctattaaatcgatttcatcttcctttttgaaataataataagccggcccttccaacatttgtcttaaatcataaaacggtcttggcttgactgcatctggatgcatcagtccgtaattcttgagtagcttgacgttttctgtttcgtatttctccagtttggatttctggactttagtagctactgtcttttcttttttatcaaacagtttagctatttgagagctatcaattaatatactggattctatcaatagcaaggttatttctttacctttaactgttaatgtatttgaatctggctataacaacacgattgttggctaatggttgacctgaagcaaatgtggtaaacaaatcagttggagaatttccttcaaggcttggaacaaatctagctctaagaaaatggcctccatctgttgagtcattatttgtgcttaaacctgagtagttcatgaaaaattgtgagtatgtatcattatttgcatcaaacattaacacttcattaccagttgataaagtgcttgtgaatgttgttcctgtatcatagacgtccagcaatagctttgtggtttgtgaaatctggccaataaggaccttgctattttccatttttcattattggctccttcagcatacccctttttaattcctttttcatatccttcatcgtatctttcctgtccgtattcttccattaatctcatattatccctcagtatatttcttaatctttttcttcttgatgtttcttttatgaatttatctacaattagaaattcaattccaaaagcaaaattcttagcactctttgcagaatttcgtattttatctagtgtttgcacggttttttctatttgttcatcaagggtttttcttgaactcataaacggagccagtgacagatatattaattcccgccgggttatttttgtattgttttttattttattttcaatattatttataatttcatcaccgtcaaaatcttttaaagatattatcggaattgtaaatacacagtctttattcaatttatattgtttaatttttgttttttcagctgtgctgaatactattaaaagtattggcttgttgttttgctttgcataatcaacaattgctgtatataatctgtatcttttttcatcgaatttttttactactgttgattgaaattcagttattactattatattgttcagttccattatcatatctgatttgtaaactgcaggatcaagttctattaattctgttggattgaatgttaaattttcagatttaaagtcatattttcttatatcccagtttatttcttcaatcaaatttataaaactgaatccatcttcttttgtagcatacttaaataatttgtcttcttcatgattcgacatattatcacttcagttaattttcatagctattgttagaaactgtatggtatttaaatgctttgttgtaaaaaagaacaaattttaatccttaaatcaatatttaaaagcaaaataaatatgttaagataaatattgattatacattgttaaattgttttttacttgttaaattgtctttaaatcttacaataagcttttatatttcttattaccaagattaaagtagaggtgttttagatatgaactcttatctgaatattagaattaatggtaaaaatttggaaaagaaagaagatattgaaaatgcaattttgaaatttgatgaagatctgaaggaaaatcctgatgatgaagctacaattgtaggaaaatccgtattattatacaagataggcaaactgaatgaatcccttgagtgcttaaatcaaatcaaaaacattagaaatgcttccattatagagctgaaagccgttattttaatgggaatgtcaaactataagtgggctcttgatttgttaaatgaagttttaaagttagactgcggaaatgtcagtgccctttactataaaacagaatgcctttttaagttaaaacgatttaaggaagttgtagatactgcagatgtggctttgaaaattgataaaaaccaccagtccattttaataaataaattctgttcattggtagaacttaacaacacaaaagaagctttgaaagttaaagaaaagcttttaagattaggtttgaattgcaatatctgaggttagaaatatggaatttcaaataaagaaagtcgaaaaaggagatattgacaccaaagagttaaaaaagcagattccaggatggtgcagtcttttaaaaaaatctcctgatgatgaaaggctgagaatcattgttgcatcaatgttttattttattgatgaaaaagaaaaatcacttgaattattaaaaaatgctccagataatgagaatatggaattaaaagaaataaccgccattgtttatatggatttgaactactataatgaagctttagagctgtttaatgaaattcttgacgctgattataacagaagcgttctggatttaaaggttgactgtttattttttttaggaaagtttgaagctgtggttaaaacagctgatgaatatctggaagttttcggcaacaatctggatgttctaacaaataaaaaggcagcccttaaaaaattaaaccgtaaaaacgaagcagaagaagtaaataacataatttcaaatttaaatgcagtcaataaatttgcagtctatatgccaaaggatcaaactgatgaagtcattccggatgaaatttatgaaagggaattggaactgtgctttaatgacttgaaatataatcctgatgacagtactgttcttattgcaatagctacatttttatacaatcttgatagaagagatgaatccattgaatatttggataaaatcagtgatgatgcagacagtgttacaataaatgccaaggcctgcatgtttatgaaacttgaaaaattccctaaagctcttgaaacattaaataaatctttaaaaaaagacaaaacaaatattataactttaatatcaaaatccgaatgtctgatggaactgaaaaaatatgaggaagtgctggtgtgtgctgatgaaggactggaaattgataaaacaaatatacctctgtggaaaaataaattttgtgctttaattgaattggacaggttaattgaagcaaaggaagttcaggatttaatttttgatttggaaatagccaatgataaagctgaaggttcccttaaaaaagcaatcaacagattttattccatggagtatagagaatgtttaaatctttgctatgatgttttggatgctgacaaggataatgaggaagctgcaattctgatgatgaatgcagtttatctgttaggtgatcttactgaagctccaaaggcattgtatagagcacttaattgtaataatggtgaaatattgactcgaaactgaaaaattgtctttaaatccaacaataagatttaatatttctttgtttaataattaaataggtgtgatggatatggatgtaataatatctgcattaattgaagcaaataaattattaaacaaaaaggattattataaagcccttgactgttttgaatgtgtgttaaatataaatcctaccaacaatctggccataatcgggaaaacaatttgtatacattatttaaaatcatttgacaacatcagcttgataaacatatatgaagaaaaattaaatgttaaccttaaacttgcagagttgtatgaatgcggaaaatacgatgaaacaataaccgaatgcaataaaatattaaaaaaagacaaaaacaattttaacgcattagctattaaattctcagcccagtttgaactcaccaaatatacagaagcactgaaaacctgtgacaaactcttagaattagaaccgaataatttagtaataatatatgcaaaagccaccacattatacaaactaaacatttacaatgaagctattgagtgttatgataaaatcctggaagtaactgataattttaatgttttattttttaaatcagcatcattgttaatattaaataaatatgaagaagctttaaaatattgtaattatgcattggaattagaacctgaaaattgtgatgcaaatggattgaaacagttgattaaatataaaatagctcaaaaatagctattttatttttttcatttttgtatattatacgaaaaatagtataggagtatataaaggcttatacgaaaaatagtataggagtatataaaggcttatacgaaaaatagtataagagtatataaatagttatataaaaaatagtatgaaaatataatggactataaaaattgggaggtaaaactatgaaattagaagaagaattaatgcaatatattttagctaaacaaagattaatgcctaaaattatatcttctaaattatcatcaaataataaaaaattaaatcatcgtactgattatttcagaataaaagaatacattgacaactttttaaatggcaataatcaaaatagatttattgtaatgcctggtcttagaggagtaggtaaaacaacaattttattgcaattgtatgaatatttaattaaaaatgatgttcctaattcagatattctttattttgatgtaagtgagttgaaaagtttttataatgttaatatattggatgtaataactaattttattgaaaacatacatcaaacaacaatggtggaattaaataaaccaatattcttattaattgatgaagttcattttgataaaaattggacattaactggtaaaatagtatatgataataacaataatatttttatgatttttactggttcatctgctattgaattacaaattcatgctgatgcaattagaagaatggaaaaagaaccaatatttccatgtacatttccagaatatctttttttaaaacagaacatacattttccaaaggagatgtcttttgcattgcaagatttaatactaaatggaaatgttgatttagctataactaatgaaagaaaaatccaagaaagtatgattaacttagataatgatccagatattgaattcaaaaagtttttaacacaacattcattcccattttctttaaaaatgcaagattttcaaattcatgaaaaaactataaataatataaatagaataattgaaaaagatatttcttctttaaaaacatttaatacttctactaatgatactatatcacgaattgttacatatattgctatgcaaaaacctggtggaacttcaaatgttaaattagctcaaatgttaggtgtttctccaaatacaattaataatatcttaaatgttttagaaaaaacacaattattatttcccataactgcttatagtactggaagtaaaattattaaaaaaccatgggagtatttctttttagctccatccattaaagcatcaattaattttgaaattggaagatataatttaaataataaaaaatgtttagccacattagctgaaactttagttgcatcatcattatataaactaaaattgttacgtcataattttataggtttattttatgatcctaaaaagtcaggtgttgattttttagtaagaaatattgataaaataattccaattgaagtgggtgtaggtaaaaaaactaaaagtcaattaacaaaagcaattaataattataattctgattatggtattttaatatctaatagaacatttagcataaaaaaggaaaataatattatttatattccattaagaaccttttcttacatatgaaactacataaatgaaaatgtagaaatgggaatacttattatattatcttctttttgaattctgctgcttctatttgaaactataattccataatctgagttgtatcttgaaatagcttttttaacttgttttgtatttttagcaccaattccaacttctataggaattatatctcccattatagtatttaacagaaaatctactccacctttttcagggtcataaaatattccaaaatctctgttttgctgcagtttaaataaactagctgcaacaagattttcagaaaggtttgcaatgtattcttttggattttgtgtagctaatccattttttatatagatacttgcttttatttgactagttaagaagtaatattcccaggattttcgctgtcttttaacacaagatccataaggttcaacatgaaataataaatgtgttttttccaatgcctgaaatattgattgtatggaagtttttgaaatatttaatatattggatagtttattggatgataactctgaaggttttgacattgctataatatttattaatttgtatgtagctaaacgtattggagttgtaaaagaagttattatatcaaggtctttttcaattattctgtctttcatatccaaagtcaattgcacaattgattcttctgttctatttaaagtaaatggaaaacatccatattgaatataatattcccattcttttaagtaattctggtttaaatttattagattttgattatacatcctattttcgattttttgagattctttgacttttcctgtgaaaatcatgtctctaaaagtttcacttaacatgtccggataattaatatcatattttaaataaagatattctgcaaaatttaatggataaatttcttttttaagagatcttctagctgaatcattgttatactctaaattcaatgcatctgatcctgtaaaaatcataaaaacatttttatcttcatcaaatattattttacctaaagatgcccaattttttgaatattgtgattcatctacaaatatgaatacctgattttttacagttggatatgcttcatttacatcttttaggaaaacatcaatgtattctttaatattaaagttaggaacatcttttaggttttctaaattaagatataatattctgttttttggaatttgtttttcattaagcagataactgaataattggtatatgattgttgttttcccaacacctcttaatccgggcattataaaaaatcggtcatcactttctttttctaaaaatgtgtcaatatgttctttaagttggtaatattctttttttttgttaaattttttatcattatagtttaaattattttcaactattttaggatttgtcttaagtaaatttgtaatatatgattgtgtttcaatttccatttttatcagctttttcaagtagttggttatttttttgaccgaccttttatatatagttggttatttttttgaccgaccctttatatactgttggttaaattttttaccaactatataaaagaatcaaattaatatacatatttataactaattagttactttttagatacatttatatactagaataatacaatataactatgtaataacataagttgttataaaaatattaaaaaattgatttaaatgacattgctattaggtaaaaaacaagaatgtggaaatataactatagttcctattttaaatgattcacctttgaaattagatattttagatttaacaacaggatttaaaatgggtcttgttgaagtatctgagtgtgaacaaagtacagttggaacaattatggttaaaaataatgctacctctccattacttttagtagatggggaagaagtagctggagcaaaacagaacagaattattggacaaagtatgttaattcctccgaataccagcataccaattccagttaattgctctgaacagggaaggtggaattacaaatctgaatttaaacattcaaattatatggcaaattcagaaactcgatgcagaaaagcagaatataatatggacaattcaataagagcttcacaaggtgcagtatgggattctattgaagaccttcaagtaaaaagaaacagtttttccaaaacctctgctttaagggataattatgaaaaaatagaaaaaacaaatgatgattatttgaaacacttcgggatttatgaaaatcaggttggtgtaatagcaaggttagaaaataaagtaggtttggatgtatttgctaatcatagtttatatgaacagtacagtgatatgattcttaaaagttatattattgatgatgttggaaataattcacttataaaagatgactttgactttgaggctgttttagacaatataaatgaaaaatattttaataaaagaaatactgttggtttaggtcagtcttatttcatcaaaacaaataacggatcaggaacctcattaatctatgaaaatgagttgatacatgctaatttcttttataataacagattaagaaacctaaaactgtaaatatattgtattggctctcaaattaaaaatatcaccttttacacgataaaaacactggaaattaaacatcacaccccgcataatatctcctaatttaaaaagggacaaacacgtattaaaaaaccatcatttttacttttttttaaatactaattaaacacatttatatagtataaactcacaatatatacacatgatattataaagaggtactaaaaatgattgaaaacaatatctgtttactgacagacagttacaaagttacccatcatgcattttacccgaaaaatactgaaaaactgtattcatacttggaaagcagggtaggatcagaatttaacaaaacaatcttttacggcctccagtacataataaaaaagtatttggaaggaaaagttgtaactccagaaaaagtaaatcaggcaaacagtctgattaagacacacattggcgaagatatattcaactatgacggctggatgtatatagctgatgaacttgacggaaaattgccgatagaaataaaagcagtagcagaaggaacacctgtagaagtgggaaatgttttaatgactgttgaaaacacagataaacagtgctgctggttacctaattatttggaaccattattactgcaggtatggtatccgtcaacagtagctacactgtcagcagaagtaagaaaactctgtaacttttatttggaagtaacaggatcaggcaaagaaaacctggactttatgttacatgattttggatataggggagctacctcaacagaatctgcagaactgtgcggaagtgcacaccttctaagctttaaaggaactgatacacttgctgcattaacaatacctgaaaactactataatgacaataatatttatggtttttctgtacaggcaactgaacacagtgtaatgacttcattgggagaagaaggtgaagtaaaacaggcaattaatgtaattgataatgcaaaagacggaatattatctatggtaattgacagttataactacagagaattcttaaaacaagccagtacaaaaggcaatgaattaaatgataaagttaatgaatttttagaaaaaactgacggaaataaaatagtattcagaccagacagtggagagcctgtttcaacaacactggactgtttgaatattcttggagaaggttttggaactgtaaaaaccacaaaaggttataaaatatttgcaaaaaacatcggactgctgtggggagacggtttaaactatcataaaataagggatattctatttggaatgaagtcaaacggctgggcagcacaaaacatcatatttggaatgggcggagggctccattcttcagtaaacagagacactcagagaaatgcatttaaatgttcagcacagttaagaaacggaacatggtatgacatctttaaaaatccattggacagcagcaaaaaatcaaaaaccggaagattaaaattagtaaaggaaaacagccactttaaaactgttccaatatctgatgaaagaaaagactatctgcagactgtctttaaaaatggtgaattaataagaaaggaaaatttcctggatattaaaaacaaaacgctaacatacacaaggaagagataaaatgaaagaagatatgtatatcactttagtaagtatgagacacttttttggagtgaagccttttaaaaaagacggaattcttaaattaataaaagaaaaggacaacaactatgatgatgaagccattaaagttgaaatgagacacgccggacaggtagcatatgtatcaaacagtacaaatacggtaatcagaggaacaatgagtgccggcagaatttatgacaaaattttagatgaagattatgcacaaatcaaattctacaacagagatattggaatagctaaaatattaactcctgatgaaatagatgaattaaaaaaagatcctgaaaatgatttgaactttatataagtgattaaaaatgaatttaaaacatttgagtttagctgaaaggcagaattatgaaaacatgacagtagttcctattttaagtgataccaatactccatttgatgttttagatttaaaagaagggctgaaaatgggacttgtaaagattgaagaatgtgataactcaaatatagaacaagtaaaattaaaaaataactcagtatctccattaattttacttgacggtgaagaaattgcaggatctctccagaacagaattgttgctcaaacaatgataatacctcctaaaaatgaaatggaaatacctgtaaactgttctgaaaaaggaagaaatgaatataaatccgagtttcagtattcagattacatagctaactcaaataccagaagaaaaaaagcatacaataagaacaatccccttcaggaagttgtctggaattccattgataatttggaaactgataaaaacacatcctccaaaacaaaagcacttagagacagctatgaaaaaaacaaatataatattgacagctatttaaaacacttcaaaatggaaaataatcagattggagtaatatgcattgtagaaaacaaagtaggccttgaaatatttaataatcattcattatatgaaaagtataatgaaatgctacttagaagttacattattgacagttccaacaaagaaaaaataaatatttccaacaatgagcttgaaaatatattatccagtatagatgctaattcatttattaaaaaaaaagctgtagatttaggaaaatattataaaatttcaaacagctacggtaacggacatatatggaccttaaaaaaataggtaatgggaaaaagctgagcgataaattccattaccttaaaaacttatttataaattgttgctaatcgatattaataacttctgcatgttctgaagagctttctataaatattgtataggttccggtattttgattataatatatagttgttcaattttcaacagattcaagtttgtttttaatacattattaatacaaaagattcaattttcatatattttcattttttaaaaaatcaattacatttaaatgagttattccatttttagagtagtcccagtcatctaatgttaatacatatttgggataattgtcagatattttctctaaaggattaaattctctttcacgtgtattttcatctaaaattgactctgatacttgaatataaatagttttatcatgttttctacatataaaatcaatttcttgttttccaatatttccaacagtaacccgatattctcttctgattaactctaaaaatactacattttccaatatttgccctcttgacttattaactccagcctgtaattgataaaatcccggatcaatacaataatatttttcattaacactaagaagtttttttgtttttatttcttctctttgtgcttttaataaaatataagcttcagtaatatgttttaagtatgtactgatggtatttgttgatacatttatattttcatgcttcaaatactttttaatagagttaacagaaaatatctgacctgtgtttgttattaaaaattttattagcctttctaaaaaaccaatatttcgcatattatttctataaattatatctttaagaacaatagtactatagatatctgttaaataatctattttttcatcatcatcaaaatcaagaactcttggaaggcccccatatttaagatatttattaaatattgatttttcattatcttttgttaaatttccattagttactttgtaatattccaatatttcattaaatgaaaatggatataggtctattttgatatatctgccagaaattaaagtagctaattctccagataataatttggaatttgaacctgtaatgtaaatatcacaatttaaatcaattctatatgcattaatacttttttcccaattggaaactaattggatttcatcaaaaagtaaatatatttttcctttgagattttcagtttgtttaaatatatattcatttagatccacataatctttaatgttgtcgtatttagatgattctaatgatacatatagaatgttttcattatttaccccacgtttttcaagttcatcaataatttgtttaagtaaacaagttttaccacatcttctaactccagttatagctttaatttcttctttatcaatgaatttacgtatttttgataaatataattctctttttatcataaaaatcatctcgtgatattatttatatttttaattaataataaatttttctaattttaaattgtataatgaacaaaattaataaaataataatttttattcattatattatttaaaaatacaaataattaaaaaaatcatcaatatataatttaaaaatgaaattatcttaagtatcaaagaggagataacttaatttcgtctttttcaatgtaaacaaacctttttcatgacatctgatttttttactataatactccagttacacttttgcaataataaaatataaactaaaaataaatagaaataattaaaactcttccaaggctccatcttcacttattttttgaattgttgcttttgtatcattcaattcagtattacactctttaagtaatatatttgcctgagtat

SEQ ID NO: 6164 - DNA, 233771 bp, Bacillus cereus
aattcgagctcggtacccctgagtctaggtcggactagaccttgtaaaacgacggccagtccagtgtgctggaaagagacatatatttatttttcgtttttgataaatgtatcgcattattttttattaaatgcacaaataaggcgattaaaggtaaagccgctccaatgagtaacggtacttcgctattaaatttatagtacgtataacttccaatccatgaaccaaaggctcctcccaaaaagaaaatggtcatatataatccattcagtctgtttcttatctcaggattcaaactaaagataactttttgacctaataataaatttcctgctacaccaatatcgatgctaatacctgaaataagtattacaatcacactaaaaagtgaatgatcttgaacaaaaaataatagtacgatagataatagtacgagcgccattgatacattagtcattgtaaaaatatagcctttatctgcgattttaccaatagtaggagttaataaagctccaactattgcagcaaatccaaacaatgcaatttcattatttgagaaatgtaatggttctgaccgtaataagattggaataactgtccaataaagactaaatgttgcaaataaacatgcgtgataaaaagctctttgttgtaacggagaagtatgtagtagcagttttaccatagaagctattaaatttgaatatgacatgttactatttgatactacttcatagttgggcaaaaattttataagtaacagtaatacagcaactagaatgattagtgaaaaaagaaataccattctccagccgaaccattcagttattccgatagataatgggcgagcaatcataatcccaattaataaaccactcattactttacccacatatttacccgtctcttcaataggtacaatcctcattgttagcggaactaacatttgagctgcacaggctccaataccaattacagttgttagtattaaaaaaacaattccatttgtcgaaattagcgtaccaatcaatgaaataatagtgagtccgataagaatacctattattttcttacttttgaataaatctgccattggtacgataaaaaacaagcccaatccatatccaatttgcgtcaaagtagtgagcaatccagataaatccgaagcgatattcaagtcttttgcaatgaattgtacaattggctgtgcataataaatattcgcaacaagtgagccacaactaattgctaaaatgaatattagaaaatttgtctttttagtcaaatttatcattccttccactttcggaacgttcgttccaaaacaattaaaaaagaaagactatagctctgcaatagccttatcaactaaattatacgctagctttttctcttttttatacatagacattaaattaagactatgatttaaacttaataaagaatatgcaactaattcagtgtcatcctcttgtgaaatttctcctttcttttttccttcttcgataacttgcttaaatgctttttcaagttcattaaaatcatttatgagtatttcttctatggaaggatcaatttgcccaatcagcaatgaagaattagttataatacaaccttttggaatgtcatctgaataacatttttcaatatgttgataaaaaaaggatttcagtgattctttcgtatttgtatcactaaaaagtaaatttctcttttgagaaccatagtttttatactgttctaaaacgagtttaaatagtgcatccttatctccaaagctatcgtaaagagtagagcgacttatacccatcgtttcaataagatctgatatatatgtagcgtcataacctttctcccagaataaatgcatagctttatttagtgcatgttctttgttaaagctaatttttctacccaattaataacacccccctattatataattcagtataatttttctggaacgataagtccagaaaaaaacatcttgagatcaattcttccatataacacatgcacttctacattaatgttcaatacaaaaacagccccactaagcgtattaacacttaatgaggccactttattcatactattaattatggaacgacggcttatagaacgaacgattatcaagagcaaagacacgttcagtgtattcacctggttttgtgcgtcctaatgcgcggtccatcatgttcatttttgcatctaagttatcgatgtaatgcagaatttctgcttcttttactaatggtggttttgggctaccccattctgcttttccgtggtgagaaaggacgatgtgttgaagaattaatacttcttctgcatcgatttgcagctcgtctgctgctttaccaatttcgttcaccataatcgaaatgtggcctaataaatttccttctaacgtatacgttgtggaaattggaccagacaactcgattactttaccaaggtcatgtaaaataacgcctgcatatagcaagtctttatctaatgatggatatagatttgagatagctttcgctaaatcaagcatcgatacgacgtgataagctagtccagatacgaactcgtgatggttcttcgtcgctgctggatagtctaaaaattcggtttgatgcttatttaataaatgtcttgttagacgttgaatgttcggatttctcatttcaaatatgtattgcgtaattttctcaaccatatcttcttttttcactggtgctttttctacgaaatctgagatatctgttacttcattttcatttgcaacacgaatttgtttcacacgtaattgaatacggcctttgtagtttaaaatatctccagccactttcacgattgtttccgctacatattgtttctcaacttctggtgatacgtcccacaatttcgcttcaatatctccacttggatcttgtaagattactgttaaaaatggctttccattgctcgcgataccttttgtcgctgttttaattaacaagaaaatatcgacttgttcaccaacttcatactctgcaattttctttttcattcgaattcctccaccaaatcagttacttttagtatagcacactacaactcattttctttacgcatatgtgttaattttataatctgtttttctgtaaaatacgcgagtaaatgcgcatgacatgtaaagaagatcacttgtctatcctttgcaatttcctttataagttcaatcgtccgattcgtccttaccgcatcaaagtgcacgaaactgtcatcaataataaatggataatcatgctcaaatgtttttgctaacgcaaatctcagcgataaatacaactgctcagctgtcgcttggcttagttcatgactataaaaacgcataccatcgttacgctctacaataaacggctccgcctctgacggtgaaaagattttactatatcgtccgccggttaaatagacgaaatactcttctgatttttgtaaaatacgaggaagatgtacttcatgataatattgcttcgttttcgttaacactgtctttgcagccgcataagcagcccacttcttcacttgttcacgcacttgcgcttttttcatttcccattcatgcattaaatctccgtacgtactaccttcttctaaattcgcaatttccatacgatgctgtgcaatacgctctgtcagttctttttcttgtgccagacagttttgcgcggctgtcagttcttgctttaatttttcatcataaccgtcagcttcataatgttcagctaatgataaactcgttaaacgttgttctaaaagatcaatttgcggtaataaacgtcctacttgcttctccgcatcttcacgtttttccgctagtttacctgcttctaaaaacatctcttcatttgtagcttctgcaatatgccataaactgtctcgttctactagtaattgctttaattgttcttgcatgaactcatattcttcttgccattccgtcagtttttcttttaactgcttacaagtttggcgcttctctttctcattttgcatacggctttgtgcctcgtgcagcttactatactccgcactaccgataacagtttctagtttatgttcaaattgggaaatcatttcatataatgaagattttcgcgtgccttgtttctctaattcacgatataattgctgcattttttccatacgctcaaacgccggcaatatgtgcgcatacgtataaaattcagggaacgtatagcgctttttatacacatttacttgttcgctcgtgcggaacgtttctctctcccattcctcatacgatgaaacgactttatcatacgctcgctccatttgctgcaatttataagactcacgctcaaataacttacgaatctcttcgtctttttctaactcataacgaacagacatcgcttcttcactttgtctcccgccagcactttgctgaagagtaagaagttcttcttgtaatccacttgacggatctttatataaaacgagggcaagaacaatccctaccaaaataatgacactaataaataagagtgctcggttatctataaataagcttgtgaataacacgcatgtgttaataagaagtaacagaagacaaactctttgccactgttttttcttttgcatcgccgctcctgctttttcctcatacttacgcttcattctctcagcacccataccgataaacgccgcatcttggaacgatttttctttctcaactaacgcatttcgttcttcatccgctaacatttgcttctgaatctgtcttatgttttcttcttgttcttctaattgctcttgcgctactttaaaacgatcatcaagctgtgctttttgcgtttctaattcgcgcgccttttgtactgcctgcgtaattaactctttcgttgccaaactcatatcaaacgaaaggactgtttctttttcaaaagtagcaccgatttgttgctcgagttctgcaagctcttcttttatattcgtaatcgttcctgttatatcacgcatttcttggcgtgcattttcatacgacatatgctgcatgcgaagttcttctacataactttctttttgtaaaaactcttcatctatttgaatcgattccatttccgattgcactgtctctatttttttatggagcgaatcaacttgcaactggagcggctccatctttgccttaattgcttcataacgcgccatcccgtttacaggaaactgcccattctcgttttctaacactttctcatacgcacgcttttcaataacgagcggctctagcgctgctaatatttcataatcttgctttcgtttttctgcactctctttttctgcgcgaacagaagcaagcttctcttcactttcttttaactgttcgacctgtttttcatacgtgccaattttcccttgccactctttcatcttctcttcaagtttcttcatctcttgcagtgacacgttaatttccggtttacgcccgctcggcttaaagcgctgatccatttctttttctagctttttatcgagctgtaatagcgcatcgcttccgactgcacttgccgaaaataaataattgccgatatccgcttcgcctagctgatgaatgttttgaaggccatgcatatcaaaagaaaagaccgattcaaataaactttcattcatcccggttaatatatcgtgtaaaatttcttcgccacccgttttcccgtcttcaaaataaacggttacctcgccattggctgtctttggtaatcgttcaattttcaaaaggccgtacttctctgtttgtacagtgatcgcaccgccatacttgccgccttctttcggctcataacggcgttgtcctctcgtcggaaaaccgaataaaatacttttcataaatgagcgaattgtcgatttccccgcttcattttcaccgtacaacaccgtcagcattgacagatccatttccacattttctaattttccgtacccataaatatggagtttttccattctcattttttatccctctcttgctggaataattgttctaaaataatattttccgcttccttctgaatctctttcttctcttcttctgtaaaagattcaatactattacgcgctacaggagatgtccaaatggttcgcaatactccgtccatatttgtgaaagcttctaactcctttagcacactaccgacgaaatgattttcttctttcaaacgctcgatttctgcaaaagaaaccgtctcatttttccacttcatcacatatacgaaatcttttcgctcttcgccggatgctaaaatgtgaaaaatctcttctacgcgcttttcgtcacgcaaataaggtgaaagtggtccctgccctgtaaatacgacagttaatagcgtaccttcctcttctcttcggcactcattcatcgcactcgatacgctcgtcataagttcatcaacagtttcaagaccatcaatattcacttcaatctcatcccacacaacatccgctgtatggaaaaatgaacattgcgacccttgtttcgtaagttcaatcaggtacgcacccttttcccctgtttccttacgatggcgcccttgtatattacctggataaataatatatggctcctctgataaaatttcacgtttatgtatatggccaagagcccaatagtcaaactgtttttctttcaactcacgaatttgaaacggtgcatagcgattatgctctgcatctccttccacacttccgtgaagcatgccaatatgaaaaggcgcatcactcattttcgtatactgcgctgtcatattatccgttaccgcttgctgcaaataactaaacccgtaaatagaagctaatagctcaccatttttataaaatgatttctcttctacgtaaggctccgtaaacacatgaacattttccggaaactcaattgctgcccagcttccccctaaatgatcgtggttaccgtgaataataaaaacagggatatcgtactgcgaaagtctcttcatttgctcgcgcacaaacacttgcgccctcaaacttctcgtctccgcatcatacaaatccccggctagtaatacgaaatccacgcgctcttgaatcgctttatcaacaatacgctcgaacgattcaaacgtactttgcttcattctctcccaaacagactgcggtacattcatctccattcctttaaacggactatctaaatgcaaatcagccgcatgtataaacttcacttgtttcacaaataacgatcctttctttttccgtactttactacgaatagtaaatctagtgctcataaaactttctctctattttaccacgcaatgtcatatatttctttgcatattctagtgatttatgccaaaatagttataagattctgatttttattattggagggaattttcatgggagtatacgttctaacagtctttgaaaaagatggttcaaaagcattagacgaatcattcgaggcggcaactgaaaaagaagcgaaagcaaaaggtgaatctattttacgagaaaaaggattgtatgaaaaaacacatcgctgcacatctactgcaggtaagctcgttttattccagcgctaaaaaaaagaagcgtcatccgcttctttttcactctactatatcttcgtcacaccacgtaaacaccacatctagaatgcgattaccgatacgtacgcgtttattccattttcctgtttggatctgatgttgcaattctgctttcatcttttccgtccagtcgtgaatcgtttcactaccgtcgtacggatatacgccctgaaactctttctgcagtagatgcaagctctctgcatcaaaatgaaaatggaagaagtagtttgctgtaagcgatggttcttgcaatcgtaaaaactgatcatcaatttgctttctatttctatagaaagtaaagatattcactttaccgctcgtaatttggtcaatttgaatttcgtgcttctctataatcacgtcttgtccacctcgttatatactatctttagtatatatgtcttttgcaacaaagttaaccattttcgcgcgaaattcatttccttcattatattacctgtacctccatatgcaatcagaacagataaagtgaaactttaatcattggggaatcttttcatcccaaatgattattagttgaaccaatcgggcatttacgggcagttgatctcccacctaactgctttgcttcatagcccaatttcaaggtgggagtcttactgcccgttaatgcggggtaaaaacaaagttgaaggggagcgatcacatgtatttcggaagcaaaggttggtatgtaaaagaacttaaaaaattaggtatccgtacttatgaaggtaaaaaactagaatcgtatcgtacgcatgtgttatctagtttacttgagagaatgaagagagcttcggcttaataggtacaaaattcattttcgttattacaacataattaaagctatattttatatagtatgtaaaagaagctgtatcatttttgatacagcttctttttattcatacaaaatgctccttcttttcacgattctaattctacttacctttcttatcgatcagcttaatgtggtaattaacgggctttataacctctaaatcccaatgtcggtttgatatatataaagttgaattattttccatataataatttccaattaaattactttcttttcccgactgatttacataaataatttcaatttgcttttcataatcttggtttatcattcttattgattgtccactcaataaagaaatcctaggcagcaaaacaaatgaaaataatagtataagaccaattcctaacttcgatacactatccgctttattggaaagaatactataaaacaaaaaaatcaccttatatgtgacacctcttttttcaacggacttctctttaatttgttccggtttttctgcttctatttcctctatacgattttcactattatcattttcagctttcttttttttatttcttttttcttttactaattttactagtgattttagtattttacctgaaaatttcgctaacgttacaattatcattataactatatatacagctaacaatatcaaaataagagtcgtcattttagaaaaagacaatattttatttcccactaaactcaaccatactagaatagaaataataatagaaagaggtaatttacttataaaataaaatcctttcatattatgccaatgactaaagttttcatgacaataacgaaagattatcattgtcatgaacagagaaggaataaataatatagtagacaattctaggaacttattttcttctaataccttcataacactcaatatttttgcaaaaaggggtaataataaaaattgaaacataactcctcttatcatgataataggatattcccctgcgatgacgatagtatataagtagcaaattactcccaaaataaacacccatattaaagaaaaacttagcacactattaaatgtgatttcattagcaaaaaacatcgttatagccaaattcaataagaatatgattaaaacgaataaaatgacgatagctcccttcttctccttatttttacgtactaaagggaatagatgctgaaattatataataactgcaaataaaaaatattgaagtgacagttaaagtttgtatactaaaggggactaaatttgagactatattaaaatttgagttatgaaaaatttcttccccactaaaataatatccatacaaaaagctatatataatgagaaaccctaaagatgatataagagtaaaaccaaaaaataaaaacctcacatcaaaaaataaactttggacatgttcaaagttcttttcaaaaaaagaattaataaaattcacctgtgcacatcctttataaaataattttcattccatatttcaataacatgcttctaatacttgatttatttgactataaaatctcaatttaaaatctatatattattataatttaataattataataatccaactatggatataatttatattataaaaaatacccacaaaaaatctcctatgaaataagcctataaagattatttcacaagagattttttacaaattatttatcttcttcatataaatctaccaatcgtctcccaccaaccgtacgcgtcccaatcatcttacgtaattcctgcgcgttttttggtctcttagtaattaagcgtgtttctttttctatcactgtacactctgattttatttgcattatatcaatagctaccacttcatcatctgcctttttgttcaacataatatcatccttcccttttacaaaatgattcgatatataccatatactccgtcacttcatattgcccttcctatttcatttcctaatctattccgaataaactaactccccaaccaaaaatgctataataaacccaatcaaactaagggggcacatttatcttgcacggaaaacacattcaatttcacaagtttggcaacccaaaagatgtattacaagttgaatataaaaatatagaaccattaaaagaaaatgaagttctcgttcgtatgttagttagaccaattaatccatctgacttaattcccattaccggagcgtatgcacatagaattccgttacctaacatacctggttatgaaggtgttggtattgtagaagatgtgggagcttttgtttctagagacctgatcggcaaacgtgttttaccgttacgcggagaaggtacttggcaagaatatgtgaaaacatcagctgattttgtaatccctattcctgataccattgatgatttcacagcggcacaaatgtatattaatccccttacagcgtgggttacatgtacagaaacgctaaacttaaaacgaaatgacgttttattagtaaatgcttgtggatccgctattggccatctttttgcgcagttatcgcaaattttaaatttccaactcattgccgtaacaagaaatagtaaacatacagacgaattacttcagcttggcgctcatcatgtaatcgatacttccactaccccgctttatgaaaccgttatggaattaacgaacgggctcggtgcggatgctgcaattgattctatcgggggaccagatggaaatgaattagcttcctccttacgtccaaacgggcattttttaacgatcggccttctatcaggtgtacaagttaactgggcagagattgtcacgaaagcaaaagtgcacgcgaacatatttcatttacgacattggaataaagaagtgtcaccatataaatggcaagaaacgtttcgtcatttaattcacttagtagaaaataagcaattacgttttatgaaagtacattctacatatgacttagcggatgtgaaaacggcggttgatgttgtacagtccgctgagaaaacgaaagggtaactaactgttatgatttatttaaccaattataacgaaagttaattaaatatatcagtaagccctgctagtcaagtgattggctagtagtgagggttaactgcgggcaatccctaaagctgattgaactacaacgtggctagaaatggcgagcgtgaatgttgcgaaagcagaaaaaatcaatcagatcgtgcaaggttaaatcctaaacactagaacaatgggtcttccgcctcgaatcatctaagtcaaaagtgataagatgaacgttcaacgactatctcgtataactgacgagattacatcacaagcctatggtgatggaaaaatcctctatctttaaagagataaacatatagtctgcgctcatgtgaaaacatgagaagttcataagagaactggctaaggaattgcgcccttagttgaacaagataaatttgattgaattgtatagatttagttaagtttatcgtatcggaaagtgtttttgacgagttattaaatgcaaaagaagaagtcttttgcatttaccttttaaatagactagatagtacgtttagcagtctataattgtaattttttggtataattctattaaaaggtgaaaggagcttctaacatgtggttcatttcggcaatcgcgcctgttctaatagtcgggggaattgtagtatttgtaataaaaagattggaacataaatataagcacggcaaattgggtaagaaaaaatcaaatgaggctcaaattttattagacagtttaataccaataggaatgtttattggttgtatgatcggcttgattttcggcatgtttttcccggacttctccctgctttcagttagtttagggaccggaataggctatttatttggttatttcgcctataaaatttatagtaagacagcaaataacttttcctaattcaaaaagaataaataggacagtacatagtcgtcatatccaatatgtactgtcctttattttggcatcaacgtaatcaccttacgttccacatcctatacacctttttgattgattttcctctcctccctctttcgtatatccgcttttttattttcactagatctatatccatagtaaagtaaagcacatgtaataactgaacctacaatgtagcctaaaaaaccccctaaccaaaacataatgtaattgcctccaatcctttataaagtaaaactttaatcagatctcaccaatcggacgtttacggacagttgatctcccacctaacttctttgctccaattgaaattttgaggtgagagttttactgtccgttagcgcgggataaattttatgtactataactctttacatgctcaatcgtttatttctataaactatacactctctaaggctattcataccattatttctcttcttacctcaaatgacaattttattatttgtcataaagttaatatttttccatattattacttttgcctttaaaaataatatactacatttgaaataagccggctagtatattggctcttctccctcttacctttagttatgaacaaaaaaatcccctcgaagcataatcttcgaggggtgagcctgtttttttatttacttatatacgtacagctgtaccacttacagcaaccattaacattccatcacgaactacttcgtaatctacgtcaacgccaacgatagcgttcgcacctttttgttttgcaagttctttcatttcatccattgcgatatcacgagcttcttttagcttactttcgtaagaaccagcacgaccaccgacaacatcacgaacagaagcgaataaatcgcggacaatatttgcacccataatagcttcaccatttacaatatcgatatactcaataatttctttaccttgaattccagacgttgttgttacaatcatgactgacactctcctaataagttgtagtttgaataagctttcttatgtctttattatgacatggaacaaacaacgaatctattgaattaccttacaggaatgtgacagttttgtaagaataaaatgcctattatgtttaataaagcgctttaacattaggatatataaatgattccctattttctttccagtcgcgttctacttctttaaaagttggtcgtcctaattcttcattgttttcatgtttacgaaaccatttcttcacatactgatctccatttttattttgaactgtacaaaggaaactattactactatcttttaatatttttacaatcacgaatagacacctctttccttttaaaataacgtaatagaacttgatcttttactataagcccttcctctcttatagtcatacgactcctcggtcgcgccaaagttgtaagatcaaaaaatgatattcactttgcttatttaaagaaatcagagttataagcatgatgcttatcaaatattttatagatttctaacttatcatctaattttgcatctactaaaatcaatatatttccatcgtaaatgtattcttcatatttcttagcatggtcttcagggattcctaagccaataaatgctcctattaaacttccagctcctccgccaataccggctcccccaatagctgctgcgatcggtcccgctgctacaattgggcccagtccagatacagcaagtacaccaagacctgttaataaaccaccgagtccgcctgctactcctccagctacaagccctgtcgctgaaaagatatctcctttatgtgcagtttcatgattcactttctcacctgatttttcttccagatgttcaatttccttttgatctttcgcaatagctgaaatgttatctgccgagtatcctttttcctttaattcattaataacgagtgccgcatcatcaattgttggaaaaacacctactatttttctatccatattcataactattaacctcctaaaattttatataacgtatctttattactcttcgtttttatatacactaatttttttattcacataaccatttacgaaaaatgctaataataaaaggactacaagagaactacttaacaagtaaatgaaatcaaatgtaatatccgttatcattttatccatatgtaacagtctcctttttatttaaagtaaaagtatatttttatagactaaaactttacaatccatcttcggtcaatctctttatggtatatgtatacccttcttccccctttctaaacgtaaaaaactataattatattttttcttatttatatgtttaactttttttaaaacgggtacgtttatattgttatgcttattatatggaaaggaaaattacgatgaacgccattcactctactactattctttataatgaaacacctacaataacgcagattcatcatttttatgctttaatgacaacatttcaaacgaatgtatttataagtaaacgaggaacacttacttctattaaaaacttaagcacattagtatcatttttccttactataaaaaagagagagcttgtattatttatattgaaggaatagatgcaaaaagagctttaagaacactctttccttcttaaaggttttattatcccctattccctcgattgttatttttcatacatagttttatacttcaaaatgatttcctctattcaaaacgagaccccctaatacaatagggggatttctagtttagccctatgaaaactgatataatatatattacgtttttcattctttaaaatagaaaacttttaataaccttgaaggtaggaatttttaatgaaatcgaaagcaaaatttagtattcgctacaaaattatggctggttatttagttatcattttgtttttacttatttcttttattatgttaaacaatcagatttccaatttacaaaaatctcgcaattttattattgatcacgattttaaagttctcaatttaacgaatcaagtggagaaagacttgctaacaattgaaaataaagcgaaaggctttatcacttctaataacgcgaactatttgcaatctcttaactctgccgaaagagattatgaaaaacattaccataatcttttttctttattagaagataatccatctcagcaagaaaaattaaaagagattaatggaaacattactaattggatgaataaagagattcacccgttaattgcaaatcataatagtaataaaatacaagaaatcgacactaccgaaatccaatcattacaatcacaactaactgacttccggagcactgaggaacaactaacgaaaaaaagagctgcacaattagatactgaaaataataaattagagcgttggttatacagtttattgttcttactatcttgtatttctattatcgtttcactttatatttccaattccattacaaaaacgattaaaaatgtaattcaagctattaaatccatttcttctaaagaaaaaattacggaaagaattcatgtaaatacacatgatgaaataaaagatcttgctcatacaacgaaccatctgctagacgaaatatcgaaaagagagtggttacaaacggagattgcagaattaattttaatgtatcaaggtgtatcttctattgagatgttaggtaacaaaattttgagtggcattatacaaaaaacgcagacttcttgcggtgcattctatgtacgtgaagaagttgaagaaactgtctactttgtgaaaaaagcttctttcgccgatcaaggtattgatattggaaaacaatctattaaaatgggtgaaggtttcattggacagtctgctttagaaaagaaaagttttattcttagggacatacctgaagagtttcgttacgttactactggattattagaaatacgccctaaaaatttactagtcatccctgtcttatttgaggatgaagtgattgcagtaatggagttagtgagtgtaactgacatttcagatttacatcaagatttaattcaccaaactgttgataatctaggtttaacaatccatagtattatgggacgtatgcgaattcaaactcttttacatgaatcacaagcaatgacagaagagttacaagttcaatctgaagaattgcaaacgcaagcggaagaactacaaatgcaagccgaggaattaagaacaacgaacgaacagttagagtctagaacggaagaggccgagcaaaagacagctgacttacaagtgactaaattagaattagaagaaaaagcaagcgagttgttacgtagctcaaaatacaaatcagaattcctagcaaatatgtcacatgaattacgtacaccattaaatagtattttactattatctgaaatgttaaaagaaaatcatgataatcatttatccgatgatgaaattgaattagcaaccgtcattcattcatcagggaaagatttgcttactttaattaatgacatactagatttatctaaagtagaagctggaaaactagatgttatttttgaagcaacaaatataagtgatatggcagcaagtatgcatcaaaacttcttacatatcgctgcacaaaaaaatgttgaatttactgttgaagacagtgacacgattcctgatctgttttatacagatgcaaaacggattgaacaaattattaaaaacttattatccaatgcatttaaattcacggaaaaaggatccgtctctttacatttcgattcggtagaaacaagcaacttgagtcatgatatgcagtctataagtaaagactggatatcaatttcagtaaaagatactggtattggtatcgctaaagaacagcatcaacttattttcgaagcctttcaacaggcagatggcgcaacgattcggaagtatggtggtacaggattaggtttatctatttgtaaagagtttgctagactattaggtggttggattacgttagaaagtaatgtaggagaaggcagtactttcaccgtatatattcctaaccttccaaacggattaactgatatacaagtatccaatttagaagtcgcagcaacggtagatgaagttattcctgctgaagttgttgaagaaaccatcgttcttccagaaacaaataatgtcttccaagagaaaaccattttaattgtcgatgatgatcatcgaaatatatttgcattacaaaatgcattaaaaaaacaccatgccaatatcattactgcacaaaacggcctagagtgtttagaaatactaaaaaacaatacaaatatcgaccttattttaatggatattatgatgccaaatatggacggttatgaaacgatggaacatatccgaatgaacttagggttacatgaaatacctattatcgcattaactgctaaagcaatgccaaatgataaggaaaaatgtttatctgctggcgcttcagattatataagtaaaccattaaatttacatcaactctattcggtaatgagtgtatggttaataaaataagtgaggtttcgtttcagtggaaaataagtattataattttgatccatcagtagatatggataagcgtacgaacttagaaattgacttactattagaagcggtatttaaactatcaggatttgattttcgccaatacgctcgcacatctatttataggcggatttgtaatcgaatgcagatttctaatatccctaccatttcaaaattaatagaaaaagtaattcacgaggaaggggttttagaacagttattaaatgatttctcgatcaatgtaactgagatgttccgtaaccctatcttttttaaggcgctaagagagcatgttattcctgaattaagaaagcatcctgaaattagaatttggcacgctggatgcgcaactggtgaagaagtattatctatgtccatcttacttcatgaagaaggattaagtgaaaaagctattatttacgcaacagatatgaatacagatgtgttaaaaaaagcaaaacaaggtattcttccattaaataaaatgcaaacttatacgaaaaattatttacaagctggcggtacacaagcattttctaactattattcaacggatagtcgttttgcttattttaatccttcactgttacaaaacattatttttgcacaacataatttagtaaccgatcaatcttttaacgaatttcatattatcctttgccgtaacgttttaatttactttacaagtaaacttcaaaaccaagtacagcaactattttatgaaagtttaagtcacaatggattcctatgtttaggaaataaagaaactcttcgtttctcggatatcatgccgcattatacgcaatttaatccacacgaacaaatctatcaaaaaatacaataaaagcgtatgaaatcctctatttggatttcatacgctttttatttcgcattcgcttgtatcatgataagacacatatcatctgattgtgcttccttctgttcttccttgtaaaacccttctatctcttcttctaactctccccattttctttctgtaaaattacgtaatttctcttcagcctcaaactcatcacttgctattgcttcaagtacaccatctgtaaacaatacgatttgagcatttttctcaaaaggtataactgtcttttcaacttttatctcatcaaaaaatcctaccgcacaactcccgcgatttagttccactacatttgtttcatcaactaaaacatatccagaaggatgtcctgcatttacatattcaatcgttctatcttctgtattaactactaagtatatcgctgtaaaataatatggaatattgtcattctcattatgtaaaagagtcatatatttatttaagtctttcatgacaagttctggatcgattaaacatttaatcgtttcacgtaatacagacgaaatgaacatgcaaactaaggaagcagatacaccatgtcccatcacatctaataatataataccgtagcggttttcatcgattttataccagtaatacatatctccagctagtttaaatgaaggtaagtaacttgcttcgatttttatgtgttcttctcttaatgggctacttaataagtttctttgtacttgcgtagctaaatctagttcattccgaagattttcttcctgttctttatgccaatttaattccgatttcaagcgtagtgctacacgcatacgcgctaacaattcaaccttatttattggttttgtaatataatccattgcacctatatcaagtgcttcagctaatttattcgcatcttctaaagctgttacaaaaataataggaatatctttaaacttctcttctttttgtaatcgcctacaaacttcaagtccatcaatttcaggcatcataatatctaatagtattaaatctatttcattatgcctggaagaatcttttccaaaatggatgtattcgaaaagctcttgtgcagaattaagtgatacaagatcctgatatccagcttgttttaaaatcttcttaattacaaagatattcaccggattatcatctacaattaaaatggacacaagtgatttccccttttcttatataaaatgtaaatcgattattattttctatttttctagtattacatactcagttataaaatgaaaatttcctactcaaacatattttttatatagcaaaagaacaaacccccagaaatgagagtttgttctttcactctataagtttccacttttaatttagcaccattgctttatcacttaaaagacgatccaattcttccatatgatttgtttcatctgcgatcatatcttctaactttacaactaactctgtcatatttaatttcgctgcttgttcttttctcttttcataacgcttaattgtttcatattctgactttctagcttcttctaacatttctctaacgtcttctacttgtttcactggtaaagggatcgtagtaggtgtaccacctaacgtcttaattttctccgctaaatatagggcatgtccttgttcatcactaatttcagattcaaagaaaggttttaacacttgtctatatataccagaaactgtagctgcattatggttatacataataattgctgagtattctcctgctaaatcttcattcaatccttcgattagttctttcacatcgtgtgacatttttatatctcctcctatacttaatacgtaccccttttctcatgttttaaacatcattattttaaattttttatgtatctaaaaatgcggcttgcttcaatttacttatcgcttgtcttttaatacgagaaacgtgcatttgtgaaatacctaaccgttcccctgtatccttttgatttaaattctcttcaaatatataatgaataacactcttttccgtttcatttaatacgttaaaaatatcctttaaaacgagacgcctttctgtctcttcatatccttgctctacttcacctacagattcaattctcgctaccgaacttccatcagatgcattttcaactacatcatctaaggaagatactcgataattatttttcgcatccataatttctagtacttcctcctcggatagtcctaaatgatctgcaatctctataatcttcggtgaacgctgcaggcaatctgttagctcctctatcgcaagtttaatttttccgcctaaatctttaattcgccttggaacgtgaatgccccaagttttatcacgcaaatacttctttatttcccctactatcgtaggtattgcaaaaggctcaaaggcattccctatcgaataatcataccttcttattgcgcctaagagccctaacattcccacctgtataatatcctcatgcatcggcccgccttttgaatagcgatatgcaatagaatagacaagatttttataatgatcgactaacctttcctgtgcttcatcacattggttttgttgaaattctgcaattagtttaataacgtcttctttagtaagagttgtaggttgagattggatttccatcattctccacctgctctctttgtatatattttgtcattaaaactgtcatgccctcatcatgcatgatttgtatatcatccattaacgtattgattaaatataaacctaaaccattttccggcaaatgttctactggtttactaatatcatacgggccaaccttacttcttaagttgttaaaatcaaagctaaccccattatccgcaaccataatttctaatcgatcttcatatagcccaaagacaattgcaatttctccaacgtcttctttgtatgcatgttgtacaatgtttgtacatgcctcactaatagcaattttcatatcttctatatcgtcataagcaaagcccattcgatttgcaacaccagccattgttaaacgaataatagccacatattctgcctttgcaggaattttcatttctatcttttcaaatctctccatcatccctagtcaccttctttctactttttcaaaatcggaattcaaatttaatatttctgttaaccctgtaatatcaaataatctttttaaccttttagatacaccaataaactctagttttccattatttttcttaaccgcttttaatagagctataaacacgcctaaacctgtactatccatatactctacctcagtaaaatctacgacaatatgaacctctttttcgcctgcaataggcataatcttattttttaaatctgatgccgtatacgcatcaatttcaccattaagctgtaccgtataacctacatcattttgcaaaatatttattcccaaattcatcatttccgcccccttatctcaaactactactatgttaattacccataaaaattagttttaaacatatttttttatttttattataaataaattttccacacctttctcggcttaacacgtaaaaaatactaccaaatgtttaaaccttataaatttgtgtatatataatctataaacattatttttagggggatctatctatggaagagcacaattttaaaaaaggagattttgttcaattttcttatcgacacgatcatgctacaaaattagttggttccattattaatatactaacgaatacaattgtagttgatataggtaataacgaggacttatctcatatagaaccaaggcaggtcgtaagaataaataattgtaaaaaagtaacgatggtttaatacataatagaaattgtaatttcaatgagtgggggttcttcatcctccactcattcctatgtagattacattaaaaaagcatccaaattagtttaattggatgcttttttatgtatatttatcagttcattaattttatagctatatataataaacttaagattactattcattatcatacttacgctttccgcaacattctagagaagaatgtaacgattaaaataaagacgattgcacctaataaagctggaagaataaagatgcctccccattcaggaccccaatgaccaaataacgcactacctacccaagatccaattaaaccagcaatcacattaccaactatacctaaaggaaagtcttttcccgtaatcattccagctaacgcaccaataagtccacctacaatacacgtaataatcagtcccacaattaaccctcctatattcgttttatattggatttatcaagctttggtatgtaaccaaagcttgataaacatgtattattctttatgatccaacccgtcacttatcttttgtttcacttttccgactttttcttttatcgttcccttcgtcttgtcccacttcccttcatttttcaactttctatcttctgtaacttcaccaattccttcttttacttgtccctttgtcttttccactttaccagtaatttgttcttttagtccgctctcactcatatttcccatctccttttcgtaatagatttatagatttacaggatacaaatttaaatagaatacatgcatcttctttcttgtaaccattcaccgactctctctaaatctttaacgaataacaagatttttccttcatctagcttttcttcgtagaagttcgcttcttcctcattaagccctaactcctgcatcttatttcttaactgatctcccgttttttgaaagacgttaataatacttgtcccaagtccctcctcttgtataccaattgtattcacgtctgcattgtctgcgattctatctgtcctttctttctcgtgtgttaatacgtaaatatctttttggtctattcctttcttcactagatcattcgccgcattcatgacctctttctccgtaataaattcatatacaaaaggtttcctatacttcgtttccatctttaacttcctcctttaaaatgaattatttgttatattatatgtagtacacctattttcgaaatgttaaacataaaatttgaaaaaaatgaaaaggagagtacatatgcactttcgtctagagctatttgttgaagatttgcaaagatctattcgtttttatgaggaaatccttacccttgtattctcaaaaaagaatgcaactagtgcaatgattaaactaggggatttttctttattattaacccctgattatattctcaatgaaaatcattatttaaaaacaggtggacttaagccaaaaggtaaaggtgttgaggttatcatagtttttgataatattgaacaaatataccaacatgtattagaaaaaaattatccagtggaatctaaccttaaaatgcaatcttggggaatgaaggattttcgtattgtagaccctgatggttattatttacggttaacctcctcttgaactttctctatcctaaaactagtaaaataaatcctcttacaataaccacctaaattaacagaaaattgttataattaaacttaaggagggatactatgaaaaaaatcatatctatatgcgctctaaccgctctatctttcactgtaataggctgtacaagcacctcagctacaaataaagcttcacaagctaagcaagaacatacacaaactacctttcaattaaaatccgcaaatattacagacattgaaatacttagcacaataaataacaacgtttcaaaatctcaaacagacaacgaagaaatgatacaatctatcgtttcagcagttcaaaaaggcacgcctaaaacaatcactttagatcaaaaaaagcgagaatcggcacattctactattaccgttacatataaagatgactccaaagaagagtttcttgtttgggttgataataatgagaaaattacgattgctaaagatgagaagaaggataaggttgaaggtgtaacagtgaatattaaagatgtgaaaatgatgaaggatttcttttaaaattttaatataattgatgttaaaaaagagtaggatgtaatgaagtgacccctaaaagttagacacagttatttcattaggcagcttgataaaagtgagtccggtattgtaccgggctcatttttaattttgccttaatccgtttcgtattataataatctatatatttttctaattctattttaaaatgatctacactttcaaacttttttatgtagaggaactccgacttcataatcccaaagaaattctctattactgcgttgtcgtaacagtttccttttcgagacatactctgtacgatcccccttgattcaagtgtacggacgtattgtctcatttgataatgccatccttgatccgaatgcatcagtagctggtggttttcaggtaaacgttctaatgctttctctaacatctctgaaacaagtgaatacgtcggtctagaaccgattgtataggtaataatttcaccattatataagtctaatacaggtgatacatacagtttctctccaaacaatttaaactccgtgatgtccgttacccatttttgattcgggacatctgtataaaaattacgctctaaaatattaggtgcaattttaccgactttccctttataggatttatatttcttcatacgcacaacacactttaatccaagctctttcataatgcgctgaatcttcttgtgattcactttctgaccacgattcattaattcatcacgaatgcgacggtagccataacgaccttcattttcctcataaatcgctttaatttcagctttcaaatcggcatcttgatccggacgattcattttctttactaaatcataatacgtactccgtggaataccagctagctccacgagtgccttcaccgaatatttatgccttaattcatagactacttgtgccttgtcttgtttcttgatttttccttgttttgaactaaggcattcaacttttttaagtactcattttccatttcaagctgttgaatacgtgcttcaagtgcttcgactgacccttcagctaaagcttgttttacttgtttatttgaatcttttttcatggatggacgcccctttttcttagattgaagggcatcaattccttgtgtttcgagctgttttttccaaacagaaatcgttgaaggggcaggaatgttaaagatagccgccgtctcaaataaggacataccgttttcaatcataaagtttagtacgtctagtttaaattgttgtgtgtaatttgtacatcgttttagaaaagcttccataccattctgtttatattggtttacccaattcaaaataattgtgtcacttataccaatcgatttacccatttctcgataactttcatttccgttcaaataacgtagaacgatttgtattttttcatcagctgtaaatttagccatagaaaaactgcacctccaattgttagactgtgtctaacaattggggtgcagttcataatcctactcttttttaatcttgtccaataaataaacttttataaaagctatttaagatctaattttgctaaatcatgttgtaaaacattatttccttcttgtgggttaaatacgattgcactaagaccaaaaacattcgtaacaacatctctatctttcgaacgaatgattcttacttcataagcaaaaacacctgaaggaagagctgctgaacgaaaagtaacacgtcgattaggtgccaatgtttgtgttgaagggtctactaatggtaacaataccggagaacccgatgaccaatcaaacatttcaacagttactgtatgagtatcatctggatcaacattcatagcttctacagtaagaaacaacgtagcggaatgtctacgtaatacacccgttgacaaagtttcattgtggtgtttatgatgtttttcaggaggatgatcatagccataactcataccaatcccccctttcatttacaattaagaataagtattccttacaatatataatgctagtattattttaatgaaaggtataaaagcggatttctatctgtgtttttggaaatttcatttcccacttattccctattaataaataatatagattctcctattttgtccttgaactccttcaaagaataaatctattttgaaaagaacctgctccattcataaatacataaagtaaatggaatccgttaaaacacataattgatcctttgttttccccctcctatttaaaggaggaactgttctcggctttggtgatagttatggcttcgcgggaggatttgctttattagttgtattgtttattttattaatcatcgttggagctgcttgcttctgttaaaaaactattggaaaagacatgcgttcaagtgtaactaatactttaatgatataatattacattcgcccccaaaatgaacttcgatgctataaaaaagataaagtgttcatttatacaaccttagcttgatagcaatatcatgagttcccatcccagacaaactagttaacatctcaataattgctattgcagaagagtacaacaagctggacaacatagatttcaaactgtaagattagatgttggtgaaatcggacagcaaagtatatatagaaaataggtgttaattttgaaaatcaataaaaaatttgaaccgataatttttaatctctttatgattttaggtatatctagtattatctctttcgtcatggtttcaatgaatgttgggtatacagctttatttctcaaatcatggataaaaacatgggcaattgctttcgtgcttgcatttttagcttctaaattactaccctttgtagtaaaaaggataatgaaaatattcatatttgttgagaaggatgcttaaaactaaagtgatgcactactttagtttatgtaaatgaaaagagacaatcaccacaaaacttaacctagtaaaatgttttaactcgaaggaaggcaccttaaaagttgcttttctttatatgttaaaaaagctcgcctatttccgtaggcgggctttatctttattacacaataagaaagtatactctctttttctctaaaatttcatgtaattatacatattcatgaacatacatgtattgatgaactttatctctacatacgcatggcattaatccattgaaaatttgtcttctttaaagaaaaactctcttttagaaaaaagaaaagacaccctaaagtgccttcctccgacttgaaccatcttaattttaataatatgtattggactcccatccaactattattttaccatgttaagttgtttttgtttattgagaaatacaataatttacttgtgctggttgtctatatgagatctttttgtagtccatgtagtaattaacaaaaaatcaatagtagtaatgacacctaaaagtccttgcttgaaccaatggatagaaacataagcagtactgagtatgtattaaatctccttataagcaacctctctatgggactacacatagggagaaaaatagatatatacttctctatctaccttaatgttacttgataagtgcttattttcattatatatacaaggaaatgaaaccggctataacaatcaatggaagggttactgcgagtttattttttagagggacacgtttgtctggaacaccggggtggataacaaaagcgagtaaaacaattgctccaataatacctaaaagtgtatgaatgatgatcatcctcctaaggaatattattattaattttatcacactcaaacaaaaaaggatataaataacaattaaccctaaacaaactattttcaattccaattatatagcgtcaccaaacataaagtgaaactataatcagcggtaagcccccttccccattgattattaattgaacctatcgagcatttacaggcaaatgagggataacagtaaaaataatataattaaaagaggagtgaaatttcactcctcttttttacttgtggattttaacactcattagatcgctactagaattttgcttctctaagcttatctctattttaagattgtttttatttatatcaaaattacctgtgcgtgtattagaagccactatattatcaatctctgtactcaaatctaagtttggatttatcatattgatccattttttccctaactctactaacgccttcttaccttgacctctatcaattacaaaattaacggtaaagttactttcattatcgccttctacagtgaaattcccattaaattctggaatcccttctaataccggagagaataacacgacctctgaacgtggaccgcctatccctatatattttagctccgcattatattttgcgttaatttcagtaataagattttgtgcttccttagatatagatttttttaataccgaagagctatccatccaaccttcatgataataaatgagctcgtctgctaaatcttgtgggatagcagtaggctttgactcatgctctttttccgatttattaattgcattgtataagaatagtgcatactgctcacgagtcacgagactttgtggttcaaacttattatcacctgtgcccgtcgtaattttattttcttgtaatgcactgatagcatttgttgcccagtaatttttatctacatctttgaaagtagtagtagatgttgctttgaagttaaaagcctttgttaatacaacagctaattgttcacgcgttaaaacgttatctggaccaaatttcccatcaccaaatccgttcataataccagctttattaagagctaaaatttcttttttaaacatatgctcttctatatctgtgaaagggttttgtgtattaagttcatctactggcttcaagtaggcatatattagtctagctacttgtcctcgtgtaatattatcaccaaaaccaaacattccgtttccataaccagccacaatatttttctcttttaaatccataattgcttgataagaccagtgattttcaggaacatctttaaatcctagtgtattttctgcttgcacatttgttagaggtgttagtgttgttgatgcaataactgcccctgctaaaattaattgtttaaaattcataattgaatccccttattcttaaaataatatattaaaaaaataccgtacatactttttaatattaacatataaaaatgttttttgtaggttaattatggaatatttaaagaaggttattccagcatataatgtttatacaactaaattaaaatcgtactaacttgcttccaatacgcactcatttcctttatccatttaaaaaaatacaatttataaatgcaaaaaatcccctcaaagcatcagctttaaggggacccatcctatcatcttctctcttcatataatcgatttgctttatacgaacaaactaaatacataacaattgcagcagggataaacaaccatgcaaagcctctcatcaatgcaagtggtgtttcaaataagaatgcccatagaaatgatacaccttgcttatcccatagtcctggcgtaaaatatagttctttcggatttgcaagtgctcctaaacgaatcgtgtcattaaacataaatagaattaatatcggaatagaacatatcgctaattctaaaaatgttttagatagacgtttatatttccctgctcgtgacatttgatctgaaaaaatgtcatcttcattttcctcatttacctttttaaaatagtgcgtacctgaccaccaattaccagctatatgctcccagccactatcttcaaataatgtacagtaattcataaattcactttttctactaaataccctatggtctattttaatcgtcgcatcttccggttctgtatatctaaatgtataaccaaatgtattgctttctagttgatagcctttccaagccatctcttctaaccatttttcctctttctcaaagtctaaaaagaatttcaatttccacatcattgtttccccctaactatacgtgtaataaagtgaaactttaatcagtgggggttttcttcatcacccactgattattagttgaactaatcggacttttatgggcagttgatcccccacctaacttctttgctttcgctgcattttgaggtgggggtcttactgcccattaaagtgggataaactttttgtaaccgcaataatgtgctgcattctcataaagtctaaatgcaatacttctttcccgcgttccgtaatgacatacacttttcttcgtttatcttcactttttaccgattctattaacccttgttttaataaattttcaaccgccccatacaatgtgcccgctgcgattttcacttgatgattactcagttcctccaccttttgcataattaaataaccatgtgctggctctaataaagctaaaagaacgtaatacgttgtttccgttaatggtaaattcttatctctattcataaagacctccaatgtaacgataaatatatagctaaactatatagtcgaactgtatagtttgattttatacagttcgactgtatatgtcaaatgcagaaataacttcattacccataacaaaaacgctacctttttaaaaagatagcgtttttatattacccttgcttattctttgccttcatttgctcttcataaacaaactttgcggtcataaaatcgttaggaaaatccctcaacgccttcttcatcacgttcaattcttcttgtgatttgatctctactccatttaagaaatcaaatgcttttgattgttcatccgcaacaaagttttgcgtcatataatcatcttgaaagtcttgcttcgctttttctttcactttgttcattgcatctgttttatttatacttttcacaggatttgcgaatgcgcctgtaggctgttcttgtttaggctcttctttcgtttccggctgtggagctggttgttgcttcggttgttcttgttgaactggctgttgcactactggttgctcttttttcgctaattcatcttttaacctcttaacttgtgcatccagagatttattttcagtttctaatacactcttatcactttttaacttttgcatttcttcaaaatgctcatctactaatgtattgtattctttctcagtgtacattttttcactagttgatgtcgtttttcccttcgtaataactacattaataattacaagtaacactataattcctattaacgcagcaacaatcttctttttgttcattattaatcctccaaaatgtaaaattaccaaggtcatcataacagatgctagcatgttcttttgtcgcattacgtcgaattaaaacaaaataggataagtccttttctatttttcataaaaacactctaaacaaatattgaaaatagctctgtttatttccgtaaatttgcaagcgcatttcatagatgatattgattatcattttcattaaaatagtgatataatgatttcatcaaatataaggaggtaacaacagtaagtgaaaacataagcaaacgtgaacaacgctctttatcacgtaaatttgaaaatataaaaaagcgaggtgaataatctgttactaacaaaagagcaaatatagatataaatatgcttagggtgcagcagattgtatatttgtctatatttttagtagcagaaaattatgattacatcttttatccctaagaatgtatgtatcttttctactatcctattttctatattcttttcatcactatcatcacaacaagcaatggcagcagaagatccagaaactccagtaacaataatgaatcccgatgaaccttccaaacccgaaaactatattcaaagtaaagattcattatatgaagaatcaggaggcctttatacagaagaggacctcaaaaacgccatacctaaagataaaacaaaaacaccagacaactccatcaaattaaatccatcatttgagaaaccacctatgaaagaaaaagataaaaagcaacaatttgcaccaccaacttatcccagcaatgatcctgttcctactaaatcaatagtcccaaaaactacaggaaagctatattttcgcgagacccctaattctaaaacgtcggtatgctctgcatctgtagttacttctaatgaagataacgcaatattaacagcaggtcactgtgttcacgatggcgctaaaggttcctggtatacggactttttatttgttccagcgtactttaatggtgaacgaccatatggtagttggatatgggaaaaagtccatgcaccatatggctggacaaattcaggtaaatatgattatgacaaagccattataagaatgagaccaaataatagcggtaccaaaattgcgaattatctagggtcaaatggttggatgactaacgctagtcaatatcagacagatgtgcggataacaggatatccatctgatgccccttatgatggccaacttccttattcatgttatggtgacacttttaaagatggccttttttcaaacgatgcatatatgaattgcgggatgacaaaaggttctagtggcggtgcatggtttgatagagtgtctagtgaatctcttggttatatatttgctgccacatcaagaagctcagcttctggtacgaaaagactttacgctgtccccttaggtgatgaatttactaacatgctaaacgctgattaattttacgattccttcaagagaattacatgaaaaaagtgaaactttaatcagtgcggaataaattatataatttgttaaatctctttttcagcaattaaaaaaagcatctgaaacagatgctttttctcattctcactacataaacgtaatcgtcactaaagaatacccttctttcgcattatacggctccgctttataagaaacacggcttgccccttgcggataaccgatttccccaattgcttttttcacatcttgcaatgcgccatccattgattgtttataaaggatttcgatctttggtgacttttcgttataacgttgctgcattttattttttaattcgttatagttatttgcgatgtattcatttcctaaatagtttaactttgtatcttttaatatttgctgataggcagggattttcataccacctgcagcaattttatttgttaatgtactataataatttgttgtagcttgcggatagtcccctcggttccactcatgatttcttgcgatttgctcatctgataagttgaaataggaatatgttactcggccttgttcatctggcacaggatcatcgaatgttgtatcaaggtgataccatttgttttcgattttcactaagttccaagcatgaggctgaccgtctccagttcctactacaaaatgattctcaattcccgcttcttttaataattgataagttaatagtgcgtaaccttggcaaaccgcagaacgatttacgagtgcttcatatgctgtgtaagctttataagacgtatcataagaaacatgttttacgacataatcatgaatcgctttcactttttcgtgatcatccatcccaacttgtgtaatagaagaaacaattgccttcgcttgcttcattacatattctgtttgttctttcgtttcacgatatgtaatttttagcgtaaacgtataatttccaggtgatccagaaagtccatatgaaacattcgatctattattatttgtatactcatttttacttgccacttctttataggcgttaaaaagtgtattcatcacttcttttgtattactatttgtcgttttatatggaagtgtaatattcgtttcgtacgcattaatacgcttctgcacttcatctttgaatgctgctaatagtgctgcatctcctgtattttgcaccgcaaccgcaggctttttatactgcaaagcattatataaaaactgtgcatattgttcacgcgttaccgttttagcgggttcaaatttcccgtcgcctgtaccagatgcaatcccgtttgactgcaccgcactaattgccccttctgcccaaaaaccattcggaacatcattaaatgtatgcttttgcttagccgaaacttgaaaagcgtttttaataatttgcgccatttctgcacggctaacagaatctttcggtctaaaacctccgtttccatccccgttaaaaatccctaatttcgttaacgttaaaacctcttctggaaacaatgtggatcctgagcgaatatctcgatacggattatttaaagtagatccatcttgtaatacgtaacgagcaccatcattactaaacgtaccaccttgcttattcggtaacaacgcacgataaattaaagctgcaacttgctctctcgtcgcaacatcaccgaaaccaaacttcccatttccataaccagaaataatatttttacccgctaaatctttaattgctggatacgaccaatgcgatgtaggcacatcggaaaaaatacccgcctcagcagctctcacatcactgccgtttgtatacagtaaagcaccaccaataagtgataatgatgtaattgattttagtagttttgtgtacataattccttctcccaatatcgtttctatttatgttattttttgtcgaaaaatctaaaagaatatgacaaaacatattatactattaaaattttttgaaggatatattaggttttgaaatatgcaaaaattcatattgttatagggattcatggtgatattatgttgttttacttgtggatatataaatagtaactcgttataactccctcatgataatctctaatttagtattgaaatcctctaaatctcaatgtattatatttttgtattttctcagtttcccaagccgagaaaacatcatcacttctaaaaggacccgaacttcagggggtcctttcttttattcctcatttttataaacgtatttatcgttttatctagtacaatactaagagactctcgcgtttgctttcgtgccatatcatcacttatttcattatacaagctacagccttttctaatttctgtggagcgatgtattgccttactaaccctaaaccaatcgtagcatttattaaattatctattattataatctaatttacaaaacatgaattccttcgaataaaactcaatattatgtccataatgttgataggctgtatgccaaaacccatttagttttctctgtatctccttgtattgagcagttagcctttgctagctgctcttttatttgtaaccttgttagacaagttttcatataatgtagtcattcctttcttataaattaagctcgtcacttgaattataaaaatgggattatatcctataacattttcaggaattatccatattttatttctgaaaaagtgctttattttgctgaaaggtggttgcggaaacaaccgtctttttatttatggcaaaatgagatttctattccgatctattacaaagtatgttattactggtaccatccggtataataaatacagatcaaatattgaaaggaaatatgacaatgaaaagatatttgaacttcatttcacttttcttaactgtacttgtaataattaatcttacaaatatacatacgaagtatcaattctttataggtgcatctatagcaatatgtttaactattatttctacaaatgaaattataaaattccttgctactagtagcttattagtttatggatttgccgcttttacttatttaagtattgcttgctaactttcaatttcgttttgtattaaaataacatttttatttaacttcatcacgttaagttatatagaaaactatatataattgaatattaaaaatgttatttcgattctaatatagaggcacatacgacttttttctttgtttatggagttcttacataatagtaaggaccttttttatttcaaacacaatttgttcatttttttgatacatttatgaaacattcatgtgttaccttcagtacgttctattctttttataatgtcgtgtgagatataccaaaacgtgaaaccctagaccccctaaacctagggcgattttatttaattactagttttcatcaacccgagagcttagtaattacctcttcaggctcaactctctcccttttgaggattgaaccctttttttataatattatccccatacttcctacttatttgtacaaaatcctacttcaacctctcccaaaaactttaatatcacataaaacttacgtaaagattgctataattcaattaatccctcaataaacgttatataataaaattgaaaatatccagtttgcatacaattgtctttctgtatgacatataactcttttgctaagagaaatcctagcttttttatagagaatcagtttaaaaatcaaaaataaaagaacctcaataaatgaggttcaaaaaatctactattttaaattaccttcgtaaaaagcaactccattttgaacatgctttaaataccatgtaatcgtcccgccacaaacattttcattaaaactattagcatatactccatttgagtaataaagagttcttttaaatttaccattagaatactcataaggaattgagcatgctgcttgcttcggagaactcacagctttttgcgtatcagctgaagccgctccaattcctcctgttaatgcaataccagttgccaatagccctactactaatttcttaaacataataaatccccctttaatagtttttatagcttacaacttaaatgtatcacttttgtaacttatgtaaatatcttgaatatgtagaaatatttatttgatttttagtaatattaggattccattttatcaaatgaaaaatagaggaatttagagaagtatgtaacagtgcataataaagtgaaactttaatcagcggggggttctttatcctccactgattattagttgaaccaatcggacttttatggacagttgatcccccacctaacttctttgctttcgctggaggatttgctttattagttgtattatttattctattaatcattatcggatgcagttgtttctgctaaaaaactattagaaaaggtacctatatgggtaccttttctttatatgccttattcattatctagttccaaatttttatcacgattgaatttgttttttcatttttcgtattcatcatacctgaaataagaatcgatttcagacatgtgtttttaacgaaaagaattggggaccattttttcccacaaaggaaatacctttttgaaaatctctaccatggaaggatcaaattgtgtaccagatccttctataatacgtctatacgcttcttcaggagatagagccgaacgatatgctcttgaagaagtcattgcatcgaatgcatctgctatcgcaacaattcttgcgcataatggtatttgatttccttttagttttttgggatagccctttccatcccatctttcatgatgagaaagaattatgtcttcattaccttttattaaagatatatttttaaaaacttctaatcctaattgtgggtgtgtcttaataatattatattcttcttctgtaagagaagatgctttctttaaaacttcatcaggaatacctattttccctatatcatgtaataaacagataaggtgaaattgttttaaataattatcatcatattcatttgtttctttagcaagaatcgtagcataattggctacacgttcactatgtcctttcgtatattgatcctttaattccattatcctcattatcgataaagctgtttctttcatttgtttttcataggatgctttaattttttgtactaaaaattttaatgaaagaaatacaaaaaatgacgtaacaaaaattgttagaaacaataatattaatgatattggatagttaatttcaaaataataaatagcaattaaaaatctacatatcatacagatagataccgatagaagataataaatacttaaaaataaaggtgcagaaattactaggaagcactctaaatatgggatatgtaaagacgaacctggatcacttataaacataagatcatatgccaaaagataaataatactaacaccaagaaaaatatattttgtaaacatttgtttattcattttttgtaaacacttattacataaaaaaaatgaaatgaaaataaataaaaatacgagttcaaataaaagcttctctagtgtaaaatcctttccaagaataaaatgttgataaatattatcaaacaaaagagtactacagggaataaatagaaacatgtttatcggttctttcgtttcaatatttttaatccctttcatcattttacacaccgccaaaccttttttaataaaaaagaagttcatatagatattattaataatatctaagaatagataatagtgcaaaaaacaccctttctcataacctataaatggggtactgccatgataggaatgtataaagagatggatagggttatagaaaaagaaaaaggcgaattccttttgaagtttggaattcgcctttttcttgctaccgatgatagggcgttatgttaatcaagcatgaataagtattcctcacaaaaaatccaaatctttgattatcattttaaataacccccgttgtttttttaccctttgctaaggtctcgccctacagctttttattacacggttcacttcactacaatctccctctatttcatcacactcaagtgactttctccgcataaacacatggactcaacaaatcacttctaaaatttataaaaagaaaagatcttttatatacttattaagatttatattttttgactgtacaaggaatagttacaatgtataaatctatagcatagattgtaacccaaatacctttaccttcagccgctagcttttcattcaattgtgataaatgctctgacacttttcttttaccccattttctaggaaaccattgaaaaaccttaggaacattatgtttcttgttataccatacattcaatctccaaaaactaaagataacatcattttctctttaaatgtagcatctgctccaaaccaaagggctaataaactaagaggaacagcaataagaccaaaaataattaaaattttcctaaatacctgtaatgaaagcaaaaacacttcctctttaataaatacaacaatttaacctttctctacgccaaactttatttctaaaccaataccaaagccgacacttaattcattttttaatccaaatttagcctatccatctcatttgaagatttaaaaactcttcaagaatcctattatatcgcttattagattcagaaaccgtatttctaaattaatatggtcataataaaaaaagagggtgcccacacagctccctcttttttcaggtaattaaatatgctctccatgatccataaacacttgaatagattcactttgtggtacgtcttttacattagtaagaccaaaagtaaaaacagcggataacatcatcattaataagattgcttttttcattttagcgcccttctttctatgctctttttgtctgcatctaaagcaatgtgtaaatacttgctggctttttcgtgattttctgaaccatagaatatattacctaatagataagcatattcttttacccaatcatatcagctcttctttactatctaataaaatctaattaacacgaaaatcacgtatatttcttgggggtaaatcagtttacttgttgtttactagttcccttataaatatccaataatcagggtaaattcagacctgaacctaaatagtcagatttatttaagttttctgtatataattcgatgtaatgtggtatatttatagtaaactaaattgaaaagggtgaattgatgattaaatttatttattctattgcctttgctctcatattatttttcgcaatgcgaagtacacttataccttatatagcatcaaatgaaagtatcattgcaattttggttatttttacattaatcattattaataactgggttatggatttaatagatacaataaataacaaaaagaaaaccgaactagataaatagtctagttcggttttctttttattatttaacaaatttttgtactttagtatcagaatacaatcgcgtaccaccctcactttttgtaacagttacagattttacatactcatttaccgcatcaaaatccctgtaattatcagtataatatctataaagcgaaggttgattgaagtacattagaccgcctgcaactgctttagctatagcgggataaagtttaccaggaagataaccggagaatgcacccgttaaaattaaagcaacattgtaactatccctatttattctattactagactctctggaaccaacatatttccaattgaaacttccatccgctattactaatccttgagaactagagggtttcgcttctgtaccagatacttgtctatctacaacatttcctttttcatcataaacaacactttcactgtagacaacattatcttctagattttgagcagcgataatagtaggaattgcctgtgagaagttttctgatgtagtagtatcatgattagtagtaagagggcttgtttgtgagtttgatttctccactgtttgtgaatcagcatgtgcgtaagaatatagtggacttaatcataaaaccgaagctaatgcagttgtcgcaagtttctttttcataatttagaccatcctttttatgtaatttataccataaaaatttcaaaaatatggtataaattacataaaaccgcgcagaaatctacatatcaataaagaaaattgacaaaattcagaaaaaataattaattcattttggataacaacttctctattccattattttttataagcatcttgtttttttaggatataagggttccatagtgggattaatcatagatatgtatctgaacataaaaaccctatccaatggtagactttaacatttcaaaaggtacaccttatgaaacaatctctccatctcttccaaagcacttcataaggtgtaccaccataattttgaagcccaaaatacaattaaacaacgtgaattccatatttatatgagaactcacgttacttcttttaaaatccttatctcattatttataaacatacatatctttacggagaaaacatctagcgaaattatatatatcaatcaactacagaaaaacccctccaccttaaggcagaggggactctccaattcctatttcaaactacccgcaatctccgtaaagataaccccaagcgcatgtgcacctgcatctggatatcctaaacttctttcacctactgtaccggcgcggcccatgcgagctacgatttcttttgtgtactctgctcctttgaccgctgcttctgctcctttttcaaaggcagttttcatgtcttcttcgcttgaagcgctagctaaccaagagtctacacatggagcaagtgcgtcaacaagtgttttgtcaccaactaccgctcctctgccgaatgatctttccccgatcgattgtatgccttgcagtgctgcttgtaacatttcagcgaactctttcactgttaattcacgtttttcgcctgctgctttactagctgcgcggaatgcaccgccccaaattggaccagatgcgccgccgcaatgttccataataatcatggaacaaccgtcaaggaatgatccgatcgttacgttttcttgttctacaatcgaatgccactcacgttttaattgcttaaatccttttgctacactcattccgaagtctccatcaccagcatgcgtgtctagctcacagaacggtacttcatttttaataataatatcgctcattttatcaacgagataaatcatgttgtttaatgtaatgacattctctttaatcacagcgtgctcttccgccgtttctagttcaaaggagacttccttctcttctgcctcttcaagtacatttacatactcaacactttcaactggcccgtctactttaaacgctggtgtattacattctttcgatagtaatgtttttagctcatcatctaacttcattaccgttaaagacatacctgccatatcaatactcgtcatatagttaccgacgaatactctattaattttaatgtttctagcagctagttctctcgtcactgcgttgttaaataagtaaagttcttgcagtggtgttccgccaaaaccgttaactagcagtgcaatttcctcgccatcttttactcctaaatctttcattaaatcatttgtcatacggttcgctaattcatcagccgacagcattttttcacgcttaattcctggttcgccgtgaatacctacgccgtattccatttcatcttccgcaagtgtgaaagtaggtgatccgctcgctggaactgtacaagatgttaacgctaaaccgattgtacgcacgttagcagctgctttttccgctacagctttcaccgctcctaaatccatacctgcttccgctgctgcaccggcaattttatggactaaaataacgcccgcaacgccgcggcgtcctactgtgtatagactatcttctaccgcaatatcatcgtccacttttacatagtcgacttcaattccatcttccgtcgctaaatgcgcaccgtttttgaaattcataatatcgccgctgtaatttttaataattaataacgtaccttttttactagctgtctctttaatcgcttggtatacctgaatttgtgaaggcgaagcaaacacatctccgcacactgccgcatctaacattccttttccgactaatcctgcatgcgctggctcatgaccactaccgccgccactaattaatgttactttattttcgttcatttctttcttcttaatgactttatattttttcaaaagctcaagctctggatgagccataaccattccgttacacatttccattactaatgtttctggtttgtttataatctttttcattgtgcttctccctcaattcctttaatatattgtgatatatttgaaatcttcttcttactatccatgttaaaatgaaagcgttttatagtaaacggacaaaatggacaatctgtctaaagacaccgctctcatttatgggtaggattttcatattactaacattctagggatgattcacatgacctcttctataatttctaaaaagataatcgcgaattcattgaagtatttaatggaaacagagtcgtttcataaaatatcagtgagcgatattatgttacactgtcaaatgcgtaggcaaactttttattatcattttaaagataaatttgaactattaagctggatttatagagaagaaacgaaagaaaacattatcgactttctcgactatgaaacatgggaaaatattttcgatttattatttgattacttttatgaaaatcaaaaattttaccgaaacgcttttaaagtcattgagcaaaactcgtttaatcactatttatttgagcatacgaaaaacttatacatgaaaattattgatgaactatctgtgagctgcggattcagcctttctgatgagacaaaaaatacgattgcctccttttatagtcacggcttcgttggaacgataaaagattggattgaaagcaaatgcgaagtagatccttccattatgtcttctctcatgaaaaatatgataaacaatcaattactactattactggagcaatcagcaaagtaattaaagggtggcaaaagcaatgaaaaagattatgaatgatgtacaaaatatcgttcaagatatgctgcatggcttttattttgaacataacgacaaagtaaattatgacgaaacaaataacatcatttatgtaaaagatatcgaaaaaatgaagcaaggcgttgtcattataagcggaggtggtagcggacacgaaccagctgatattggttatgtaggaaaaggtatgcttacggcggcagtaaacggcagtattttcaatccgcctacagtggaacaaattgtggcggcaactcgcctcataccgaaggagaaaagcattttattcatcattaaaaactttaaagatgatgttcagaactttttagcggcaaagcaaatcgctaaagaagaaggaagacgaattgaccatatcatcgtaaatgacgacgtttcaattgaagatgatgcttcttttaataaaagaagacgcggcgtttctggtactgttttcgttcaaaaaatattaggtgcggccgctcttgaaggtcattctttagaagaattgactgcactcggccgttctatcactgaaaacttacacacattaggagtcgccctttcacctgcaaacgatccagtgaaaggtaaagcttcattcacattaaacgaagatgaagtcttttacggcgtcggcattcacggcgaaaaaggttaccgtaaagaagcactatcctcttctgaaatattagcgattgaactaatgaacaaacttaaaagcatttatcgctggagaaaaggcgacaacttcgccatcctcattaatggactcggcaccactccattaatggaacaatacattttcgcaaatgatattcgccgtttatgtgagctagaaggattacaagttacattcgtaaaggtcggtacactgttaacttctttagatatgaaaggtgtttcactcagtttgcttaaggtagaagatttggattgggtgaagtggttgaaagaaaatacggaaactgctagttggtaatacaaataggatggtttcaattggccatcctatttttgtacgtaattcagctatgagaaaaattcaattactgaagaattctgcactcaatattacagcaaatttacattaaaaatgtaaatcctcatttccttcgtattttcctttattaagcctttttcttatgaataattctgcaacaattaaattaggtacccacgctaaccaagcaataatagcataactaagttcaaaatgttctattccaaatagaacgataaacaacggtagccaaattcttaatgtaactgccgcaaaggttaaagagtaatttctgatcatccaatttcgatggtctttcatttttttattcttaactctatgtaacgcttgatatgctgatgttaaccaaaatacggataacaaaccgaaacctagctttgctaccaatcctcccgtagcataaaaggacaggtacagtccagaaatgcctcctaataatataccaaccatatagattctcccagctattcgatgacggttgatattcctttctctaaatttagtggataatgtaaacggaccaattactaatgctactatactcgttgtaatatgcgtcaataacatactataccagaactcacttaatttagatccaaacataagcttcgcttttacaagccctgtttgaaatccatccataataaaatattggacaacaatataaccagatactaaaagagcaaaacaagtaaatacaaaccaaattttcctgttcaaatttcactgcctccctattacattcatgaaaattagattatacgttactgttcattcttgtaaaaaaatagaaaatccttctagacaaatgaaatacctccgaaaaagagacatgtaatagattaagatttcaaaaataatgaatatatatgttatattgttaaaggtactgaaatgggggggctaatggatatgttgcaacaagtaatagatacatttaaaatgagcaaactttttatataataaaaaaacctcaagtatatcattctatacttgagagtttactcatctattcctccgcatccctcatactgtaataccccaaattaataataatcaagaaatacccacccataattccagcagcaaatgtccacatgtactcacgatgttcaatttcatacataataatcgcgccgagaattgcggctgcgaaccggttcatcattccgagcatcggtgctttttctttttttacaatgctatttccaaatttttcgatacgtcttcctaaaatccaggcgcagtacatactaactaaaaggccaatgcttatccctacaaactgggctcgaaaaggtgtaatcgcccatcccaataacatcacgcctagcaaacaatatatttgtattttgaatgatcttaatgccatacgaatcatgttatactccttacctttctcgttagtcccatctttcggacttcaaactttcagatatatcttttttaaaatgagggaatttgattttactcaccattaaatacgcgagtacgcatgtaccaaatgccacggaaactggattattcaaaaagcataaaatgaggagacacatggctgcgaatggaattgacattccgatgaatgtcgggagtttgctttgttgtgtattaaatctcgcaagccgcagcattccgcaaatactgtaagcgagcgcacatatcatcccaatagactgcaaatcttttagcgcaacactataggcaaaaatagacggtgccacgccaaacgtaactaaatccgcaaatgagtctaactctccgccaatttccgaaaaagcatctagtttccgagcaaccatgccatcaaacaaatcaaataccatacctgtaataatgaatataactgcaccatacatatcgtgaacgaaaacagcgtgaatagcgagaagtccacatacaaagtttgctatcgtaatcatatttggtatgtaactcatcacatgcttcccctcctttttactcattacctcatctaagttcttactcattacaatcaagatccttctgtttttcttccaatataactttatttattttctttaacgtatccgtcatttgttctaaagcaccgatatcgattttagaaaaatacttctcaattaatacatcatctaactcagacaactcctccatatacttactaccgtttggaccaagtgtaaggaaatactcccttttattattaggatttacttgctttgaaatcatcttctgcttttccaatttcgataaaacttggctcacagcacttttcgatatattaaaagtagtcgcaatgtgatttgctgtcgtgttttcatttaaatgaatatgaaatagcatactctcttgctgtcctgtaagaccgtactcatctttcaactcctggaatagtaaaatgtaaaattcattataggctctgttcatttcattaattatttctttatatgttctcgtcatagcactcttcctccatgctgttattttgtttcgtttaatagttaagtttacttaacttaactatattataccgttatgtttgtgtaaagggaaatcaatttccatactttaaaaaagaagacatccattaagatgtctccttctcatacgtaaagctctaaactttcactattcttctcaattacatctttatacaagcaaaagtgtttctctcacctcaacttatatattagacaatatataagttttatgttgtaaactactaaccgttaattaactgttgcttaaattcatctaaaactctctttctctcttcataatcttccgtatcggcttcttcccaaagctcaaggtcagccccacgttcaattaatgcaattgccttgttacgaacttcttcttgaagacagcctttctccaattgtattgccgcaagaccaatatatactaaagatatttcttctaactcttcctctatatcaaactcatctacatactcttctaaaatgaacttagttgcttcttccgcactattaccctcttctatatactcaataaattgatctttcacatcacaagtcgtgtcatcatcaaataatccagttccccaagcgcccatatgctacagctccttctttgtgcttttttcatttctatttcaatcttaaatataataaaaattcattacaagactagttatatacatcgttatattttacaattactataggcaataaacatctttcactacatgtaccattctgaataatcaaacataaccatcgataaaattccatatagacccagtaatggttaaaatgttataatgaaatcaccctacatagttactcatatttaacttgaggaactagcgtcttattaagcaatgcgcataaatcaaataaaaaagacactttttacagtgtcttttttatttatattctaaggatttatctcttttagacacaaaatctattacatgataaaggagactatcatatggagcatcctctagcaagagaactacgtaacatacgtatatgtcttattatcttgatcattgtcattgcattttgggatcgtgacaaacctgtggaaatcactgatcatgatagtgaccctatcttaaacactagcaatatgacccaaattggcgatcatacatttgcctataaagatgaatctaatcaaattaaaatatttaagtttaacccagatacaaatgaaataaagctaataaaagaattttatgctaatgaatattaattacatacaatacataattcaaattgctagaaaacacctgatgttttatttttcttataaactaaaacctacgcgaactcaagcctttagtcataattacgactaaaggcttttttctataaaaaattaaaacatagtaaaaacgacatacttactcaaattgtttttcaccttattaattatatccaaaaagttggatagcttcttttactactcatgttattaatgaataaagcaataactacaataacaagggaaccaactaaaactggtgttactaaataactccaactgtatgctcctaaaataacgacaattggatcagcccctgccggaggatgcgttgttctcgttaacatcataacggctattgccatccccactgctaaagctatcgtccaatattcattcccaaacaaatgatatattgataggccaatgaaagttgaaatcaaatgtcctccaataatattacgtggctgtgataacggtgcattccaaactccaaacgctaatacacaactcgccccaaatggagccattaacaattctgtagaagttatactcgttaaatatgttaaggtgagaattgttaaaaatccccctaatagtcccgtcaaagagtcctttatgtttacttgtaacggacttcttcctttccctttcatttttgcaaaatatcgtacacttattggtggagcctctttctgcttagctgctgttatatgattcatcattctcctcctttatttaccaataattatatttcaaacaaactaaccggtcaatattaattttagaggttagtttaaaaatacataaaaaaagatcaactgctataagttgatcccctaaacttcttcacattttcgatcctggaattttgctaccttttttcggttcccacatattttcatagaacaccattttcgtttcccacttttatctataaataataaaacacagtcgggatttgaacaccttttaaggaaaataagtttattttctgctactaaggttaaagcatcaaatgcaattatcgatacaagtacatcctcaacttctccaactgggacaggtactagactctgttcaatgactttatatgtaaatggtgccttctcaatttgtttttccaaatacgtaataaaattattagaaatttcgtgctgatcagcaattgtctcaaactgttttctcagtacttctcttgcctctaatatgctagatgtaacttgatccattcgttcttgaattcctataagtgttttttcattccaaaaaggaagattaacctttattacatgtagccattccaatacatctttatccgttattaataaatcataacgttgtccacgcctaactagctctgtattcactaaatctaatgagagatttccacatataagcgggaattgttttgtttcctgcatgtactcatcacctactctttaaataatcatattccaaattcatacagaagtacaacttttttataaaatacacagtatgaagatccaagcctttagccataattacgactaaaggcttttttctatataactaaaaaggagctaactgtatggaacataataaaaatggaatgcttgctttaatcgttttatttgtaggactcgcattttttgttttcggtatggtttatcatttatggggaacggtttaaaagtaagtagcaattcatttagatgcaccagaaatcatttatctaattatgaaaccccttatactgcttcaggggtttccaccttaatacaattataaagaaaggtactatcactcaggcgctcaaaaaataatataagtcaatgaattaaaacaaataacagacaactaaaatatatacgataaaaattgtataattcatatatatgcaatattacatagaaaaatttcattattacatgctatactaaaataggagtcgacaatcgttattttcttcttagttttaaagcaatatggatatataccttcttatcgcatttggattgtacaagcaaaagaagacatcttactagatgtcttcttttcttatatttttatgaattcctttgagcagatgctctccaagcacgaaaagatgttgggtgtccagaatgagctctttgctttgcagcagcaacagctggtttttcttcaatagtctttggtttttcttccacaatcaatgatttttcttcaagagtattcacagctgtttgcattttttccagctgttcttttaaagcttgctgttcaatctttaaatctgtaagtaaacgtaaaatcatttcagaattagccataaagatcctccttcccccaatacacagaataaaatagaatatgtcatcagcggaataacggtgacaaaaataaggtcgtcaactctcttaaaatctaagcacctttatttttcaaaaggacctgctcaagattatccgtaaaaacataaagtgaattaaatccattaattaatggtctttatggaaggaggagttaatatgggctatggcggtagttgtggtggaggctgcggtttcggcggcggtttcgctttacttgttgtactgtttattttattaatcatcgttggcgctagctgttggggcggcggattcggctgctaaggggaggcactcttgagagtgtctttttttttatgtttttggatgtacagcccataccttctgtggaatgtggaacagatagataagaatctttcgtatttttccgcctaaataatgcaactcgatataattgataattctaaaaattaaccctgttgatatggttaatttttctatatttgttataattattttatataaataaattggaggtgaataaataatgatactattattacctatactgttattattcttattaataatccttgttaaaatttctaaaatggtgagtagaaccgtagctgttttagttgattttttatttttaggaggattcgctgcttattcattacataagtctgtatcggtaacaatagcaagtggatacgccatttatttttgggatattttatttttcatcgtttcctgtgttctatattacattgttttaaattatctagttattaactttcctagactagccgcattaattaattacattattgcttggattggaacatttttagtgtatgccacaatctgtattatcttgataggaaatttaccgcagttattaaataataagtttttcagtgagcttactaatattattattatttctatacttgcaatcataacattcaatgttagaaaaactatgtttgccaacaaagagagaaatgaagaagtttattagtttatgattaactacatatcatagcgcgataataaaaaggcatactaaggtgccttttttatttatttgaattagattaatccataaccttcttatgtacttggaaatcctagtcattgagaataaacaagtagatagaatttcaccagataaggaagtatttctatttcttgtgtacttatcatttttattattagtgctattcccctcattacatgagatgcgtccctaaatgcacccccaataaacccgtaccaattctgttgtgcgcttcattttaaatctcctgtctttcctttatttcattctcatttacgctttcctcataacaagttttcttacaccttcttcagtacatgtaacattaaaattgacataacacttcatgcaccatatactgttaaaaacagtatactgtcattaacagtataaattttaattcattataggaggaagaaccatgaaacatacaggaagacatacaggtgcatttcttttgttatttttagctgagggcgataactacggcgggcaattactgcaaaagtgtgaggaagaacttcccgtcaatccaatcgatagtgccattttatatcgcacactaaaaaaattagaaaacgaaggtgcaattgaatcttacgtaagtacagatcatcaagacaaaccgagaaagatgtacaaaattacacctgctggaaaggaacaattggcacatttccaaatggatattgaagaaaaaatgaagaacttatcctttttcctgggcaaatataaagacttacaggaatccgatcatgattaacggcgtcatcctttacacttttgccattatccttactgggatttcttttatgaaggaccgcaggaaaacgaaagatgctctaatgaagtcatggaaaatgtttcgcaaccttctccctgcgatgctctccatcatgcttttcgttggcttatcgctttctatattaacgccgtctttcatctcttctattattggggagcaatctggattcatcggtattatttattcagcaatactcggatccattgcacttattccaagctttgttgtatttcctctcggtcatacgttagttcaacacggtgcaggcctacctcaagttgcggcacttatgtctacacttatgtcagtaggaattacaaccttgccgatggaacaaaaaatattcggacgaagctttgcttacgcacgtaatgcatctgctttgctcatgtctcttctattctcctatatcatttggatggtgatggtatgaaagaactaaaaagatatcgcttctttttcgtcttgctactcgggctctttatattaacttttataaatcaatctttaggatggcgtgcattacaactaacagggaatagcattttagatatgatgtttctcctcccccctgtcttactatttgtagggctacttgatcaatggatgaaaaaagaaacgctcatgaaatatatgggtgaaaaatcaggtatatacggaatcttattttctctattattaggaggcattgcagcgggtcccctctacgtcgccttcccaattgcagcactactattaaaaaaaggcgcaagcattcggtacatcgtatttttcttaggcgtttggacaactgcgaaattgccaattctcgtgtatgaattttcttcatttggagctacttttacactcattcatattggtttcggtctcgtatttttctatgtaatgggaattgtttttgagagattttatgatcaggggcagttattgcagtatgatattacagaggaaatgtaatcaaattgaccataaaataggaatatgatatattttcggtagagtactatataagtatgacatccactaaaatggcatataataaaagaagagatgcgctaacatctcttccctaactgctaccgtatagggtggtggttattatacgttattattttttgcgaaacccacccttttgcttcctacggcgcggagtggtttttttgttgtccttatctagaaaaatgcgctgaaacttcgcgcacagtcgctttgacaaactcttttacaagatcaaacaaaaacatattatcacctcctttccttccaaatagaaagaagggataaccacccaccctcacaatatgcagttgattttattttatcaaataattgtaaagatattatgtaaacacatgtaattagtaaagctttatatcgctaaaatatggtatacaaaaagaagttcccactctaaaggaacttctttttgtaccattacacaccaatcttcttcaaatccgaactttcaataaccgaatgcgaatatccatctttcccaattcgcaccatcgctcttcctaattgttctgaagttattacactgccaaacctcttcaatagtggattaaaaggtttcatcacatcgtacatcaattgatatgatttcatttttgatttcacaccatttgctgggatgattaatcctggtctaaacatatacgccgctttgaaaggtaaacgtaataactcattgtccgttcttcccttcactctcgcccacatcgtacgtcttgattcttcactgtcttttccgctactacatacgtaaatgaatgtaatctttggatttaactccgctaatgttttcacggcggataacattaaatcaatgaaataaaacgtcgataaatttaagttacaaatattcagaattaatattaaaataaacaatggggataggggtatgtgattataaaatttatacataacgagggaatagaaatgaaactacaattaaaagcggatttagggctactactagttacattcttttggggggcatccatcttacttacaaaggttggactcgaaggcatggaagaatacaatttaatcgcattacgatttattattgcctttcttttatcaggtttaatattttacaaacatttattcaaagtcgattttaaaactgtaaaatatgcatttatactcgcttctgtcttatttatcgtttacattttcgcgactttcggcacaaagtatacgagtgtttctaatgccgggttcttactctgtctcactgtcattttcattccgatattatcagctatatttttaaaacacattccggaaaagaaagttatagtaggaatcattttaacgataataggaatcggcttattaacattaacgagcgaattcagaatcggtaacggtgatatattttgcatactgtctgccttattttatgcgattcacgtcatcattaccggaagcgtaacaaaacatgtgaattccattgcacttggagtagtgcaacttggtttcgtcggcctatttagtcttattttttcattcattatcgaaacgccaaagcttcctagcacaatcaactcatggctcatcatcttagccttaagcatattttgcaccgcagtcgcattcatcgtgcaagtgattgcccagcaatacacaacgcctacacataccggacttatcttttcattagaacctgtcttttccgcaggctttgctttcgttttcacaggtgaaacacttacaggaaaaggatacttaggggcgacacttatattagtcagtgtgttgattgctgaggtggattttaagagtttattacgagttaattataaaaagaatgtagaatagataaaacatcccccgggaaaatattcgttactattattttcattcccttttaaatgagacttttttagatgctatcttcgaataagatagcatctaaaacatgttaaaaggaattattatatttatgtagcctgcatagttcactgtttctacattacttactgcacatagtcatacagatttttcgctaacaacaaacaagttacggtaatgaaaagggcgcgaacatacccgcttcctttttttatagcaaatctggagccggcgattcctccagcaatttgagcaactcccattataaaaccatacacatagtttacttgccctacatacataaacatcaacaatgcaccaacgttacttcctaaattaagaaacttcgccgtacctgctgcttttaaaaaatcatacccaataaataaaagagcaaacattaaaaatgaacctgtaccaggacctagaaatccatcataaaaaccaataataaaaataaaaaaggtaaaaataatgacgtgtcgaccagacaattttttatgagtggaaatacttccccaatcctttttgaatatcgtataaattgcgaccacaccgagcatgatcagcattaatggctttaatacttctggattcattaaatgaacggtccatgcccctattatggaacctatgaaagtgattggaaataatttaaacgccgatttcaaatcaagattaccagaacgataaaacacaatattactagttgcacttcccatcgtcgatgctagcttatttgtggctactgcacttgctggattcaatcctgtaaataataaagctgggtaaggcgatcaatccaccaccacctacaactgaatcaataaatgcagccacaaacccaaaaacaatcaaaatcattaatacagatgggtctaaataaaaatccatactagtagcctcccccttagtcactattgtaatagtaactatcaatttgctaaatgtaaagagttattgtaacgttgaaatataacagcaaacatcggaggacaaaaaagtggactacatagtgcaacagcttaaaaaatgggttttaatgaatatgaagctaaatcttatgtatctcttgttaaacaggggcctgtcacagcctaccaagtgagtaaagattcgggtgtccctagagcgcgaatttatgagattttaggtaaccttgtagaaaaaggaattgtcatgaaggaagaaataaatgacaccactcgctattcacccctacccgttgaaatctttttacagaaggctcaatcagaatggcagtctacttatgaaggaattagcgattcattaaaaaaactagaaacttccgaggaaaaaacggataatcgagtcattactttaaaagacaatcaaacaatcattagctactgtcaaacattaataaaaaaagcagaacgacgtattgtcatttcgatgtgggatgaaatgtatgaagcgttaaaagaggacctagctgaggtagctgataaagtcacagtacaaggcattaccttgtatgttgaaaatcctattaaaaatctagaagcccatcgtataacaacttatacagaaaccctctctacagggcattggtttattttatcaatagattctaaagaaatgatttatggcccatcacttgaagagcgtaatattgctttttatacagatgaccccgttcatatatacttattagaggattatgtatggcatgatgttttagtgaatcgacttgtccgacgtagccaagatgacttggagcaatggattactgcggagagacgatctttctttatggggaaataagaaacatattcaaaaaataaagcataagtgaatacagtggaaaacttatgctttattttatatgcaaagtaatactcaagtcttttcactatttcccctccacaaaccgaccaaactccttcataaaccgcagcttaaaactacccacaggcccattccgatgcttcgccacatgaatctccgtcatctctttctgcttcgtttccttatcgtaataatcttcgcgatacataagcataatgacatccgcatcttgctcaatttgtcctgtctctcttaaatcagataaaagagggcgcttatcttgacgcgactctactgaacgagacaattgcgataatgctactacacaaacatttaactcacgtgctaataacttaagtttacgagaaatctcactaatctcttgaaaacgattgcccttatgcttcggatcgcccgtaataagctgcaagtaatctacaataattaaaatctttttatcaccgtgcttcctctttaacttacgagtttgcatccaaatatcttgcaccgtaacccctgcattgtcgtaaatctcaagaggtaactcaccaatctccgcaaacgccttactcaccctttcccagtcttccatcgcaaaacgatgcttcggatttttcagcctacctcctgacacttcacctacgcaagaagctacccttttcaataattgcttactactcatctctaacgaaaacaacccaaccgccgcgccagacttcgccgcatgcagtccaacatttagcgcaaacgctgtcttccccatcgaaggacgagcaccgagaacgacaaaatctccttcctgcaatccgcacgtcattttatttagcgatgtataacccgtctcaataccagtaatctctttcgcatcttgatgaagctcttcatataaatcaactagcgcatccttcaaatcaaactcacatacacagtccttctcctctaactcacaaagtgccgtaatcgtctcaccaataattttctcactcttctctgcaataagacgctctcccatcttgtgcccaagaacacccgcctgatacattttccaggcacctcgaacaagcccctcataataagagaagttggcagttgtaggcacaccatccattaaccctataaaatactccattcccccgatccccttcaaaaacttcggatccactctagaagtgaacgtcacaagatcaatcggttgcccctcatcttccatctttcgcattaactgaaatatagacttatgtactggcatcgaaaaatactgctccgtcaaacggcactccttaataagctctccatcaagtaatagagagcctaacaccgtcttttccgcctccacattttgaatactcatggacgccacccgcgctccgctaaaaagcgctgtaactcttcctcagatggcgcattcttctcccactcctcacacctcgccaaaaactcctccgtctcccccgtactaacagacgaccccttcttccggaaattcacagcacccgcatcaacctcacacactttcgtaaaccctttcccgtaccaaccacgcaaaatccccttcacataagccatcttccgatttttattctcatacgaaatttgaagagccttcagcaccagctcctctgacaaatcattcatccatgcattcaattcctccaccgtaaaaggagacaaactaccaaaatgttgctcataaaacgtgaacaccttacttcccgtctcttcctgaacaacctcttcttcctctgcctcctcacaagccggctctacatcatccatagccaaatcaccaggcataccgaaatgcgctaacagcatcggaacattcagctcctcctctacgcacttctgaagaaacatatgtacaaactccttattcttcacacccttcagctcacgaagcacacacttctccacattcgtattcgtcactggattataacgaagccaattcaaaacgaataactcccgcgtatccgcatcataaagaatcttcccataatcaacaaagcgctgcacaagcttatcaacagtctcccgattataaccagtctccatctcagctaaccgcttcggaaaaggaaaaatcccacactgcgtcgtcttcgaacaagttaataggtaaacataaaaataccgctcctccggcgtcaaatccaaaacaaaatcatcctgccaaaaattcacctgcacagtacgatacaccgccatcctaattcctcccgtcctaattcaaaaatgaacatttcctctttgtactatatataggaaggagggctgggtttttggcgtgttatttcaaaaattttttcgactcctactacggtgtttgttggtgtttttgttttgttatgttttttcttagtgatttattacttggtaggggcttgtaaggggcttaggaggggctagttatcggttacttcgattaggaagattcgatttgagaaaccacctcgttcttctgctttctttttacggatgttgttgatttcttctagtgttgtgccttcgtgttcggctagggcgtttattagttctagtagatcggatagttcttcgagtttatgttcctttgttgttgcttctagatattcggttagttcttcttctgtttttttgcagatttcttttatgtattcttcttcgggtagaattcttgttgtgggtgtttttccgttggattttattatttgtgggattttgtttcggattagtttgttgtaggttggcatgggatttccctccgtttggttttcttctattataatggaaaagcagtttaactaggtgttaaactgcttcattgcttcttttatatagttttcttcttcggttgtgaagagggttgggaattcggatagtgggaggtttgattgattaattatgtcctctatattactttgaggaatatcaagggaatttgttatctcttctattacattgaaaaattccttcaaagtaacttgaacgtcttgatgacccggatctttctcttctaccttatactttttcaacttccctatcacatccataaatcgctgttcaaacttttcttttagttccttattattataaaacgctcgaacactatccgttgaaaagtgttcctctagccattccttattttctttctcccatataaaagtttgcaaaaacgaagaaaacaaagcgacatccactcgtttctccttttgaaacttcttcgtcatctcatccatatgcgaaagcaccttcgcaatcctttcttgctccgccaaaagcaattccctttgaaaatgcatttgtcttaaaaattcttccgtctctatatcacgctgcaatataatattttgaatttccccaagcgaaaaaccgagatgcttaaacgattgaatttgctgcaacacatacagatcatctttcgtatataaccgatgtcccccctcagtataatcgctcggctttaataaattaatcttgtcataataacgaagcgtccgcaccgtaacatccccaacacttgcaaactcactaatcatccacgccataccatcacctactccgataacttctctttcacatactgaatcatatgagaaaaattcatctcattctgccgataatattgaaacaaacctacaacaagtaataaaaaaggaacattccctctataacgattttcatactcactaataccatcataaaagtactcatactttctttttcgtaaaacaatataaatcgcaataaacaacactgcaatcataaccaaaagtcgctttccccttatctccacttcttgtttcatcacctattctccttcaccgcatacttatcttctttaaataacggaattcgaatgaaataacgatatggctcgtcgcgtattactttccacgcaacaaagatcacttgaacgacctcaaaaacaaatacgatccaaaacaaaacatcactaatacgcgaactaatattaaatagaagaaagattaacaaatgaaagttgaacgcctttcggcaatgatatttgtacacctcatttttccgtgccagcgtgatgtacatgagtagtggtgaaaagattcctattgcggctgagagtagtagcatgatgatggtgtttcttttttcttttgtggtggttttcatgagtggtttggtcccccctttttgatttgtcttctttaggttagggggtgacgttggggaaggtgcaagggggatatgtagaaaaaatccgatatcactaatatagaggtaaaataagacttttaccttgacagggtggaggtcgctggttcgaacccagtcgggatcatatgaaaaaccccttgataatcaaggggttttctttatgtagcggacctttgtcttttcttaaaaggtaaattctttgcttcttggtcaagatttggtcaataactctctttgggtcaacgattgcttttttactcattcacttcggcataaacttcattcatcatatcttccataataaagtttttgaattcctcattttctaaaatcttcataaagaatttttcgttactactcatacgatcaattacgaaatccatgaatgatttttcgaaagcgaatttaaaattgtcttttgtattatttttcgctttttgttgaatgtcttcattgtttaacatgtcttcttttacttggtcacgtgaaagaaaatcagtttccgtaaactctgtgccaaagcgctcatttaacttctctaaaatagatgataaacgaaccttctcatcttccactgcaccacctgtaccatgtgaagttggctttaaatttacgccacctgttttctctagttcaatgctgccttcaaacaccttctgattacgataatattgaagtgcaacatcatctgccatatatacgtctctatctttactactgcgcggtagcttacgtaatagatagtttaaataaatataaagcttgtgcaaatgaacatcaatgaacatcgcaatttgtaaaataaatgcatatgtacgtacgaacttcgttaccgatgctttaaacgcttctttttcttcctcatttaatcgcttaaagcgttctacacctttatcaatccatgcgttaagttcagtttgtgccttcgttgactttttgaatccaccttttatctccagctcatttacagcttgcacttcttcctctgtaaaaatttgatacggttctaattctgcttgtaagtcatataaaatgttcggatccgtcacttcttccaaacctgtcgtttcataataaggttggaacgaagctttaatatcttctgtatcattaacaaagtcgagtacaaacgtatcttctttccctgggcaagtacgattcaagcgggataatgtttgaactgccttaatcccgctaagcggcttatccacatacatcgtatgcagcaagggctcatcaaaacctgtttgatatttttcagccacaagtaacaccttatactcatccgaattgaacttatcaggtaattctttctcactaaatccattcatatctggctctgaataaggaatttcaccatctttgacaataccagagaaggcaacaaccgttttcaaatcatcatagcccattttatagatgtatctgtcaaaggcgatcttataacgtaccgcatgcaaacgacttgccgttacgaccatcgccttggcacgaccaccaattttatgacgagtaaagttacgataatgctcaataatgatttctgtcttttgggcaatattatgtgggtgtagggacacatattgagctagttttttggttgcttgtttttgcgaaactaatggatcgtcatcgacctgcttcgctattttataaaatgtcttatacgctgtgtaattacttaacacatctaaaataaagccttcttcaatggcttggcgcatcgtatattcatggaaggcatgcggcttgccatctgttcccatcgttccaaacttttcaagtgttttcggctttggtgttgccgtaaaggcaaaaaatgaaatattatcctgcttcccacttttcataattgtttcaacgatttgttcatctaagttatccatattttcttcagcaatacggtcttcctcataagcatcttccaatgttttatctgataaaatattcgttaatgcagtcgaggctttcccaccttgtgaggaatgtgcttcatcaataataaccgcatactttttgcggtcaaaatccgataccttctccataataaacggaaacttttgcagcgtcgtaataataattcgcgtctcacctctgatagccttagcgagctgattcgaatctttattaatacgctcaaccataccagctttatgctctagctgatacaccgcatcttgtaattgcttatctaaaacacgacgatctgtaatcactataacactactaaacaccgcattatttccttcatcatgcagctttgctaatcgatgagcaagccaagagatggagttcgtcttcccactccctgcactatgctgaatgagataattttgaccgactgatttcacttgtacatcttcttcaagcttacgcacaacatttaattgatgaaaacgtgggaaaatcaacatcttacgttcaccaatcgtttcaccattcgaatctaaaatatcatccttcttcacaaagacaaaacgaaataaaatatctagcaaactatcggaaactaacatctcttcccataaataatgcgtgcggtagttattataaacagttggattccctttcccaccgttatttcctttattaaatggcaagaaatatgttttttcctttttcaattcggttgtcataaacacttcatctggatcaacagcaaaatacacaacaacacgctcattgaatttaaacagctgctcttttggatctcgatcccttttcagctgcttcatcgcatgctcaaccgtttggcttgtcaatggatttttcagttccatcacaacaagcggtaagccattaacaaataataccatatccaaactattattatgcttatcgctataatacacttggcggctcactgtgaatctatttttgcgatacaactcattcattaactgattcatcgtagttggtggcttgttgtaaatcagcttcagcgttacaccacggtctttaatcccgtggcgtaaacaataaatcaagccttgctttttcagttgatcacaaatacgattgagcaccttctgcttataatccgaaccatacgacttctctagcgctctaagtaactttgcttgtgtatcctctaaaaatgtaaataactcctcaacatcaagcgcatattgcttaaataaacgacttgcctcgccttcaagcgtacgtttcgtatacccgttcgctatgaaggaatcttcaatattcgtctcaaatcctttttccgtcgcatcaatcgccataccatcacctcattacaattctacttcaaaatcacgtacatcaatcttccccgtcaccgcctcgtaaattagggattggcggtagtcttttaagttttgaatttgaacttttatcatatcaattgcttcatttatctcaatttctttcacagaaagatatttactaattgcaaattgttcatcaattggtggttctgggataggaaaacccttaaatacatccgtttgtaatctccatctacctaagtgtgacactccttgtccatgtccgtaaaaaatctttgcaaaataacacatttggaaatatcgtaaatagtaatcatgacattcctcaggataccttaagcggaatactcgataatctggactggttaccccttcaaatttagcacaatctacgtaacctgtgagtaaatccattccattcatcacatagtcatcaatttcaaccctctggtatttctcataagattcagcatgttgaccagaaaaatcatttaagtccttaactttaagacctttttgggttaaagaaagtacggttggtgcttcagtcggctgaataacttttctaatatcaaacttatattttattttcttaatgttccagctttcaggtatctcaccaatccactccacacttgaatctttcattttcacatttggatttaatccttttgttacagcttctataatcattgattgacgtttttcttcaagaagactaatcatttgttctttttgagttattaaaccatcaatttcatgaactttattatctaaaaataaaacaatttgtttttgttcagaatacgaaggaagtaaaacctgtaaacttgataatttactcgccttaatacccgcagcagtggatcctgtagcaaacgttctcaaattcgactgaaatccgtgcgattgaatccaatacttaaggtaatagttatctaatacattttctattcctcgaaacttgattatccgctgagctaatgcaatatctattctatctacattagctacttcccccaaaggtgcctcagttgtaaaaagaacatctcctatttcaggtaagcctctcctcataacctcttcatattcttctatttttacgaattcttgggaaagagaataatcaatttgaccatgctttatattcttagcggtaactaaaaaaatcccttcttcaactttctcaggagtcttacctcgataatccacaatactatctagatacttagttaaacctccatattcccattcagaaggaatattttctaaccattctaaatttgtctttttatattgaggatataccatcatcccatcaccttcttcaacttctccaaaatacttgcctcaagctccttaatttcctccataatttccgctgaactacgaagggctgtgtatttatagaactgacgagtgaacgggatttcataacctacttttgtttttgattcatcaatccacgcatctaaaacatgcggtattacttcacgtttgaagtattcgtaaatctcctctttcaatggtacattctccgtatcacgtaagtctgtatccggctcggcatctgttttatttttcatacaaatatgagctgtttcatccttttcagaaagacccgctaaaatcgcttttaacactggcgcaccaattgttatgtcctcttttttaaatgcatcctttaataacttcgtaaactcgtcacgattcttaaatagttgctcgctttctaagctacgtaacacttccatgatttttgcctgcattgccttcccaacttctatttcagccagtccgttatcgccctttttcttagacactgtaagattttggaacgccttttgctctgcaacacgctgaattcgttcttcagaaataacgaagtttaaacgtaatggacgttctaccgtgatcttgtggtagccaaagtcttcgttatcaaaaattttgacgtactctctttctttaaagtcaccgtataagcgtgcgatttcatcaatttgctcttgtgcaatttcattacgtttactacccatgctcttcttcatctttttcgaaaagtctacagcattgattagctgtacttttcctttacgaattgcagctttattattcgttaaaatccaaatatatgttgcgatacccgtgttgtagaataaatcgtttggcatcgctacaatgccttctactaaatcattttcaagcacgtaacgacgaatttcactttcacctgaacctgcatcccctgtgaatagtggcgatccattcataataattgctagtcgagaaccctgtgggttttccgctgtaactggcttcatttttgaaattaaatgaagtaagaataatagctgtccatcacttgtacgaggtgtcccaggaccaaaccgtccgttatatccctgctcttcatgctctgccttaataggcttttcatatgatttccagtctacaccatacggaggattggagatcagatagtcaaactgttctcctttgaactgatcgtttgatagagtgttccctaaacgaatatttttcgcatctgcaccttttattaagatgtcagctttacaaatcgcatacgattcatcgttaatctcttgcgcaaaaaattcaaggtcagctgtagaattcagctcttttaaatactcttgtgcaacggaacccataccacctgttccagcagcacagtcgtataatgtttgtgttaaaccaggctttgttaacatatcatcgtcatgcatgaataataggctaaccattaagcgtacaacttcacgaggtgtgtagtgatcccctgcttcggcatgctctgagaaacggcgaattaattcctcaaagatataacccatttctacgtttgaaacgatttccgggtgtaaatcaagctcactaaagcgtttaattgttaagtatagtaaatcattattatctagcttttcgatttgacggtcaaaatcaaaatgatccataatatcgcgagcgatttttgaaaaaccattaatataatcacgtaaattatcggcaatattatcagcatcacttagtaactttgtaaagttatagttacttgcattatggaagttttgctttgcaatacgatttaaaatcggctcacgagcatcttcattcattgctttaaacttttcaaagttagatagtacttcatcttttgtactatctaacacacaatcaaagcggcgtaaaacggctaaaggtaaaattaccttcccgtaatcttctggtttatatggtccacgcaaaacttctgcaattgaccaaatgaaacttactttatcttggaagttgatcattatatatgtctcctctttattatatagtcctagtgtcttcacaaagtcatgggatcaatgacttacgtatgtccattatattttaacaaaaaacgcctacaaatgttgctgcttttaaatatgaagatgtttttattatcataaacttgacgacttagtaatatcacaaaaattcgataataactatacacttaattcctatgcaacagatttcaatccaaaattagatgtaagagctaatacatttcaccatataaatgctatttaatattatgagtgatattaaaattctactttgttagcgtacaagtcttacaagccttctttgctgtattaaaaaaagaagaaccttgaaaaaatcaaggctcttcttttgctctaacggctacccaaaataattatttctttaacattgccctatcgttcatactttggtcatatcattattctattttccttagcaataatcacctttactttatcgtctaacaattctccatagataagaacaaattaacttaatatgaaaaaatgagtaccaaaaacccatctcttctaagagaaattaagccaatttaatctaaattaatttctacataatacttatcatccttaccaaacaacatttcaccaaatttgatagcagtatctttctgcatactcggtaataagtggctataagtatcaagtgtaattcttacatcagcatgtcccaaacgttctgacacaatctttggatttactccttgtaacagcagcagtgtcgcgtgagtatgacgcatatcatgaaatctaatctttggaattttagcttttttgattatagaattgaagctcctccgaatattacttttattggttggtgtacctagctcagtgcatacaactagatcccagttattgtagacttctgatcctgcctctaacttttctgattctattagcttccgatgcttttttaattgaataatagtttcctctggcaaatctactgtccttgatcctgatttcgttttggtatacggcaagatttcttttccgtcactacttaaagtttgtgtaattcgtatacagcctgtttcaaaatcaacatctctccaacgaagtcctaatatctccccctgcctcatccctgttgtcaacgctaacaaaaaagcaatatagtatctgctatggctttgagcatgctttagaaaagtttgcacttcttttacatcccaaacttttatttctttcttctctgctttgggcctatcaactaaagaagctggatttttcgaaatgataccccaacgctctgctttttttaaagagtcatttattaatgtatgtactttttgtatattttcatcagataatgccttctctttagttagttgattatacagcttttgaattgccattggtgtgagttgagtaagttccatattacctattgcaggtataatatgcttttctacaagccatctatatgtttgcaacgtttgtttcttcactttagtttgcttatcttcaagccactgatttaataagtattctccataaagcatctttgtcggagcaatataagttcctgtcattaatgaatgttcaagttcatgaagcgctttaagagcctcctgctttgttttaaagccacgttttttaaactgtctaggtttaccgtcttctttttttccatgtgtcaaaacaaaataccaagtttttgtcttatcatctttctttactgttctacctgccatttcgtattcctcccattttacaagaaataaaaaacagcgactattagccgctgttttttataacaagatattaattttgttgtttatactcttctatttgaatttgtactttagcaagaacgtaattttgaatacacatcttaggtatcctatacgattttccaactttaaaagatttaatttgtcctgattgtagtaattcgtatgccttgttccgtcctatatctaacatttccattagatcctcaacgggaaccaaatcatcgtatgcatcgaacataaaatattcctccttttttatttacctcaaactaataatatacatttcaaattcttgtatttactctattgtttattgaaaattaaatttaattattatttacttgttagccttatggttatttactttctactactttgtataataaaaaattaactatgaaacaaattttttatatttatcatgacgattatctccctgatgtttaaaagtcattctataataaatgatttatattaaacttctgtttttttacattataatcattgcttcgtattacctatatagataatatatgtataagaaagccgttgggacttcaagggaactggttgggactttttatttttaataaaacaaaaccttccttcttagggtagcaaaaatgggtattcccgcattcccaaagttcctttgttcccaaattgaattatgctacctttataaaccatcatataaataagaggtttagtcgatttactattaagttatacaactattaaaatttaataacatggagctgatgaatagaatgaaaggtaacagcaaaccctcccaatactttattgataagtacgtagaaaagattaatctcaaagacttcccaaatgagattcgggataatcgtcgactcttaaatcgtgtcctcaagagggaaaacttaggtattgattcgtctggcaacacagtactgtataatcctactgttcaagggaatataaattacgaaactaatgatactgatgaacctgaggagatcatagaaacaaaactttccaatttttttgttgttccaacccatagactctatataaaaaatggtgacaccatacaagaagatggcataggcgtaaagatatatacgcagatcagtaagaaaaaatataaatgtatttaccttaaccttaataatgaaatgattgagaagggattttggataaactcatcttacttagatcatgatttatatctttataataaatcctttcagcaatacttaaaaatggctactaaactttcaacaagaatactttccaaaagtgattttaaaatatttgatggagaatggtggttagaaaatcgatttgcagatgttaaaatttctgattttgagggatattctgattctagacatacacgtgcccttgcacacccctcaataacaaatagatccttaaagccattccatgatgatttggatagtgaagagccccttaaagaaactgacagagttatcaaaaaagatatttttcacttcctaaaggcattattagagcttattagtgagcaggatttgctacaattcggaactattcccgaaaatagcgaagaaaacgcaggttgggaagatgaacaaaaatactatttaccttacaagaaaacgtgggaatggattgccaactggttacaagcttcaaaatatcctatctctgtaaaacagaaggaacttgacatctttctatatgaagaaaaaattattgagattgaggtggagaaaggtagaggcaggaaaagagccgactgtaatgttaccttgtatcccaaacataaagaacgagtttttaaaatttcaaaggcccgcattaccgaatatattaatacataccccaatttttaaatttcatattaacagtactttgacttaaataatattccccctccgctaatcatgtctgtacgatacagcatcccccggattattggggtttgagtgaggtattgttatatgattgatatgatgcatctaagttttaaactgacgaaattcgagtatgatacggcggtgatcaggatatatataagtatattatatatatccttctattctatctacttcttgtctaagatatagattttactgttgtatatgagtatttataaaaaacaaaaatgcgtataacaacatcctaaaagaacttttagggtgtgataactatgtaccatacaacatatctatatttaccaatggacggtttatattatagccatttgtttaaatctttacataacctctctattcgggaagggaaaaagtttttcaaatctcaaacgaaaaaagattgttatgaatgccatctctttaaggagaatggaatactaatctatttacgcagtactgaatatacaattgggaataatcacgttcattatcatgctatggaaatacggatgaatcctaagatgctattgcagcaaaaagaatacatacaaatttctcgatttgatgattatccagcaattgaacaaatgttttttaacctcttagaagaaacacaagaaaatatattaggtaatgatgctattaacaatcaattctctccaatcaattcaatagctacttacaaagttaatagaatagattattgcgttaatctattctcagctaatgctgatcaatatatagaactaattaagaaagcagacatcccaaaaagattcgcccctgtcatgatctatgattctaagagcaaacgaaaaaagctatataaaagtgcatattacgtaaaaaacaaatcggtatgcttaaatttttatgataagcactaccaattactacaagtaaaagatgatattttagctgctaatgctaatggaattattcgtttcgaggtacaatgtgagaaatctaagttagagagtttatgcagacaacactctatttctaattctttgtatcatctatctaacgatgaactatcacattctattctacttaaatattatgtacaatcgattggaattggtgattattacacattaacaaaagctaaagagattatacgcgatgctcagaactatacaaataaaaaaaagcagcttatgattacactccttactcacatttctcaaaagaaatatgtatggaaagcgagaaacgaatctaatataggtcccaaaaaatttgataaaactctaaaacacctaacagaattaggaattaatccagtaacaataccttctagatggaaagtacaattcttacccaatttacttccggatattatgaaagtaatgaaggaaaataaaagctgttaaaagtactttatatgcccgtactttcatggggcttcctacaattatagggattaataaaagaatctaaaaaaataaaggagcgtctgtacatgactctccttttccaaataaaatccgttatatctttgcgcttttaaacaaaactattacatggtctaacctagaatttaataaaagtatctctatttactcttctttcttatttactttataaactcttaacagttaatacctatcctatatttcaataaatagtctcttttatggcaatggaattttaaatacttatctttttttaccaactatttgtataataactttaatcacttcaagtataatctcaccagatttagaattcatcctcttcacctctactttcattgtcatatcttatcaataatctgatggtaaaagcataattgcatatttaccatcatctattatccaaactttataagtaaccacctccttagaacccaactcaaatacttgtaagtaatctaattgatctccagcagcttttcgacaatcaataataagccataaaaattgttataattctaatggaattatattctgtaccgttttggtaacgaaacgcctctgctttacatcaaacatatatccactctccccttattcaaataattaggataagttatattcctttttacatgtaccctttttctttaagtgaaacaaaactctcctcacaaacaataaggtggtctaacacctctatacctacaactttccccgcttcaatgagtctttttgtaacttcaagatcttcactactcggagttggatcattactagggtgattatgcgctacaataattgaagcagcatttgagataattgctggctttagcacctcgcgtggatgtacaatactagaatttaaactaccaatatggcaaacattgatagtagtaggctgatttttaatatcaaggcagagtacaataaaatactctcgatcagctccatctaaaaactgcctaaataacaaacttgcatcttctggggatttcactcttctttctttataaagaagactactctccttaatcatttttaattttacgatgtcgacacgttttgctggccgattgataataacagatgattctaataccttttgcttttctgctctactttcaccatatatcacttctttattcctccattcataagaaaaagggctactcttcacctgaaaagcaaccctttttctcttaattcatataaataatatatagttattaaatttgaatataccctacacttgttaccttatgtataatgattcattgtcttatatttaaaactccctcacatttaaatataaataactaacgacatctaaaactaccttccataaattcggccttttgaatctacgattatccttgtttcaaggactggtgcttgctttaaaaaagtcctttgatcatagtaaatattgtactgtttaccatttagatacttagtaataaattgttgatttttagaatagttacctttcatttcaccgtatacatcaatataatccccttcatctaatgaagtttcaatagaaataagaatgaatgcctcatcccctatatactcaccattaacatgtgcagttgataacgaaattattgttttcccattaacttcttgtatattatatattttcccaaacaaatgtattttttcaccttcatattcctcaggcttttttttcaactctttataacttatatctaggcattgtttaacaaactgatccctttttattgtccaaatgtatttttgagcttcatcaaatttcccggaatttgtactaatctgttctagttgcttaattgcttcttgctcttttccattattcataaaagcaattccactattaaagtactcttcatttttattttcttcctgtttctgtccactaattctatcttgatcctgtcctaacaatttgagcacttctactttaccccaattttcttttgatatattttcaaatgcctctttccccaattctctggattttaaagctttttctggaaaaaacaatatagtaattaaaaagatacaaatcaggcttccaattccccctagatatacaagtaatcgtcctctccatcctttaatttctttaataatctctcgttctacaattttcccaacgttttttctatcagttgagagcttcttatcacttaattcccccaaaactttatctttaagactttttatcagttcatgccttttaaaggttccatttttaagatgccttattgtattaggatacttcttaataatttttcttatctttaccctaaaggttattttactttttaaaaacaatgaaataaccactagcaacgctacaaacactataaaactactcaaatttcttttccccctgcctttttttcagaaaaaacagtaatcttttaccaacgatatatctttacaaaaaataactttgcatgtctgttcccttatataataatatacgagtactttctccctactaaactaacttcatatatattctgtatgtctgctaaacaataaatcctactatagtaatgatcagtactattatcactataaattttatatagccagactttctatcaaaatccccccttataacctttaaagtttggtccttatgtactgcctctacattaaaattttgatcaaaatgataatttcttgatacaatactagcctttgaaggattttctctaaagtaattattattcaatcctatatcacttggtgatagcttatcttgtataactagttcattctgtttctcgctttttttacaatactccgcctcttcccaatattctctcgctaaacaataatctaatgagtatcctcttgcatcccgttcaacactgcaattcaaatactcccgtgcagaactgtactctgtattaaaataaagatcaggaaaataaatgaattgaaaagcatgtctcatttcatgtgaaagtattgaaattaaataataatgatcgaccatatcaatatgattggtatcagaattataaaaaccaccaaagccaccttctaattcatatcctcttggatataatttaatagttggataaactttcaaatttttagcgataacatcataattttcatatagcgtcttcttagtgaagaaatctaattgtcctataatttgaatttttgattgtccatctcctatatcatttaacccttttaaattattaaatttaaaatccttattatgtttttgtgcatcaaagaatcgattgaacaacttaactaacccctctgcatataaaaatataactaaaaataaaatatctataatttttctaagaatcacaattcattagttacttatacttagataatgaaaataggaatatccattcacttaaattataacacttctcataacaaattcacccaaaaataacgctattggtgtatataaataacactaacagactattaattaaacttccttcttttactaaggtttaagcaggagggttttatatggattataaaaagctcggtaatagaattcgtgaagaaagattaaagcttaatttaacccaagagatactagctgaagatataaatatttctgtatcatacatgggacagattgaaagaggcgaacgtaacctgtcattagacactttagtaaaattagcatatagattaagcgtaactgttgattaccttctactagattcagtacaagctaataatgaaaattccattaagcaatttgctagtttaatagatgggcgttctcaaaaggaaacatatatggctttagatatgattaaagtattattctcgcatttagataataataattaaaacttttcttttaggaaggagactctccttcctttttcctattttatcaaaagtcgtagtcctcaaagttttaatataatttgttttttatattttacaggctataatactctcctctatatatttttttataaggtaatatgcaccataggagttattaacctgtcctaataatatttactcttgaaagcaatccttcttcataaatacttcccttctctggatctttttgcttcaccatctcgttcattatgttattccctaaaattcctatataagaaaattaggtaatattcttcaatcaaaatattacctcttttcatctttataatatatatttgttttttctcttaactacaacttactgcattatataatttataccacataccagattaattctaataaaaagcttctcttcatataattcaaaaatacctttaccaatctcctcagcaaccgtatctctgttaaccaaattatataaacgtagcctttattcactccactatcagaaccaaacactcgatcaaattatctattattattcgtggtgtattaaatattattggacccatccctaatattatttttagtacaactaatgtacatttactatttgctgtttaatttatattcagctttgtctctttactagaattagtaaacgtactactcatttctttccatagtatattttaatttagtggagaaaactaaggattaaccgattttaataaactaatttttaatttccatttatccccgcatccctttttcctttattctaaatgattttgttctaaaaaacctgtaaggtattaacataatttgataaaatataacagcagaaccaattaattaagaaatctactaagcaaatacttattaattattcttcaacatttgcatttgtatttataaggagacaaaatttatggaattaagcttggcttcaactgattttttaaaagtgttcaaacatctcgattcttatgaatttggtgatactggaaacaaaatcaatttatttttatgccctataaacgccaataagttcgattatagtagaataataaatgaacttatggaaccagtagcagactttgccatttcaagaagagtgaaaagttcttatgccaataaacctatgactctatccaaagtagctagagaaaaatttgttgagtataaaaaaaacactggtgaattaggagaatttttattgtattgctttttagaaggacatttgaacgctccaaaaatattttcaaaattggaaatgaagacttcaactagtatgtacgtcaatggttcagacggtgtgcatttcttaaaattacctgatggaaattaccaattagtgtttggagaatcaaaaactatcaaaaaattaagcaatgcaatatatgacgcattcaaatcaatagaccaatttataaatgaggttaacgataaaggaaatgcaaaaagtggcatcaattttgaaaaaagattaattagtgacaatttagatcgtgaaagctgggataacaccgaaaaagaattcctaacaaaactaatctatcccactactgatgagacttttgatgtagacgatgcctttggtatttttgttggattccaaataactcccacagatgcacaaaaaaaagcaagcaattcagcgtataaaaaagcaattgaaaccgatgttaaagcccaattatcaaaagaattgaaacatatccaagatttaatcgagaaatatgagctatttggatatactttttatatatacgctttgccatttactgaacttgacaaaaccagagaggacataatgaaaggactaacgacatgagttttcttaaagaactagcccacaaagcacttagtgatgaatatttagaaactttaatatataaattagaaaaacaatatggttaccactttgcaggtagtcatataaatagccccttaactagtaaggaatataatgatttgttaaggttctcagatatactttgtaggtccgatataatacaagctcgaaatctagcatataaaatcattagtttattatacaatttttatcatgaagataatttttttaaaatgcaagctgcaactgtactcgtaaagctaggtaacttcccttctcttaaactagccattaataatgaggaacttactctagatgaagtgaaattagaatcaatcattaaagaaacttatcaaatcgctcctgattcaaaaaccatttttactgatgctcaatacaaagtttatgagaaattaaaagacagtaaccactttagcttttcaggtccaacgtcttttggaaaatcattcattattgaatcatttattaaatacctaatcaaagaaaaaaatgcctctgataatattgttattcttgtgccaacaagggcattaatcaaccaagttacaaacaaattaaaaaaagagatttccgaacccaaatacaaaatactatcacacccaacagtacccttgctttataaaaataaagggaataaatatatttttgtatttaccccagaaaggttaatctcgtatttatcaaatgataatcctgcaatcaactatatttttgtcgatgaggcccaaaaattaatagctcaagatgattctcgcgctccacttttttatcatgctttgatgttagcaaaaaggaaaagtgtaaacctttatttttcctctcctaacattactaatagtgggatttttttacaattatttgggaacagtacagaagaaacactaagtgtcactgaaacctccgtggcccaaaatagattttttattgattgtattgaaaaaaaggcacttatgtttactgaaaacggaaaagaaattaaacttccttatgataacttttccacaaacgaacacaaaaatttaagaaacgctattactatattagggaaaaatgttcagaacataatttattgtaacactgttgatgatacaataaattatgctttgcagtttgcaaaaaaccttaatgaaaacaaacatcctaatttaacttccttaattgagctagttgaaacaactatgcatgaagaatattatttgatagattgtctaaaaaaaggaattgcgtttcactttggaggattaccccaaagaattagagaaaaaatcgaattattatttcgttataaaataattactcatattttttgcacctctactttacttgaaggagttaatttacccgcaaaaaacatatttattttaagcaacgccatcggacttaaaaagttctctgatgtagatttttggaacttagcgggacgcgccggaagattaactaaagacctaagtggaaatattatttgcctaagaatagtagataagaaaaatagatgggataaacctaaaaaagatttaaaaatagtaaaagaaaaaaaaataaaagaagttagctctattttaattacaaataaaaagaatttttatacaaatatagggaattcgattgaagaaaaaccattcactcgaaaaagtatacctaataatgaaaagaaaatgcttgattcctatggtaatatcttagcttatcatggtttatctaaaacagattcaattttaagaagtatgtttattaataaaaattctgagggggcatcaattcttaataagcttgactcgaaaaacagggttccaaacaatattctagaacaaagcatgactatcaaactaaaatatcaaaacaatattttaactaaagaaaagtttttatccgaaataccaactgaagtgaattatacaaattgcttagagctcttaaataccctttatgattattacaattgggaagaagaggaatctggaggaaataaacctttagccaaaaataaaaatattctaacctattatgctgtgctaatgaactcttggataaattccaaacctttaaatttaattatcaaagaggtaataaaagattatatcacacataaaaaagatatctttctaagtaacaaccaacccgaaccatttaatgtgaaaaatcgtattcatattaataaggtggttaataatgtagtatctgatatagaaaatgtattgcgatttaaagtgaaaaattatgtttctaattacaccctactagttaataatataagtgaagagaaagacctcccgcaaagtaacgattggtcagaatacttggaatatggaaccacagaaaatcttataatcgaattacaaaatttaggattcccaaggcatttagcaacattccttaaaaataattatatacaactctttattattgaagacaataatataattgattttttagaagatgaattaaaaaataccattgataaagaaaaattttccgaagagtataccgagttatccgaaatacttgattgggaaatttaaattactactctcaactctaaagtgaaataaataaaaattacaacaaaaaagttaaccttattttccataaacatagttattttttcttcaccgcatacccaaaacaactattttaagtggtttatattgcatgagttttgtatttattatacagaactcatgcctttttctagatctagtttcctaaaatctattactgtaaaatttaaagcccttaatcgtttttcacaattaattttagccattctatttatccctatatttttttactactgtttgttttactttacacagtctaaattaatccacatttatataatcatgaaatcaacctgtatataaattgatacacttttctcaataccattctccacagtaacttaaatgtattataatatatttagtacaaaaaacagatgttcagaaaggatacttaataatgattccattcgaatttatagtggaaggtcctcccgtatctctccaaactaaaaatcgcaatcgactccaagaatggaaggcaagagtaagatctgctgcagaattgtattggcctacagaagactctccttcagacaaacagttaaaacttagtattacatattattatgaaaatactagcccagatgttgataacatcattaaacccatacaagatgcccttgttggtttagtgtataatgacgatgatcaaattattgatacctcttgtggaaaacgcgatataaatggttcatttaaaatacgaggtgcttctcctgtcctagttaaaggatttgtagaaggcaatgaatttttattcgtcagtgtcgtagaaataacagatcttgaggaggtacgaccatgactcaaaataaccgtaaattgatagaaaagaaaataaaagaagtagcgaaccaatatattcaaaaaggatatacagtttttattgatcctgtatcacatgatattcctgattttcttaaaaacttttctcctgacataattgctattagtaatgatgataaagtaataattgaagtgaagtccaaaactacactaattcactctaaagaactagagagcatggcaaatctaattaaccaacaagatggatggagatttgaacttgttgttaccaattcaaaaaatcttgagaatgaaaaccaagaagaattatcccttaatgctgtaataaacatgctcagtgaggcagaaaaattattggaatacgattttctaaacgcatcttttattatagcttggtctgcatttgaaacagtcgttagaaacaaactaaaacaggaaaatgtaaagtcagagtataccaatatatcacaatctattaaaaacttatatacattcggtctagtttcaaaacaggaatatgattttctccaaaatcaatttaaaataagaaacttagtagttcatggatttaaatcaccctacatagatccacaaaatattcgaattttaattgcacttataaaagatgtactgaactacaactaagtaaaccccttataacaacgttataaggggtttactacatttataactgttattaaaaccattccaaaactaaattacaaaaaagtttattttcttaataaaacctccctttttttatctacatttctctcctccaatatatttttctacaaaataaaaaacggtcaagattctggtcaagaaatttcatttttctacgttacagaatttgcataagaaaatacaaattatcctataaacccttaatacagcttcctttctgctcgatattcccgcaacgtaaaatatacgtttcttatcttgacagggtggaggtcatcatttaaatttcacatctacgttattcacaaataggaagaagagcatatatctcatatgctcttcttcctatagctaataatacaatttatccgactaatatttatctaatctatttcacaattacatttatcatttttaaaaacttctccacttcatctaaaattctcattgttccaggaatatcaattcttccttttccatctcccactctataatccctcaccacagcaacagtcatatatcgcccattaccaaacctaggtttctctacattaaaagaataattatgacttcgttcgattagcgctttactccacttatccctaagttcttttcttctatccttatcggaaacatgtattttaaaacataaacgtccttcttctaactgcaaatactgcctgcaatcattatcctcttgttcattccaccataaggcatagaacccaccattcggattagctacatatccatattgacctttaatcccacgttgctttagctcctcataaaactcttcccaagcttcacctttccactcgcttagcggaagtgtcttatatgaattatatctttgctctagttctcttaaataaaaatagtaatctaaaaatatttgatcttgaacgcctctatctatatttccttgtaaaaatccaagcatttgttttcttgtaaacaacttatactttgcatcgattaccgctgagtaatcactttgattacctattttatagtagatcggtaataggtcgctctctttatatttttctagtttagccacttcttcataataacgctttaattgattagaatgctcttttgtatatgttttatcttcaattaaaatagcctgattaccgttaacttcaataagtatatctaaacctttgaattgtttcgtaatcttaatttctttaatagaagttggaaagttctttttatgtaagtcatatatttttctaataaaatctataccagctgcatgtaagcattcatcggtttctttatagattgggttcgcccactctgctagccaacaaataaaagcatcttgcgacaactcacttgttccatttgaaaataaattcggtctcttattcattacttctccccccctttgtatctaagcactattcctcaacatttaatacctctaaaacctccctaaacaacaccgatcccctcccaacaaccaactccaaaggaacctccttaactcgcccatctctcccaaccataacaaccccattctcataatcaacccaaatctgaacatcctgcacataataactcttaacagaagaagcctgatctaagttgttatgatccaactcaaccttaacttgcttcgtaaagcgacgcagggttttccaaagcgctcgttcctcttttgatttcataaagagttccggaagctcttgcacttcttttaataacgacatagttgttattgtgtatgtttgaatgccatatcctaccgggcggatgaggtggtctagttttttccatggttctagttcaaaatgtacataatcatcgttttgttgcatttgaatatgcttgattttggcgacgtattgaattccgcctttttcaccatgccattttttcggtgcatataatgctatgtactttgcttcttgccatcctggttttagttgtgtaactggtagctgatatacgccattctttctatatgtttcatagtcactttcagttttcacgctgcccactaatactttttcttctaatgaggatttccattcttcttttgtgcctcttggaaggatgccttcttttataatttcttctgggcttttttcaatgagatgatctagaaattgttctactaatcttgtcgcgtttggtaagaacgggaagccaccgatatttactttttcaatacttttataaaatggatgattctcatatgcttccttttggttccatgggaatagtacgtacgctccgtaagctgttcgctcaaagggtccttcttgttctactactaatgcgtctctgtatcgatgcattgtgttaatatcctcttctagcgggccaggggttcgatatcgacttttataatgagctgtttcagcaaaatcaatccgatatttcgcatcaaaatgtattgatattgatagctctttccctttttctcaatagcgagcatcgtatccggcttttgcgtaactgttggcagttcaccatttcttttttggaagtaaagctcgattacctcatctgtttctgggtgtttaaacgttcttttcgcagttttactttcatctagcgttacatataaaccatcttgtttaacttgaataacatcttgatggagcggtatatactttttggatagaatttgtccaagttttaaatacgtccagtattcgtataaccttgcaacatcttttaccgacattttaaaaatttgtcctcgtaatgttaagcctcgtgatagcattaagaagatttgatacgcatctctatatcctgctgccatttggataacaagtgaaaagactgatcgatctaattttccgattcccctccaaaacggatcgttcaattcatttttcattcgatacttcatattttttacacgttctagtaaatcttcatcagtttcaccacgtgtatatctagacttttcctctagcgccttaagtaaatcatcgattttatgtataactctttgaatcatccatttaacaaatcgattttccagcgtatcataagacacttccttataagctgtaatgcctttagtcggtatactgttttctccttgcaataagtgtggtcgctttcgcaaatagttcattccgagagaatctaatttacgaatcttttctcctcttacaagttgatgcctggtcataagtgtatgatgcggttgtctttttatatgagagatcgacttcataaatcgctcaaaggaatcatttaaaatacggtagaattcactcttcgatggatttgtagcgtaaattgcagatgctcctaagtaagttctctttagtagatgaaacgctaaattataaatttcatcatttacctcatctaataaagctttataatcatccttataatcaagttttactggaaaaacttcaaatgtaacggttaataaagtttctttatcatctttaatttcaaacgttgtatttcctacttcattcggaaaagaaagatttcccattaacacgtgaagtgaacccatttgaatggaactaacttgttttcgaaatcctagatgttcatgataaaaggagagctgcttgttatttttcggaacaacaacaagctgataacttctattttcaaaaaagatcggcggatgttcgttccatttatctaatctctgcaatctcgcatcaaatacggcaacggattctgtcttaccatctacatgaaaatacatcatttcatccgcactcatagcgtgatattcttttaaactctcatatttttcatgataaggatttcccttaatcgtcaatgatagctcctctgtttcaatcttaactagttctatctcattattagatccagaaagaggtgaaaccatcatactcgaacctccttaacatatgagacagtttgttagctgaacgaggatacttagcatatgaagcgtcattattgccactatcatattcttcatttgcacataatacatacaactgctttaatacctcttctgttcttccatcgctccctgcaagacgcggtaaaatcttttgatatatttgataatcaagtgcttcatcgaatgacaataacttcccttgctcgttgtatgccatataaaaacaaatttcatctcgtatacgatatccaacttgagctccaactgattcaagtattttatttatttctattaaaatagttgagatatttctcacaagatcctcattttctttaaaacattcttttagatgcagatactcagtttctaaagagcgatttgaagcaacttcagcttccttctcttctacatccattaagaaattaaaataatctaagttaacggtattaaactcaattgtattcgcacgatctaatactttcttactcaacggatgtgtcgtttcatccatattgacagttccaataatgtatacatttgatggaatcgtaatatgcttattcgtaattgattctggaagaactggtgacgtaacaatttttctatctttccatttacgactttcaattacacttaaaaagtcactaaagtagtactccactcgagctaagttcatctcatccaacactacaaagtacggtctatttggatttgcatctgcagcttcaagcaccttaattaacggtctttcttgaaactcgccttgaagattcacatagccaagcaaatcagaactatcactccaatcaggtctaaccggaataagcgtaaattgtccattctcttccgtagcccctaaactctccgcaaaccactgaacaattttcgtttttcctgtgcccgaaatacctgataaaattacaaatggcttcgtttttaatgaaaggaagaaattaataagatcctttttctcataaaagaaacctttactttgaatataagaagacacatgatcgataattgattgttgatctaaatacacttctttcctttcataaatcatttcatatttcgttccttcctctttataagctatgaacccctcataatagcgaagcatttcttctaggtcctctactaactctttttcacttggcattttattagcatcatactcaatatatgctacagttgaattcgcgtaatctttcgctgaagagctcgtacctagaaatatattatcgtctcgttttacttttgaagacatatttatatgctgtcgaatttcttgttttattatttctatttcctctttaggggtatcagtcactccttgtgctatcgttagatacaaacattgcatatcttcactaaataaataaacaatgtagtaacctctttgagttgactttgtaatcttttgattcataatagcaaaccatggtacattcgcccatttcgtttgaccaactgaaccttttacaacatatttattcatgtctataaaagataaattagcaaaaaactttttcatgtcatttctaacaaatgaccctaaattgtgctttgtaaactctccctttttcgcctctaaatactcatccattactcttaaaaaaccttcacgcaaattactactcatattaccgcccttttctccattatctcttgtatattttttaacatttcatcatcattaaaggtataccattctcaccctcacaaacagttacaattgcaattacaattacaattacaattacaattacaattactaccattttatcaaactatatatacgcataaaagaaaaatcatacgtcattccgtatgatttaataattcctattctcctgactactttcctcaagatctccctttccccaaaactctcctaatcttgcttcctcaacattctcttccaaatatcactctcagccgtcttcttaataatatcatcctggcaaatacctcttctttcgtcaggtctttcagtgtgaggttttaaaaagcaacatcaactccttattcttcccacgtcggaatgacactatttggtaccctttttcctctaaaagccccttacacatgttatagatggtaacaataagcatttctataacatctaatataactacttattcacaaaataaatatctatttcattgttactatttaataatataaaaggcaaatggaatttccccatttgccttttatattattctacccctaaagctttaaacaccgcatcttctgcactttgataaaaacctatttgaaatttagcaaacaattcgggtggtacagttggtatatctacagccgataccatcggtaaaagtatttttttcgcccctgaatcaaaacaaacttgtaatacattggctaattcttctactttattaattgttccacttatactaatagatcctaatacaaccatttgactttgtactggtttattcaatgcacctgaacataatgcgataaatgctgcaagcgataactcaccagttaatccaactccatgaatatcttgaatatgcattaagtagtcttttgttgttgtactaatagtaccacttatatttttattatttgctttaaagaatcgaaaggcggtatctatactttctttagcatctcgatctgaatttaatcccgttttttcaaacttaccattaccactcacaacttctgtttccaatttataagtaccaatcattccagtctttccacgagcaactgtataaatatgccctggtttgttcatcccctctgggattaaagttcctccaccttgttctggaaccgatacaaactcttcattcattgattcattatcaatataagagaaattgacatcataaaactccatgccaccaattttctttaattgttccttcacacgtctgcgccctattagagcgtaacgtagtacttcttccacatcttcttttatatattcaccgttcggatataacaacttaatcaaacccgaaacagttttacgcactgcgattacatctcgttgatttaaattatttcctaatctaaaatatttatcgatcgcatctgagaaagaacgttttcgcatttcccttaaaaactctgctaaataatctgttatgaagccatattcatttgtgaaaaactcgggtctcattttaggaatttcccacccaggtaaatagtaatgcattcgatcgaaaaatgccgaatcatatgccattgcttctgggaacgggtcaaacaagtgtgaggttttcaataatacatctacactttgattaatatttcctacaaaaaccatagaagcgctagcatttttttcttcacggcctcgggcaaaagaacctgaagccatataatctttcataatctggataccatctttatctttaaatgtaattcctgcaacttcatcaaatgctaccgtatcccacatgccaactaatcctatttttctagtcgacatattataaaataaattcgcaaccgttgtttgaccacccgatactagaatcgaattaggtgaaatctctttatagatatgtgatttccctgtccccctcggcccaagttcacataaattgtaattattctctacgagtggtaccattctttcaagcaaatgccactttactgtgtcttctaattgagttggttccataccagttgaacgaataagaacatcgatccattcttctttggaaaattgccttctttgttcaaacatctcttctaaatccatattaggcatttgaattggtgtaacgctctcaatgctaaatggacttgtaccttttgattcttcatcaaaataatattccatttttacaatgcaccatataccacctgcaaggagcttatcaaattcttttacataatgtgaagaaatcggaaccccatttagtccaagattagaaaactctgcttcatatatgtcttttttatcatttaattttacgccaattttatcaatgaccgtatacttgccaagctccttaactttcgactttactttctctgcttcatctgggcgtacgaaattatccgataaaatctttttgaccatttgtacgccatcattcatactcttttcatcgtccgttgcacaatacataccaagcaagtactcaagtacatatactggtacattcgcaccttctttaattttttttgttaaatctttacgtactacttttcctgcaaaatgtgcgtttaactttatatttaaatcctccatctccactcaaccccacatttcttttagaaaccaaaatcatttgtaatggctatatcaatcggaaatgctactttctcataaatattttcaacagcctcttcttcatcctctaacactaaataatatttcttcgttttatcataagtcatgctctttagcacaaacttttctttaaacgtacgatcctctggcttagaagactgactatctgcgataataatattttcattagaaattcgatttccctcttcatcagtgaaataaacctttaagcgcaatggtgttttcttaccttcaattttttccgtttggaagaactccagatatgtaatactgtttgtaatctttcttgttaaacttgttaatttcacttcaacctttctcacatcattcttactagacttactacgatcatttttaaacttaattactggcactactatttcttgtagcattgcaccaccgtgtacatagtttgctcctgtaccttgaacagcgaaacgattcgcccctcgtggcacttttacatactttccagaaccttcacctaacacatagtccattgaaaaattcattgtaccttctatagaattggattcactagagataataaatcgtcgtttttcaatatctgtattcagaaaatcttttttcactttatcactagcttgcaatgtatctcgattataaataaatccgtgatccgccgtaataacgatattagatgcgctaacagtattaataagctgatctactaaagaacgaatatcttttaatgtttgttccaccgcatgaaacacttcatgttctgttgctgcatgatcgccccgtgcatcaattacattatgataaatataacttactttttttccagaaaagacatcgcgaaattgttgacgattcattgcggctaaatccttatattgaatagctgtagagtctttataatgctttgaaagaatcgttgctctattttctgtacttgatgctttgtaatcatttacatatacttcagcattttcattaaaagtgattgacttatacggaagtagtgtcgccatccctaagtccgtatatgaaggcagaacaccttgcatcgcgacaatatcagtcgatgcttttcgttccacattcaacatattagataattccttcgcaacttcatagcggagtgcatctgatataattacaaacactctctcttctttattaacaaatggttgtacaaatgagcgataaaatgtatgttgtgactctagacctgcaattggccaatattcttcttgttcaccctcaagcgcatctgaccattttattgctaaatcatttatatatacatttgtatatatgttttctactttatctcgaagtgccctaaaaccatctttatcttcaatctgatcgaatgctacataaaattttctatatgctgtgtctatattgtgatatttactctcgtatgctttaaataaatcaaatggctgtgattcagtaattgcattacccatttcatatatttgttgaaataactgaatcgcttgatacagtgcttcgtactcattacggaatacactaaaccaatgcaactttcttcttgccgcaattatttctatatatgacgtgtaatcatgaattgcattcattaattgttttgtaatataagtaataatgtttgtatcaaaacaacagaacgtatctgacgttatataatcttttatttctttactttgtagatgttccgtcactttcacttgtttttccaccgtatttgcgagctcattgtaaattacttcatccgcactatgattcataaattgattcataaatacaatagcattcattggtatagctgaaatgtatggttgccatgttttgggtatatctccgctcaatgtttcactaacatttgttaataagaagaaaataaggagtgaattaattgacttatcttgtaaattgtagccgtatgttttctctacaaggttccaaaatgtctcttcattaccaaactttcgaatgttctcccaatacttattcgtttcttttagttgttctctaaataacgcctttattacttcatctaaattcacaatattacatttacataaagatgctaatacaacaagatcaatttgctcttctgtatattcaggaactgaaaacgatttaaacaacgcttcacgttctttgctcttaaagaactttgtatatttcttaaatacatctcgcaaagcagcatcatttgttatgcctagctctcgcatcatgacagtcattttatctgttgcaaactcttgactatatttatacacatcaagtaaccaatcttctcttgctgaaggcttagccatatttgcataaattaaaaagttagaattcacatcatttttttctacttctaacttagtagcaaacatattatgcggggttaatttccaaatacgaacaccttctaaattcagctcatctatatcttcgataaactcgccagcttcatcataccaaaaaacaatatgacgcttctttccttctgttaactctttattgaacgtatcttgtaggacacgatttatttcttttgtattcatacctcaccaactctcaatagtaagaaatagactcagcgttaccgctgaatctattgtagttttcacatattataacacgttaaatctttgctaatagattagccttaagtggctttttgccttctccttgcggaagctcaacattttggaacttcgcatagtttacttttacaccatcatctaaatcaattgttattttttgatttgcaatatgagcaattacttgatcatattgttggcactcaagaagttgtttttgtaacttttctttttctttttttgcacgcgtcttatcctttgttgaagcatcagactcaagtaatacatcacgacgtgcaatttccgcttcatacttacgttgaagcgtatgaagataatcagtacgaacctccgcaactgtaccaacatcataacgatgcatataaacgagagctttaaacccatcatttttaccactatcaaacaaccaataaattggacgtttttgatacatcttcacatgatccttaaagaaatctttcaagaaataacgacgaatacattgacgagatgtttcattcgccttcttatttaatgcttctgcaataaaatcaagattctcttctagcgtctcttcactaaacgtaacacgaacaaattcaataaagcgacttacaatatcgtcttcaaaatactcatcatccgtaattggaatgatattatccgtatctgctttaaatgttttatatttactctcgtcaaactcaccaccagcaaatactagtccttcttggtctagtgaatatcgaccaagcatacagcctacggcgtaggagataaaggatttgatgtcgcgttctttgtctgctttccgaatgactatgtctttttcttttacttctggtgttaaatcatcctgtagatcatagatttcaataaaaatacgatttaattcttcctcatttgcttttaattgattaaattgttgttcagcgaatacgctccaataatctaatacttctgataaccttcgagaactatttttatgagtaagcatagggtgacgaatgaatccccaagaagtttcaaaactatcccaatctcttttcgaaatacttatacaacttgtgattaagtccattttagcttccaataaattattaaatgtcatcaatggaattttccgaacatcacctacttgaaaatgcaaagttggattgattttttctaaaaaaacaaatgctacgttactatttaagaatgccattaaataataatcatctctggtattcccagcacttaaaaaacaaccttcacaatcaaatattgttccttgattgtgcaatcttacccccaataaattactagtagttctagaccaagtaataccacttttaaaatatagttgtttagaaggaagacaattaccttgtttcgctaaggtattgtaactttctatgttgaaagaaattaaatattcattattcccataccatttcctaaatctcccccccttattgtgtggaaaccactttattttactttcgtgagcatctgagattgataaagcaccccaatttatacgtaccttatctacttcatgccataaacgtaaaaatctatcgttatctcctgttgccaatccttgtctaggatcgtataaatcacctaaaactttattttcagaaaatgcaactaacattttttgcgtagcccaatatgcaatttgatatcctggcacatttaaaaataaatctgccgctactatatacctttcttttttctcaagaaaagatagttttttttcttgagaatcattatattctacaagcctaataaatggagtttgataatttttaaccacctgtttttttaatacaaatgatgtcgattgaactacctcgccatttatttcttcaaaactgccagatcccaaatgaatcatagagcatatagtactttcagataagaaatactttctaatttcttcataactagataaaaacatccacgactgttgattgatgttcgaaatatatccgccttcttttgtgaaattaaaacattttaacataagaacagcaaataaatctcttttaccttttttaaagaattttgtacaatactttttaagttgttcattcatacctttactgcccatatacggtggattcgttagaactacatggtacttactgctcattatttttgcttgtttaattaactgaggtattttaataagtaaaatatcactatattgaagagaaaaaatatccttaacctcttgcatttcttgaatctctatcattcttttttctattgatacaaaatcaattgataacacttcaagaatagagccatattctttcgaatcttcaaaaactctaattaagtacgttatctcatccctatccaacgaatctcccacaaaataatcaatcgcctcttgtgggatcccattactttcctgaatagaacatacatttaattcaagcggcctacggaaaatacggcggttataactacgcgccttcatcattaacgcaaaataagcaagctgtgctgcacgatcatcaatatcgagtccatataagttcttctctaaaattaattgcggaatttctcgctcagagtaacctgcatgttgataaatgttatataatacatcaaatgcataaacaagaatatgacctgaccccatacacggatctaatactgtaatatcttctgggcttagttcattatttttcaatttttctagttgctcttgtacattgggttcctgctctgcttcttctaagtaatatttccattgctgttgtacatcttcatttggatgagattcaagccataagcgtcctaatgaattttccaccatgtattttacgatccattttggtgtaaagagctgtgttgcagctggaatgttttcttttgtgatttttttatttttcttcaaatcagcaaatacttcatctttcttctcagaaatatagtattgatataaccatccaataatctcaacttgttctttccagtcttcttcgtcaatcatcgaaactaaattacgtacaactgatccttccccaagtaaattatctggtagtaataattccgtataatcttgaattgtttcaaacatcatcggcataatttcaccgagtttgttacattgtttaattaaaatatatttaaataaatcttcagttttgttttcatcttgcaatcgatacacgatgtctaagtttaagtctaaatcttcagcaatattcgttacttcaccaattacatctggttcgtttttcccctcttgtgttgaggaaagaactcgtacacctgttggcaaatattcatttacttccatgaaacgaatagcaataaaacggttaaaccacgtgtaggaaacttcttcaattacttgtttatagtctttttcttcgattttctgaattagttttttacgttgttctaattcataacttctaaagaatttattattaattcggaagccatcttcatatgtttctggttctttaatttcagtttctgtaataccaagctcatacgctttttgctttacagcgtcaattaatttcatacgagctgatactgcaaagtttttgattgcagttttattcattatgtattcctccattttacttatagaaagggaggatagcacctcccctttttattactttacactaatttgataactgaagcgtcttctaattctttttgtaattgttttcgaatttcatctagtactgcttcaatatcttcttcattttcaattgttttcgttccgcgaagtattgtatttttactaattgttttctttttagctttatattcaacgatcggatcaataacagtagtacaggtagttcctgtacatggtgatgtgacaggtggtttacgtctttcaacttcatttgcaatgtcatcaatacatcttactttcaatcgatcactttctgtttgcattgcaattgcttcatagaaattgtttacacggttcaatctatcctttataccatcaaaactatttttaaatttgttaaagaacatacttttaatctcttcatgcttattaagttcttctaaaacagtttgataatcagattcaattacattcttaactggttcacattctttttctaacaattctacaaatagttcatcaaactctttaataagccctggcaattgatgaatatttttatacggttctttatgtttcacaatcttcgagatactctcaatgaaaccagttaccttttggtcagttacatatgtttgattcttctcaaagatgtttaatcgtttcactgcatcgtcataaatatctcgctgtgtttcaaagaaagcttttacaggctccacatcttctgcatagtccaagaagtcattttgtaattgttttactttattatagaaacttgtcgtatctgaaatgtttagtagctgttcaatcgattctttaccatcttgcaatacatcttgtcctggataaaaagtattacgatattgaactagcagtacattaattttatttttctcagatactagtaattctttaaatcgattcattaatccatcttcatcatctggtaaagcagtaacttcaaacacttcttttgaaagatctttaacaactttcattagtgcgggtgaaatacgttccctctttttcacaacgacacgttctacataatcacgcttcgttatgtaatttactaaatcgcgctcacttgttgttaaattactactattcaattgtaatttaatttcttgccctttaaacaatttaataataaatgaagcaatatcaagatctttccacccatatggttgttttgtaaaatgggttgtgatgcccttaatcgtaatctgttggttgcgggttgttaaacgagtgatatagtcatttacctctttaaccgctaactgattagcatcttcattatcgtccgacagcgttaactgcgttgtattttcaactaacaattcatttaattgcttcgctgtatcaataaatttcttcacataatgcagcttattatataaattatcaatcaatactttaaaagcatcattaattctctcaacaggatttttctctttcacatctaattgctgcgaattaacaaagatttgggcatgttttaatgcttctgttatataaatatgaacgcgatcttttcgttcattcgcttctcttgatttacgcactttaatatcttcgatcgcttgggaagctgctgtgccacttttgattttcaagtatgcttgtattcttaatatctctgtcatttcatctaaataagaagtgtcttgaggtaattttaatattacattactctcacgcatagacatcattttcaattcagagtcatttaattcagtcgttgcatcgaaatatggcgtgatgatcttcaagccaatatcattcgtctgcataccaatcggacgatcgtcaataattgtattaaaactaaaatgatatttaggagaataacgatattttttatcttgatagactacattaaaaatgacatcaccaattttttggataacttccgctgagtcaacatgcatatttttaatttcacggttaacatcttgttcatcatttgttaagaaaatatactcttgtccatttttttgaattaatgtttctttacttaatcgaattaatgaactttcaattttcttcttcagctcaattttatcgtcacttatgttttgaatcattaacgttgctaaattttctaggtttgcaggtagttcttttacatatttaattaagaatagtaatttcaatacttctacatcgtatgcatttaagcgtgaattgttttgagcatggatgattacagtacgaatactcgaatctaaaaatgcttcaattgtttgatagaacgccgaaaatgggataagagctccagtctcactttcagcatatttcattgctgattcttggaatgcactcaataaagagcgctccccttctgctaaatgctttcctgatgccccatgaattcgaatacctgtaaatactttttgtagtaaattaaattggtatggaataaacggataaacatctacgaaatcttcctcattattaaatattttcatttctgctgtatcaccagagaatgtaattaaattctttaagatggaactgttatcaccataaaggagtcgtaaagtttgtttaccaacttcgttttttaataaaatacgttttttaattacttcatctacgtgagcactagacaggcttaatcttgtatcaaaacgaccttgaattttcgaaaagtcgtttccgttaactttaacaacagagtcaatatcttgctgacttgttaccaatacccatacttttcctccgcactgcgttccgatatcttctactactgtttgcagattcaacattagttgtgaatcattaccgatatattgtcctaattcatctataaggaaaacaacatgatggttatttcctttcgcttctacatattcacgcacacgtttagcaaaacgatcgatactaatgaaataatcctcttctgcacgttcataccaattacgtgctgcatcttcactcattttcgttgtttttgacaacgcttctataatcgaatcttcttcataataaaaatcttctcgagcttcttcccatgtattacccgaaatcttttcaaattccgccttaaattcctcataacgcccatctttcaccatttgacgttctaaatcagctatccaagggatcgagccacaaaatccttgcatttcattaaatactttattaaacacttttacaattgcatttttatccgactttgaatccgattcgcttttagaatcaatattaaaaagaattacatctgttgttgtatttccggccagtttcatatctgcgaggaccatcggatctaatattttattattaaaaaacgaaatggcatctttattgatttcattttcatccattacatgtttattctctaataaataagaaaggatttttaagaagtgtgatttaccagatccgaagaaacctgaaatccaaactcccattttatccgtatgccccgtaataccttttttatatgatttaaagaattcacccatatgatgtaacaactcattggttacgacatactcatctaattcttgataaatatttttatcatcatcttgtccaactttaataacacccttaatatcacggttaatctctttttcaaacattttttgaatttgcatatactacctctcctccaattctctctattatttatcaatcaattgaaatgctctatagtaattatcatctttgatttcaccaaataatacgagctccagtccatcatatgtgcctgggaaaaacatcactaacggtacattgtcgactgctttatgtaagttatttaatatcgtatgcgagcgaatgattggaaacacttttcctactcctgtcaaaaaaacaatatcattaggttgtactctatctgtaatatactgcacaactaaatcattgttacttgttagacgcaaagcttttcgtgtcgcatttaagataaagtcgctcccttttttttgctccatatcgatatttttttgcaagtagcctttttcctctaatatttctagcatcacttcatataaatcgaattctcttatatgtagagaactatcattttttaaccgttcttgcatataaacaatatgttctctcacaagcatctcgtatttcggatcataatcaaaaatataaaaccctatctcattgcctaatcctttattttcacgaaaggatgcatctgtaattttcggtaaaatttcatctagacgttcatttattcttctcacactattcacctactaaaatatccatatatataccgtcacctaatgcgcgtatatgttctactacatcaatatttaataacggtctttcaatttctcgattacctttttgattctttaaataaccagcttcaaataatattctaatgtacacttgtttcaatttataaaatgtataatcattccatgatgcaaccttttcactttgctgctgtttattttcaaagaatatattaaaatcagcatctgtcagaaaagtttcaccaaaaacaaacttctctttaaacacttcattcataaattcaaaaaataaacggtctgttttcataatggaatataatacaatagccttgctggattctatatctccatgtccaatttccctaattaaataatcatctaatatttttaaacgggccaaaacacttgatgcaatttccttttttctcgattccgtattaacttgaaaaatattttctgaaatcgccttttctttcacttcgaactctttaaaccctttatttaataggattgaaactttcttcatctctaaaaacagaagtggacgggacttaatagttgacttataaacttgctcttttaccattttttcacattccttcgggccacttttttgatatttctattgtacccttttaagtaaataaataaaagaaatttctatattaaaataaaatctagcattatttacgtcacatatataattacttacagataaacaaatataagaatattaatcactaaacttaaccatccccccataccacccactactctcctccaaaaaacccctcgtctccccactccccttataaaacccctcccaaccccgctccctcaaaatccccttccaactatcactctcaaccatcttcttaataatgctatcccaataagcaacctcttcctccgtcatatcttttgggcccataattcctttccagtgctggaatatgacgttgattccttgttctttccatgttgggatttctggtagtcgatctagtcgttttggtgcggatacggctagtatttttattttgccggatttgtattgtttttcggcttcagatagggtcatggttgcggcgcttatttgtttgttcgttagggcgtttatgattttttctttgttttcgtagacgaagaattgtagttcggctgggtttatgccgaatgctttgcttacttgtacgaaggataggtgatcgtcgtttcctaggccgggggcaacgccgattttgaagtttttcttgtcttgttttagttgttccattagttcgtttgcgttttctatgtttgattcttttgagacgacaacgacctcccaatccgacgctaatgttgcgatcggtgtaaagtctttatatgttagtttactgtggcctagtagattgttcgttatgagtaagcttgagttaatcgccagtacgtgaccgcctttttgtttcgtatatttccagccgacatcaccgctgccacctactttgtttgtgactgtgattggttttgtgaagattttttcttccgtcagtgttttttgcatcgctcgcgctgttaagtcccaccctgctccttgaacatttggcgcaacgatttctactttgtcgatgtttactgtatttgtttgggatttttccgaggaacaaccagctattactcctgccatgatccatatacatagtaataatcgctttttcatagtcctcgtcctattcggtattttcgttctggtcgtccgattattccgtatgtgtattctactgtacattcgtttgtcgccactaagtattctaaatatcttcttgcggttgttctggaggcccccatttgttctcccatttcttctattgtaattccctcttcgaatccttttataattcctttcaccttttgcagtgttaacggatcgacacctgtcggtaagtttttcatatcttgtgtttgtgaagtgccaaaaaagttatcaatgattgcttgattcacttcattgctactatgtaatagttgcttctttcttttatagtcttcaattgtgcgaacgaacttttctaatgtgactggttttataaggtagttgcttacgccgtttcgaattgctttttctaacatatggttttcattcgctgctgttaccataatgacgtcaacgtttggaaagttagcatggattttcggcaataagtctgtaccaattccatctggtaaatagttatctaatagaagtaaatcgatttcttctctttgtagtagctctatcgtctctttcgcgttcaatgcttttccgatcacttttacgtcctttatttttgataaaaactcctcttgaatttgcgcgacgcggaaatcatcttctgcaattgcaaccttcaacatatgcccatccccctgtttgtcatgtactttctttcaatgttttcggaaggtaaattgtaaaaatagctcccccatttttctcattttgaatttcaattgttccttctagtacatctaccatttctttcacgtttgctagtccgtaaccacgattgtttcctttcgttgaaaatcctttttgaaaaatggttgtgattttttcagctggtattcctactccgctatctatcacttcaaacacaatatcgtgcccaatatccgtaacgaagaaggaaacactcttttcctctcgttcactcaccgcatcaaatgcattgtcgattatgtttccaagtatcgtaataaggtgcgaaacttttatatggtctggtaacggatgaagtgcactatctccttcaatatgaaaatcaattttcttctcagacgctgttccgagttttcctaataaaatagcttgtactttcgcatcatgaatttgatggaataaaatatggttttggctttgatgaatattagattcttgttggataaattcaatcgcttctctgtagtgccctaactgaagtaatcctgataagacgaaaagcttatttgtaaattcatgtgtttgagcgcgtaagtcctcggaatactttcttacttcagatattgtgttcacaaggtttttcagttctgttttatctctaaaactacatacaatgcctaccgtattatcattttcgagtattggtgtcatgtttaaaataaacactttatcttgaaatgcgatttcttgatcgttttctagtactctctccatatgaaattcaggcaaaacttttgaaatgtgctgctgcatataatcatcatttacatgcagcatctcttctgctgatgtgttcatcatcgtaataaacccgttttgatcaatagcgataactccttcttttatagatagtagtatcgcacttcgttcccggtatagcgctgcgatttcattcggctctaaaccgagtgtatctttacgaatactacgtgctaaaagaatgccaccaacaacgcctgctaataataccgctaaggaaaagaggataatttctttcgttctactcaatatgttagattcaataccttttattaaaaattctactgtcacaacacctacgacttgatcgtaatctccgttatgaacaataatgggtgctttcgccattaaagctggaccactttcaccatttccttcaagcgtataataaccaccaaaagtgagtgcttcatagttatatggattgttactctttgtaccaatcaacttcgaattagaattcgaatacataatcccatagcgatcttctataatgacagtatcggcaccagcttgctcacgaacttgttccgcaatggattgaatcgtacttttatgctcgttattttgaaaaacatcttttatagcaggcataaaagaaagcgacttcgctgtttgcagtgctagctgctccacttggcgcttcgtatcaacggactgaatgtaaacaaatattccggctaataggagaacgacaaataaaattaacgcgataattaagcttactattttcgtttgtaatgacactttgcgtgattttttcataccccataccctttgatgaaatattcaaaactatcaatctcctttttctattattatgacaaaacgaataatgaagcaactattaaaattatccgtgtacataaagtacaaaaagaataaaattgtcataatattgagatttcattctatagacagtacaattcaaatacaatgaacacgctttcataattatcattttatttataagcaagaggaggaatgattatggctcaagcaaaatcaaaccgagtcgccggcaatattttcaaaggttctgtcggcaatttaattgaatggtacgactggtacgtgtactctgctttcgctgtttacttctcagcagagttctttcctaaaggagatccaacgagtcagttactgaacacagcggctattttcgcagttggatttttaatgcaccctatcggaagtttattaatgggacgctatgcagatcggcacggacgccgggcagcattaacgctttcgattacagttatggcaggtggttctttcattatcgcctgtacacctagttacgaaagtatcggtattatggcaccaattattttagttcttgcccgtttgctgcaaggattatcacttggcggagagtacggaacttccgcaacgtatttatctgaaatggctagtagtggtcgccgcggtttttattcaagcttccaatatgtaacgctcgttgctggacaaatggttgcgttaggcgttcaaattgttcttcagcaattactaagcgaaccagatatgaaagcttggggatggcgtattccattcattattggagcgatgggcgcagtagctgtattatggcttcgccgcacgatggatgaatcggagcaattcgcaaacataaaatcacaaaaacgcgaaagcgcaggaactgttcgtgctcttatgaaacacccgaaagcagtattaacagtagtcggcctaacactcggaggcactgttgcattctatacgtacacaacatatttacaaaaattcatggtaaacacagtcggtcttccgaaagaagttgtaagctggattaactttgtcgcactacttatattcgtcgtacttcaaccgattgcagggctactatccgataaaatcggacgccgtccactattaatggcattcggtattctcggaacgttactaacagcaccgatcttcttctttatggaaaaaacgacagaaccaatcgtagcatttttacttatgatggtcggccttattatcgttactggttacacatcgattaacgcaattgtaaaagcagagctcttcccaactgaaattcgcgcacttggcgtaggtttaccatatgcactaaccgttgcaatattcggcggaacagccgagtttatcgcattatggctaaagagtatcggaatggaatcactattctacttctacgtagctggatgtatcgcgatcagctttattacgtattggcgtatggatgagtcatcgaagacttcgcagattgaggcggagcttgatggtggggatagtttgaagaatggtactagttcaaaataaaaaagtaaggacggtcaccttggagaaggtggcctttttatatactctctcaaccaatcccacacccccaaaaaatatatcaacgattatccaattatatcgaccgcaactccgaatatatcgacgattcgacacaacatatcgacttaccgacaaatttcgcaaaaaacagcgccaaaaccaccaaccaatcccacaccagcacccacgcccctacaaaagaaaaaaacaccaggtccccccagtgcttttccccactctaaaacaaatgacaagccacctcatgccctttcgcaatctccaccatcttcggtacttcctgcgcgcatttttcagtggcgaatttgcagcgtgttctgaatttgcagccggatggtgagttgagtgggcttggtacttctccctctagaatgatccgatctttccctatttttgttggatctggttctggcatggatgagagtagtgcttgtgtgtatggatgtgccggttttgtgtataggtcttcgctgtcggcaatttctactatgttccctaagtacataactccgattcggtctgatatgtgtcttaccatggataggtcatgtgcgatgaataaatatgtgactcctgtttcttcttggatgtcttgcagcatgtttacgacttgcgcttggactgagacatctagtgctgagatcggttcgtcacataggatgaaatctggttttacagatagtgcgcgcgcgatgctgatgcgctggcgctggcctccgctaaattcgtgcggatagcgatatagatgttcttcttttaggcctacctttttgagcaggtctaatatgatttctttttgttcttctttttcataagatccatgaatgttcattggctcactaataatttggaatacgttcatcgacggatttaatgatgcgtatggatcttggaaaatgatttgcattcgttttcgatattcttttagttcactttcctttaagcttgcgatgtcttttccgtcaaataaaacattacctgaagtgacatcgtgcaagcgaatgatacttcttcctgtcgttgattttccgcagcccgattctcctactaatccgaatgtttcaccttttttaattgtgaaacttaagtcatcgactgcttttaattgctctgtttttctgccaaatagtccttttttaataggaaaatacttttttaagttccgaacttcaattaaattttcttcatgcatggaaatcacctaccgccctatcatttaaccagcacatggaacgccttccgtctccgatttcaaaatacggtggacgttctttttcacaaatgtccattgcatgcggacaacgctctgcgaatgggcaaccttgtggcgggtgtaataagtttggcgttacaccttgaattggcgcgagcctttcttttacaccgttcgatattttcggtaaagagtttaatagccccttcgtatatggatgattcggcgattggaaaatatcaagtacagatccctcttccataataagaccgccatacataacgataacgcgtgtacagttttgcgcgactattcctaagtcatgtgtaataagaagtaacgccatattcgtttcattttttaagtttttcattaaatctagtatttgtgcttgtatcgttacatcaagcgctgtcgtcggttcatccgcaatgagaagatctggattacaagacattgccatcgcaatcataacccgctgcttcataccgccgcttagttcgtgcggatattgttttaccctttcttctggcgacgaaagaccgacttgttttagcaagttaaccgcaatctgctctgcttctttcttttttactttttgatgccgtataattacttccgtcatttgcttcccaattttcacaactggatttagcgcagacattggatcttgcgagataagtgaaatttgatttcctctaatagaacgcaattctttttcagatttagaaaggatgttttcattatgaaaaagaatctctccttctttcactttccctggtgatgcaacgagggacataacggacttcgccattacactctttccgcttccagactccccaacgataccaactacttctcctttatttaaacgaaatgtaacaccacgaacagcttccacttctccactttctatgaaaaaagaagtctttaaatttttcacttctagtagtttttcagacacgcttctcactcctttcacgtaacactttagttttcatttccagctccttttggtgcgaaagctttcttcaacgcttcaccaattacgttaaaacttagtactgttaaaagaataaggaatcctgggaagagtgttaaataccaagcttcaccgatatatccttgcgcattgtttagcatactgccccaagaagaatctggttctctaatacctaaacctaagaagctaagtgatgattccattaaaattgatgtcgcaatcgttaatgtcgcggcgataataatggttgataaaatgttaggaatgatatgtcttacaataatcgtgagtgatttttgtcctgacacttttgcatataaaacgtactcacgctcttttacagataaagtctctgctcttacgatacgagcggtgtccatccatgttagtaatccaataataagaactaacgtcgtaatccccggttttaaataagcatttaataacagcattaaaaaaaatgatggaattgacataagtacttcaacaactcgcattaagaagttgtctaactttccgccaaaatatccgctaattgttccaactgcggtaccgattgtaacagatacaaccattgcaaggaaaccaaccgcaagtgaaacgcgtccaccatataacgccctcgttaaataatctcttccgtaatcatccgttccgaaaggatgactcatactcggttcttgtaagcgatctggaatcgacattttactaggatcatacggtgatacaaatgcgaatatcgatgcaatcgttaaaaccgccagtataataactcccattagtacaaacttatttttcgtaaaactactttttatcgtttgaaatctcctattattcattccaaatcaccccctcattcgaatgcgcggatctactacgccatataaaatatcagcaattaagttaccgagaattaacatgaaggatgatagtaatgtaattgccataataattggataatcaaatctaaaaatagcatttaccccaagtgaaccaagacctggccatgaaaatactgtttccgtaataaacgctccgcccactaaacttggaatagataatccgaaaattgtaatgatcggtattaatacatttcgaagtacgtgattaaataaaactgttttcttcgaagcaccgtacgcatattgaatttgtacatagtcttcttctaattgttgaattgtactggaacgaatatatctcatataaacagaaacgttttggaacgcaagcaccatacaaggtaaaataccgtgctgcacaatatccaagaaggaatcttgaccgactgtacgcatacccatacttggaagaaggttcaactttaaagagaataaatagattaatagtaaagcgaaccaaaagactggcattgagattcccacataagagataaagtttacaatgcggtcaaagaacgaattctttttcacacctgtaaatagtccaagtggtattgcgatcacaaatgagacgagtaaagacgatcccattaagccgattgttgcgggtaatctttctgcgataagatctaaaacaggacgatgattttgaagtgagtaaccaaagttccctgttaaaatattttttaaccataaaaaatactgcacgtaaattggttgatctagtcctaaactttttcgaatacgctcaacatcaattggactcatatttggtgtgacaaagtttcgaacgggatctcccggtgctagttttattaatagaaaagaaataatagaaataacaaataaaagcggaattgcatttaaaagcctcttcgcaattactttatacacaaacttcccccctcaagctaaagaagctgatttccaccagcttctttactgtttgtttcttatttcacttcataaatcttagataaatcttcaaacattgtgacaggaattgcttttgcttcttttaatccatcaaactttttatctactgcaataaccgctttcggatacgcaattggtagataaggtaaatcttctctagctgtctcttgaattttatggtatagttctgcgcgtttcgttttatctgtttcaactgcagcttcttcccataacttatcgaaatcagcgtttttatatcgtgcataattgtattcagcattacttaagaataagctcttatatgaatctggctcaggtcccattatgtaaccaccaaatgtaatgtcatattctttattctctttatctaagcctttttcacttgccgcactagcatctaatgcatttagttcaacttctaagccaacttcttttaacttttgttgtgtataaagcgctaagctttccataatcttattattcgttacatacatgacgcgtactttttctttatctttcacgccagctttcgctaataaatctttcgcttcttttttatcatacttataatctttaatgtcttttgcataatacatagcgtctggcgttaaaattgaatttgctggttctgcaaattgactagaaacgaatgcagagttaatcatttcttttttatctaacgcatgcgcaattgcttggcgcacttcttttttcttcataagatctgtattttggttataagataagtagaataatctaccttcagggaatgtcaccattgagaagttcccagtgctatctaatttcttaaagtcttgcggctcaatcatcttcatattgatttgaccattttgtagtgaaacatttgctgtattacggtcttttacaacgcgatagacgatagagtctaatttagctttaccacctacataatcatcaaatcgatctaatgcaacatactcatcagacttatactctttaaacttaaacggacctgatcctacaggttgtaagtttttcttactcttcgctaaatctgcttccccttcaaatacatgtttcggaattgggaagaaatcattcatcacaccttcaaaagatgcgcttacttgtggtaaaacgaattgaactgttaactcatctacttttttcacctcaagcggctttcctttaaaaacaaagttttcacgacttgagctattttgcttctcatctaaaatagattggaatgtaaatgctatgtcgtctgatgtaattttcttaccatcatgccatttcaagttatcttttaattttaacgtccacgttaattgatcctctgaaggcgtaaaactttcagcaagaacaaactttttcttaccgtcttccatatgatacagcggtgcatataaagcttgctgcacagttaacgacacacgatcattcgcataaagcggattcatcgtctctgggttatcgctaacgccaatcgttaatgttcctccatctttcggagtccctgatttactagtgcccgcttgcttcgaagaatcttttcctccagaacaagccgctaatgcaataagtagtattaggacaaatggtaatgcaaataattttcgtttcatctttcggccccctcaaactagttatacccataagaaaactcggaattaatcccgagttttcttataagttttaaattaccactacctctatataaagtcaaacttttttgtaaaactagaaggtttgaaatctattcatgcattcttgcaataaactatattgatgcgaagagcaaaataagttaaaaaactagtagcctaaaaaatttctcttaaatgattgttataatcgaaagaatcgaatggatgttttatatacacctaactcttatgaaaaacataatttccttatcaaaggaattcaacttattacatagaaaataactatagaaaagaaaaagcttgaccaattggggagttcacagtaaaaacaagaaaatgttaacaagaagaaaggaactaatataccatgtccacacaatcttctgttcaaatggatgaaatgctaaaaattttatttcatttgtcaagaaaaccgaccattcatttagttaacggactatttcatgaagcatttgaactacacgaccaactgactattacacatcttaatgtcgagtatactcaaaaacgtctaacaaatagttatcaaacgaagcgatcagataaagttcttcaagttaaaaacaatgatgatgtttttcattatcatttagaatttcaattaaaaaatgattcaaccatgccttatcgaatgtttgattatggctgttgtattgcggaagagtgccagaaatcgataggtacttatgataagttcgtctttccaagacagttagttctttttattgaagaagatgaaaaaattccagattttctttccatggaatcgcattttacaagcgggggattccattatcaagtacctgtagaaaagtattggaaacaggatgtcaatcaattaatgaaaagaaatttatatgccttattacctatacagccttttaattaccgaaaaaacttaaataaaattttggatagaaagccatctaaaaatagagatgaggaaatccgcgcaatcttggataagattcaagatgaggtgaaaattttagttgaaattattataggttattataatagagatgaattaacatttgacgatacggataaaatgcttattgtattaacaaatgttacggagcatgtatttcaaaaaaacagtgaatatcatataataaaaaaggaggtggataatatgattaatacattgtggagtcctgttaaagaacgtaaagtacgtgttgaagcgttcaaggaacttatatacgatgtcttacaagataagaacctcgatacccaaaatgaagagctacgaacaaaattaaacaaaattgatgatccaaatcagatgaaacaattagctcgccgagttcataatgtaaaaaaaatagatgatttattttccaaataataaaagggactaatcctaaggacacgtaagttttttttaagggttagtccctagccataacggctatctttttcattactgataatatttagcgcttgtccaacaatatccaactactccacctgtaaggaaagataacccatagtagcaagctgatacagctgcgggtcccaaacaataccggctgcagaatatcccatgcagcaattccttgagatgctaagcaattgttaaaacctcttagaaaatctacaaaagaacctcctgcacttgcagtttttacactaaatggatttaacgagctcaataacccctcatcttcctttttttcttctttctcaaaatgttttgcttctagttgaactgtattatctaaaactttttcattgttgttccaagtttcaattttcactttatagaattttaaattctctgaatatttttccatataagactttaattttccatccgaatataaatctcaccttttatcattctcttcgtgattaccccctctctctaaacaaccaattccacaaccgtataaaacaccccaaacaaaaaaagaccaccaaaaggcagcccctctcaaaactcaatcctctccccaactccgcgctccaccgctctctcatacaaatacttcgcaacaattatatccactaccgccaaaccaaccgatttaaaaacagtaatctcttcatcgttttcgcggccggctttttctccgcttataatttgaccgagttcggcgtggaggttgctagcttcgaatagaccttcttttatcggcacttgaaggtcccctgtttcttctagtgctgcttcttttgattcgactactactttgtttgcattaccaatagcgtgggatggtagttcttgcatacttggcctgaatgaaccgacggcgtttacgtggacgcctttttgtagtttttttgagaagactggtgtggatgcgttcgtagttgtgacgatgatgtctgcttcgcttattgcttcatttgcgtttttgtgaacataagtaggtgtattgaatctcttttgtatatattgcgagaatgcatatgctttttcttctgttcggttgtataacatgactctttcaatatgtctaactgcaaatacagcttccgcaattcccttcgcctgttctcctgtcccgataatacataacgtttttgcggtatgacgagctaaatgttttgtcgctactcctgataaggcgcctgttcgaatcatcgttaagtacgagccttctaaaagtgcgagcggttctcccgtttgaaagtcggatagcatcacaatcccgtttatcgttttctttcctatctttttgttctcgagcactactgttactacctttaagccaagtgcctcaagtccttccgctactgagggcataattaatgcagtatttttctcattcgcaaatggtaatgaagtacgtattggcgtgattgttctttctgcggaaaactcttttaaggcaagcgccgcgtatgcaatgacttcattcatatttactaagtttcgttgttcgttcgcgcttaggactagcatatctttccacctccttcttctatcctaacaaaaatccccgattcaaatcatctctcgggtctacaacgaactgatgaaatcctgtaataaatgcatgccccgttactttcggaacgacagcttcatatgtatgtaccgctgttaccgacaatacttccccttcaaatttcccgtcagtaatacattcgtggacgaaaatttctcctttttgcagagcgcctttttcaaaaagagttgcgattcttgcggaagttcctgtgccgcaaggagaacggtctacttgcccatcagcgaagattgttacatttcgtaacgttgcgtcttcccctttcggttcatctgagaaaataacgccgtatattccttttaacccttcttcaagtggatgcttcacttccatctgactctcaatgtagcgcttaattttaccgccccacgtttgaatagcagctaagtctttaaaatcaactttcaaacccaattctttactatccacaacagcgtaaaaagctccgccaaatgcgatatctacttgaaactcatagttatctattttaataggaacgtcttttttgtatacaaatgaaggaacgttttcaaatgatacggactctacttcactccccctatatgttgcgcacgcaatgacttccccagcagggctatcaataataaacttttgttttgtttcaaacataccagtttcaattccgactgtaataacagcgataatgccgtgtccacacatcgtactccatccttcattgtgcataaataacacaccaaaatcagcgtgagcactcgcaggcggagtaatgatacaaccgtacataccgtgatgtcctctcggttcatacataagaacctcgcgaagatgatccaaatgttccatgcagtatgcccgtctttctagctgcgtttctccctttatttctggcacgcctcctgtaataattcgaagtggttccccagctacgtgtgcatcaattgttgtatacactttactaaccttcatttccatctctcccctatatgttgatactctttttattgcaaatatcatgccaacgcatagggtataaatttgtatacattgttaaaaaaaaacatacactactgtctatttttttatacacggtcttgaagctattttatggaacaccttgatacaaccggtcttattattttcaatggaaagttacttccacccccaacatatactgttcaaaagcaaaaaggaagtgatctcatgtattacggaacaaaaggctggtacgtagccgaactaaagaaattaggcgtgcgttatcatgaaggacgcaaactagaaagttaccgcggacacatcttgcgcaatttactacttgcacaacaagagaaattaaaagaacagtaatatactaatgtaacgatatcgacgattctcggaatatatcagcgatttcacacaatatatcggcgattttttaaatttatcgacgattcgacatggaatatcgacttaccgacaaatttcgccaaccccctcctccattccaccaaccaatcacacattcatacaaagcaaaaaaaggtcacccaaacgggtgacctttcttccttattcacaaacaagaatttgtctagaaaatgttcctttttttgtagtgcagcgatctataatttcaaatcctgcttcatgaatcatatcgtccattgtttccattgtaacaacgactacctttttagcaatgcggcgcgcgcttgaaagaatggagagctgattttctggtgttgcgtgcgtaaataagtcatatggcatgtcgataattgcgacgtcgtaattatccgtaatctcctcgatcgggcctttcgttatcgtcccatcgaatccgaagtgtgcaatattttctctcgctccaatcgcaacgagcgggcttatatctctaccaacgatgttaattcccatcgaaagagcttctactacaaccgttccaatgccgcagcacggatcaatcgctcttactccctctggatttggcaccgcaatatttgcaacggatcttgcaacgcgtgtgctaagagatgtcgaatagctacgtggtttttttatatgatggtaccaaactggcttactctctacataatgtccaaaataccaacgtccgcctaatggaacaataccaaaagtacgctctggattgcgcacatctgcttccgcatcaatacaatccccaatacgtcgttcaatgatgcgtctttccgcatactctattttattttccccctcaaggtcattgattttcacgaagataactttaaacgtcatttctcctaattcaatttcctttacttgttccaaaatactttctaagtcgtctccttcatacataacctcaacgcgctctttcataaaaggacttctactcgggtcaattttgacatcacttttcaaaatattaacgtgggactccattccaaagaacgagcgcatttccaagtaacataaagcacgctcctcctcacgaaatgcatacgtatatatacatgcaggtgttttcctatgattattcaatctatgatcatcctctatatcgttataattacaatactttcttatataaaattaaatgatatcacatgcctgaaataaagagaaacgttaataaataaaagagactgcctattggcaatctcttttattgtattaacggaaagaagatacgttattaccctttgcttcataatagtctaaaataccttgataaatcgcttctgctgcactttgtttctgtgctggtgtagcgattttatttgcatcattcttattatctacaaatgctaattctgctaatacagctggcattgtattatattttattacgtaccaattatcctttttcacaccacggtcatatgtcccaagtgctgctacaaggcgtttttgaattttttctgctaataagcgactgtcttccgtatgtggattcgttgatcttgtcggtgctgctgcataatagaatgtttctgtaccgtgtccatttttttcatctgaaccgttaccgtgaatacttacgaaaatatcacccttattttcattagcaaattctactctttttcttaaagaatcactagaatctactcctgggcgtgtatcgttcgtacgtgttagcttaacagtaaatggtgtctttttctcaaatagtttttgtaatcgtaaagatgtatctaatacgatttgactttctttctcgtaataaccaacattacccgagtcaattccaccgtgacctggatcaataataatcgctttaccttctaagaagttctcttgttttactggtgggtttaattgatttttatcaacccactggaaaccagcgcctacgcggatacgaatccagcttccactctcttccataatcgttactgtttgtgcattatatgtacctagcactttagaactatgtgaagctaattcatatgcagtaaagtcttggttaattgtttctgttttttctgttagaggtgtccacttctcacctttacttgttacaatttttaaccagccgtctgctctttgttctttcactacaaccatttgtggcttatgctgaacatcagtaataccagatgataatgatggttgatgatatgtaataaagtttctgttcatatacattctttttgatgtatctgttttattttgatcagccatcgcaataaactgagctgcttctgcacgagttacagttccttcaggctcccagccatttcccgtacctttagaaatctctaaagctactaaaatattagcttgtttcttaccccaatgaggttccaaatctttaaactgtgttggaagttctccaataattttcttatctaatgagtatgcttgtactaacatagatgccatagatgcacggttaatttggcttgatggattaaatttaccagtaccatctccactaattacacctgctttttccactgcagcaatgtacggagctgcccaatggttttgtgcatctttaaaagatggctttgcttttggatcaattggtaaaccaagaacgactgctaaaatttttgcagctgaccctctatctactgcttcagatggagaaaacgttccatctggctttccatcaagcgccttttttcctactaaataatcaactgattgttgcgcccatgaagggacatccgaaaacttcttcgctactgcgaaactacttactggagacgataataaacttgcggctaaaatacctgccgcgactgcacgatacttcataaaaaataatactcctctcgacaatcatcttttaataacgcgtaatcttaatatataaatctcttcaaatccgaacaaaaaaaattagtgcgcctctattattttataatactcgaattatgtagtaaacctaatttcttaatattgtaaaataaattacaattaatttactctttgttaaataaagtcgatttctctgcacacaaaaaataggctactagaggtagcctatttcttttcttattctgcaatcatctctgataatacatatgcataaacaagtgcttctgtatgagcaatcgaactttcatgtgtacgctcaaatgcatgagaagaatcaatacctgctccaattaatgcatgcttcacatcaaatccagcgcgaatcgcagctgatgcatccgatccatagtacggataaatgtctactttatattcaatattgttcgtttttgcaagctctactaaatgtttacgtagtgcataatgatacggaccactagagtcttttgcacaaatagatactgtatactcgtcagatgcttgtccatcacctagcgctcccatatcaaccgctaaatattcaaccgtttcttctggaatattagagttaccaccgtatccaatctcttcattgttagaaattaagaaatgagttgtatatggtaatgttacgttttcgtcttgtaatctcttaattaattttaataggatcgcaacacttactttgtcatctaaatgacgtgattttatgtacccactctctgtaatttgaacgcgtggatcaaatgaaacgaagtctcctacttcaattcctaattcacgtacttcatcagctgaaaatacgcgctcatcaatacgaacctcaatatttttctcatcgcgtttcgcttcacctgcatctttatatacatgtacagatgtttgatgcattaaaatcgttcctgtatacgtcttaccacttgatgtttcaatttcgcaatattccccttctacagagttccagcgaaatccgccaatcatagaaagactgagacgaccatctggcttaatttctttcaccatcgcacctaacgtatcaacgtgtgctgttaataaacgatgctgtgcatcatttttcccttttaccgttaaaataagagcacctttattgttacgcttcgtttctacattccactcacttacatagttttcaataaaacgaataattttctctgtatttccagatggacttggaatagagacaagctccttaatcaattccatcgtttctttcgtatgatgtgccattgtcatttcctcctcatttttcctattatttagtataccgaatttactataaatcctctactcatatagcttaattttctaaattatagtaaaattcactttagtatataaaaggagttatacaatatgaatatatcaaaaaaatatgtacacattacactcattttgtttctagcatcattactttgtttacaagtttcttatgcagttcatactactacttctattacaaccggctgggtattaacagctatcttcttcattattagcttaattgcaacaaaaaagcatagcgttaatgagtaatgctatgctttccctacaaatctattcttctgaaacatccaacaagtaaatacctctttcaaacccaccgcgctctatctctttctgcttacgaagacgttctacatcttcaattgttgcaccttctgcacgcgctaatgatatgattacttccagtgcatccgcaagagaatcaagcgcatgttcacgctctttcatagaagcaaattcacgaatttcttctgttccaattttcgctaaagcttgtatgtatgcttgtcctgttaatttttgtgctgtatatgtttttccagacattaagattttctctggaacacgatctcttactaacttgttatatgctgacatcattcatcctggtttaaaattcttataaaaatctataaattgttggcgaaccaagtcaaatgccaactaccgaaaaggaatctcacctttttcctgtccgtaagatttgtgaccttttcatccacctattgtgaaagaatgacggcaggttcctgttaggaacgatctgtccttacatactaccattcatccaagtcagcaatatgcaagaggttataagaaataaaccagtacctcccttctatatttaaattttaaataataattgttgattgttcatataaacagttttgtgaagaatactccacaatttccaattatgatgatctttccatgttttaatcgtttgtagccattttttatatacttttttcgtattcgtatccttttcgctttcttccatggaagcgacaagaatacggagttttattgtaattttgttttttaataatagaacaacttctttaggtaatctttcttggaaacctaatccacgtcttgcgattgtgaacgcagcggtttcgtgaacactaataccaaactttttactatattttaattttccgatcacacttgtatagacaggatttactgttttgacagaaaatccgttacgaagagccatacgaattaaactatccaacatttttttatacgtaaattgatgaaatttacgattgctgtatttatcagtatcatgagactgttggaatttcaaatcctctaaaacaataccacctacattgttttctattaaccattttttgatttgttgtacgatttgtccgattactgttgtgcgtttgtttgttgaaaatgtatcaagattgtgtaagtaaaaaatcttcgaacccttaaaattaccttgttttgtacataaactaactgcaatgcggtccggatttacatcaattcctgcaattacatctgattgtggtgtttccttgaaatctagtacacgacctatttctgtttcatcaaacgtaatatttacataaaattcattttgtttacgaatgatttctacactatatttttgatgctctataatcggttttccttttggatttacaccgatttgctttcccataacgacatttgtgatttgatgataaaaatgatatggaatgataatcggaactttgattcgtgggctttttgtttttccatttgttcgtcctaatggatttgcaatttctaaccatccttgcccacaatcatcaactgtaatgcgcatgttcaaattcccttttttacttttatctccgcgagaatataattgccttgtacgtaaatctttccattcttgattggatatcttatctttcattctttcatagaaatttttccgtccaccaaaaataataggaggtaatgttccatttttaatatgtgtttcatacatttcaattttttgttctaatttttgttgtctttttcttaatccaattagacacatttctaatgaaactttttttgggtttttcctgccactttcataatcatcttttttttgtaatgttttttctaattttttttgattgttttctaggtaaacaggaagaagttctttttgggaggaaaggatggtttgtgcttgcaaaactgcatcttcacaaaagcgtttgtttaacaaatatttaagttgtagttttttaatcaattctttctcgttttctccttcaattaaacgattaaaactatatcgttttgcactttcgaaggtgcgaattaaagaaattaaatcttctatttgttcttttgtaatagaattgatcttacaagtccgcgttgttttcatccttttcacccttttctaatacggattttattgcattttctaattttctacctcctcttttcccatgaatttttgcagaaaaagaggttgtgattgctataagatcttccactaattcggattcttcgtttttttcaatatgttctatccgcaataaaaacaccttctttatcccaattccgtaaagtttgttgtgttttacctaatatgtttgcagctttcccaattgaaatataattcttcattttcgtcacctaaaaatattgtatgttaaattctgtaaaatgcacaacccgtaattataaaattttagagtgttttataaatttttgtttactgttatttcctcctatgtttaatagcagccgagctctgccttataaaataaccactcttttttcacacaagcacttaacatatcaattcctgatccgtgtgcccttactgccggaaagaaataatgctctggttcttctttcttatcgccatataaggtttggtactcatcaggaatcgcctcttttttcacatcccgttctttctccacttcacctgagaaagcaacaattggatgcccttcaaagaatagtgcagttcgtaccgcaagagatggtgtactatgcaaagcataatatgtaagtaaaataataacgataacaccaataattttcttcatatattactcctaaaaaaagtgctaacacaattatactaaaatgtgttagcactttctcccctttaccttaaattaaccgttagtaaaactattactacactttattctcctttaaatgctggcaaacgtttttctaaaaatgcagcgatgccctctttatgatccgctgtttgtctcatcgcatattggccgcgtttttcaagctgcagtgtttgttctaaattagaacggtttacttcacataaaatttgcttcgtttgaatcatcgctttgatcggcttttgtgaccattcactaattttttgcttcacagccgtttggaaatcctcgccgattacttcatcaattaaaccgatttcaagcgcttcgctcgccgataatttctttccttcccaaataatttgcttcgtcatattttcaccgacgcgtttttgaaggaagaaatggccgccaccatctggaattaaagcgattccaataaagttcatcgcaataatggatgatatatctgccatcacatagtcagctgttagtgcaatacttaatccaagaccagcagttggtccatgaatcgcactaataacgagctttggcatcgtatataaagtcacaacgacttcagagatagtattcataattccatcaaacttgctttcatcattacttgaaagcatcgatttaatatctccacccgcagaaaaaccacggccgttcccgcataacacaacaatgtgtgcagaactctccgctacttctttcagtttttgtaataactcttttaacgttggctcatctaatgcatttaacacctctgggcgattgaccataaccgttgcaacgtgcccttcatatttcacaatgacagattctgttttacttgttacttccattatatatacccctcttttctacacaaagattatacttatataattatagaaaggatgtgaaaaacccttcttttttcttaattttctgtctaataatctcgtaatttgtatatcaccttgcataaaacatacaatttcgttgaaaaatatagaaattaaagtcggtttatcccggctcttcatctatttaccattacaatgaaatggtgtattcttaagtctgatataaaaattaaatatagaaattcattccccttcctattatatagaggggtgctgaaataaaggaatgaagaaatggaggaacatatggttactaagttaaaacagacggataactacttcccgcatttcctactgctattcatcgtgtttcaaccaattttagatttattaacgtctttttcaatctatatattacacatgagcgcaacagtcggaatcgtagtccgtttcgcctttatgcttcttgcattaggttatctacttcttcatcataaacaacaaggcgcgaaaaagtacattctctatttatgtttactcggcattgcactggcaatcggtcttgtaaataatatgatggttaaatctccagtttcatttggagaagaagttaaatttattttaaagagcatatatccaattgtgctactgtttggatatattatcgtctttaaagagctaaaaaataaagaatatgtgtttcataaaatcattacatatttcttatatgcaactttaattttaagcatcacaatgattatcgcaatgcaaactggcactgatttcccaagctatcctcactcaaaaattggctcaagaggttggttctttgctggaaatgatttaagtgctctcttcgcgattatgttcccaatcgttgtcttatattcgatttataaaacaacttctttctcgaaaatatattactggattccaacaatacttgcgatgtatgcaagtattatggtcggaacaaaagttggatatggtgcaattgtgctaacattaggcgtagcacttttcttctcgttcattgaatatatgataaaccgtaaaaaagaaaaaaaaggattcacatatcttgtaaacaccatcgttgcagcagttgtactaggaggtttaattgttcttacaccgcatactcctatcgcaaaaaatatgggaatccacatgcaaatatacgaatacaaaaaatcagtacaagaagaacaggataaaaaagaaggaaaagtaattaaagaaaatccagaggatgcaaaaaaacacgcaaaaggtgaactaacagactctgaagtgaagagtttaatttatagtgatcgggacaaattcttaaaagtatacaaacaatactataaagaagcaccgctctcacaaaaactttttggaatgggttacgctggtaactacacagttaaaattaaattaattgaaatggacttccatgacctatttttcgcctttggaattatcggtttccttatttacttaataccacttctatacttcggtattaaactgttcatccgtatgatcacaaactttaagaaaattataactgtaaaatatatgctattatctagtacactcatcctatcacttggcattggctttatgtctggtcacgtattaacagcgccatctgttagcatttttttcatcgttatacttgcctacttaattgttgatttagaaatagaatagaaagaagcagcatctatttggatgctgcttctttctactccagtcataattgctttttctcgcttaattaaattttttgtggactactaaaaaagatcgaatcacatgaagattcgatctttgaaacaaaactatttctttctattgaaacgatgcatgaatctgctccagcacctcatcaatattatcctttgtaataacaatcccgaaatctttcggcacattacgatcttcttcatttacaactttatgtgcaattatctttccgacttctggtctgaaatgatgtccatccatatagttatctaagttctttgttactgaatttaaatacatgaaatgatgtacttctccaaatacatcgacagtatcatggagccaccttttataatcttcccaacgccctgattgaatcatcgcacggaacaatggctctgaaacaggagttgtaaaaatataaaacttcgtattcggattatgagattttacagttcctaatatttccttcatattttgatactcataattcccaccataaatctctctactaaatttatctacttgcgcggcaatttgtgtgtcgcgctcttctttcgtatactcacgcatcgattttatgttatcgcgattatatacatcaatagtcttattgtgatgaatggagttttgaattgtatttcgggaatatgtaatcccatccatactcacatacgatttaattggatatagtaagctttgtgcctcattaatatatacttctggcttttcaaaaccgatttctctatttttgttcgttccaaggaaatctaaaccaatcacaatagaagataattcactaccttttctctcttttgcatattcaatgtacgcatcgtactcacgcggatctgtactacttaccgcataattaaatgcgtttaatccagtaaaatcattctcattgataaacgttgttctactacttccaagtataacgccatcataagtaaacggacgatatgttatataattcgttttttgttgtctctcattaaacccaaactgaacattattccacttatttttatgagagaataaccaaagtgaatctgcatagccattaaatattccaacacctgcaagtggaacaaaaacacatacaaaaacgaaaataagccactgtttgtttttcatattctccacctagaaattaaagtataaaaactcactaatactcgttaaatgcaatacactatacacaagtaatattgcagtaaataacgccgtccatactgtcggacggaatgagtcttttaactgaattgaattttttaagaagaaactaatacataatgctccgaaaatatacgctactatttccgtatttaatagtgaaacatggtatgcttcagtaaatgaaacaccgtacccttttaaaaattgtagcttctcaataacaaataccgggaatacgctattggctagttcgaatccattaaatccaaacattccttttaacactttcaccgcatcatgcatcgatgttgctctaaagaatacccacgttatattaatgaagaaaaacgtcacgagccatcccgcccaggccggcatgcgccctcctgctttgttccacaaacgatgaacgacagaagctaatccgtgcagaaatccccagaaaataaatgtccaaccagccccatgccaaagtccacttattaagaagacaatcataatattgacgtatgtacgcgtaataccttttcgatttcctccaagagaaatatacacatatttcgttaaaaactggcttaatgtcatatgccaacgatgccaaaagtcttgtatactcaccgctttataaggtgagttaaagttttgaggcaatttaatgttgaacattaacgcaattccaattgccatatcgctatatccactgaaatcaaagtataactgaaatgtaaacgctaatgatgaaagccaagcttcaacaaaggttagcgactgctgtacatcaaacccttcccgtacgacaggagataaaacatctgcaatccctactttcttgaaaataccgatggcaaatacaaaaataccgagaacgatataatttgattgccaacgctttttactacgatccccaaattgcggcataatttgcgcatggtgtacaattggtcctgcaataagttgcgggaaaaatgttacaaacagagcgtaatcaagaaaatgacatgcctccgtttccccgcgatatgtatctactaaaaacgcaatcttttggaatgtatagaaactaatcgcaagcggtaacgttaatgataataatgtaaaatgagttccaaataacgaatttacattttgcaaaaagaaatcatagtacttgaaataactaagcattcctatattaaatagtaagcctactgttaaaagaagtttactcttatgcttcacgagcctcattccgataaagtagttcacaatgagcgatactaacataagcggcaaatactttatgttccaataactatagaaaaataaagatgctgccacaagccaagctttcgctaaagtagtttgtccaaatttatttaataaaaaatataaaagaaatgctatcggtaaaaataaaaaaataaactcaaacgagttaaataacacaccatctcttcccttctaaacaaatcacaccttattcatcttatcttatccagatagtgggtgtcaaaaggattccataccgcttttcttctattatatagaataattattttaatcgaattattaacatgctaaaatattaaaggcactattataaaaaagaatatataatagatatgtcgttttttttacgaaatgtatttcgaaaaagtgaggagagtcctttggtatttagtagttcgattttcttatttatctttttacctctcgtattatttctctattttatagtgcgtgccgagctacgtaatttcgtattacttgcatttagtttaattttctatgcatggggcgaaccacgtttcgttcttttaatgctcttttccatcgtattaaactactgcttcggcctactcgtgcatcattatgataaacgaaaaaatatgaaagtcacatttttaattatggctgtagtcggaaatatactattactttcttattttaagtatatttcatttttcacagacattttaaacaacatattgcacttatctattcatgtggaacctattccactaccaattggaatttcattttatacattccaagcgatgtcctatgtcatcgatatataccgtaaagatggggatgttcaaaaaaatccacttaacttagcgctatatatctctattttccctcagcttattgccggaccaattgttcgttacaatatcgtcgctgagcaaattaaaacgcgcatccattcttttgaacgattcacagaaggtattcaaattttcgttctcggactagcaaaaaagatattaatcgctaaccaagttggattcgtcgctgataaaatctttgccttaccaccatctgaaatgagtgttggaacggcatggattggtattatcgcctataccctgcaaatttatttcgatttctcagggtactctgatatggcaatcggacttggaaaaatgttcggctttgatttcccgaaaaacttcaactatccgtacatctctaaatctatttcagagttttggagaagatggcatattacactcggctcttggttccgcgattacatatatatcccgctcggcggaaaccgcgtttcaaaactagcgaattatcgtaaccttttcatcgtatgggggttaactggtttatggcacggggcgagctggacatttatcgcctggggcttatattacggctttattatttcaattgaaaaagctggattcgaaaaaatattaaacaaactatggaagccgctgcaacatgcatacgtattactaatcgttatgatcggttgggtcttcttccgagctgacaacttcgcttactcgttccaatatttaaaagcgatgttcggcataggtggccaatctttcatcgatgacaatacgatgttatacgtacatgaatacattatcgtatttctcattgcctttatcgcagcgacaccaattttaaaacgaatgaaaaacatactagaacttgcgccaaaaacgtatatgttcacaatgcaatttgtacgtcctatattattactaacattatttatgatttcggttatgtacttgattaactcaacatataatccatttatttatttcaggttttaactgatgtaggaaggaaacgttattatgaaaaaattggggaacctcatcctgtttatcggttttctcaccattatcttttcatttggcatattatcgttactcaaaacagaccgagacatttcaccagttgaaaatcggccgctcgctcaaaaaccagcacttacgaaagaagctctcctaactggtagcttctttaaagatgtcgaaacatacacaaatgatcaactaatcggacgagatgagcttattaaaaactatacaattgctcaaattaatatgggcaaatctctcattaacgacattattttaactgatgataaatggctcctgaaaaacccggcgtggacaaaaaaatataatgaaattgaccaatccatgcctgctataaacgatttgtcgcagtttttaaaagaacaaaacgttgagttttactttgctttaccaccgtcaaaaacgaatgcattatcatttaaattaccttctcatattcacacatatgcacaggaaaatttaaattactttctaaagaagcttccagcagacgtaaagccaataaaactgatggaacactttaaacagaactatacaaacgaagaaatacaggacatgtatttcaaaacagatcatcattggaatatggacggcgccttcttaggttaccaatatataatgaacacgatcgggcaacaatcttctatatataaaggaaaagaaataaaaaaagaagactacactcggacatgtgcgcaaaataaacatttagttggaagcttcaacaaccagctataccaactcatcgatgccaatggtgaaaaattgtgctactacacaccgaaagacggtttcaacttcacaagcgtaaccgcaaaagatgtgaaaggtactgttcaccaaaacttagatgaactatatggcgtagaaaagcaaaaagatacaacatcatacgcaagttattacacggacgactatccagaaatcgtcatcgaaaataacaatgcacaaaacgaagtacgcgccttagtcctaaaagactcattcgcaaacgcaatcgtgccacacttagcacaaagtttcaaacatacatctatcctcgacctgcgtcactatcacgaaaaagacgtatatcaatacattcaagacaacaacattaacatggtattgtttgtgtatagtgattcgaatttgagcggggatatgtttaaatttaagaaataactattaaaaataggtctctttagaatcctctaaagagacctatttttttcggaaccaaaaacaatcctcatgtcattatgacatgaggattgcaaatctaattattagatttcttctttaataacgttgattgttacagcttttgtaccatactcagtagttggtgctactctgtctttcattactttaaagattactgtacctttatctccaaatgcagttgttacacctttgaagacatcatttttgttagtagcagtttcatcagttaagaatttgaataagtcatttccttctttagaaactgtatcatttgatttaacagctgttacataaccaagcgcaacatcgttaccgtcgaatgtagcattgtcgttacgatctaggtacacttttccttgctctgtaccttcatcaacgatacgtactttatgttctgttgagatgtttaatttgatgccatttagaacatcatctttatcactcttcacgacgtctagtactctgtcgatattaactttacggttttcaaattgctcaacctctacatctttaaatttaacagatgtgatttggatattttcttgtgtaacagtaatagttgcgtgtccagctgtagcgccatctttcgttaagataacatctgtaacaccagctgttttacctgttacttttaatgtttttccttcaatttttgctgaagcgattttatcatttcctactctaaactcatatcctgctaaatcagctgcatcagcatatacgccttcagtagtgtaattagataattgatatgctactgtatttccagcaccaagtgtagtgtcagcagcttcacctttttgaccagctttagaaacaagctctaagcgtggagcttcatgaccgatgttgctcttcgtaacttcaacatgaagtgatccgtaaccttcaccacttgcatttggattttggaagtggattgtaccagctccaacgttctcacctttaactttaatagaagatgtaccgatagaaccttcatttgttgtagtaacatctaatacttttacaacacccgtttgcgggaatacttctttaatagcaccagaatttgcaccaaatggatcgccgtattggtcagttgttacgaatgttactggtaactctttaccatctacaacttttaattgatctggattagcttttacagttgtaagtttacgagtatccgtttttacaacgaaatcaaatgtttttgttacatcgccaactttaactgtaagtgttgcagaaccagctgcttctgctttaatttcaccgtttttaacagagataacacctggattagatgattttaggctaatcgcgctaggatcaacaactttgttttctttgttaatttgagcaacaactttgtggataccagctttttcaccagcaactaaagttttgctgtttaatgtgaagtctgttccacttaaaggtttagcgtaatttacaccagctttatctgtatctactgcaaatacaacatctttaattgctgttgcttctgcatcaaggtttttcacttcgataataccagtgttagaaactgtgatgccgccacgtttcgtaacttgtacttccactttgtatttaccttcagcaataccaactgctagtttaccagttgttgactctgcagtgccaccttcaaagatgtttgctggagtgccatctagattatttgcaacaaatttcacatcatgaccagcgatatctaaatactcgatatcagcgttacctttttcatcatttaatttgaagacaactgcttggtctgcacggtcgtcatcaaatgtaagttgttctacgcgtaattttttcacttcgtatacatacttcacaataaatgtattaccttttactttaacaggaagttctttatttggagcaatttttccacttaatgttacaactgcagatttcccgtccttactcgcttcaagtgcgatcgctttatttccttcaagcgtaacatcttcagctgtaagcttgtttaatcctgtaccagttaacgttaattgtgttggctcagtagcagcaacgtttgttactttcgcatcactgttctctggttttgcatattttttatctgttaacgcgataaattgagctgcttctgcacgagatacagatttattcggctcccatttaccaccagtacctacagagattccaaggttaactaggatgttagctttctcttcaccccaatgtcctcttaaatcatcaaattttgtaactaatgtgccatctactttttcttttaggttataagcacctactagcatagacgcgaaagaagcacggtcaatctttccttcaggatagaaattatcttttccatcacctttaacgacaccagctttttcaactgctgcaatatattttgaagaccaaagatttttagcatctttgaaagaaggttgcgcattttcatcaactggtaaatttaaaattttagtgaaaataacagctgcagaagcacgatcgattgactcggttggaccatatgtaccgtctggcttacctacaattgcacctttatctactaagtagttaatagaatcttctgcccaatgtccagctggaacgtctgggaatgatttacctgctgctgctactggagatacaacacctgctaccattgctgctgtcattgtacctgcgattacttttttgtaagagttagtctttgccattttataaatttcctccttcaggaatatgctactagtttcacatcatattaaatttgaaaactagctagttagaaaagccataaaacaataaaaacataaacaaaaacactataatgaaaagtagttcacataaaaaatgatacaaaccgttagatgtaaatataaggtttaaataccattttctgaaacaagttcatcatactatacaaaaccattcgttatcaagaactttctcaaaagaagattcgacacattctgataattctgtctttttatcgtactattaagatatcaataatacttaaatatagaaatgaataaactgttttcctataaaccactctcaatgcgcttcgtatatttttcatatcgaatacacaattggaattatagcacatatttccacttcagcatctaaatattttttacaataaatacaattttcagactacattcgactgaaactatttcatttcgacattattttcttcttttcgaatgtttttttaacagaaaaaggtgttaatttacaaaaaatttacatatcaatgaggtattcttctatttttaaaagcgctttcgatttgtttctcaatatagctaactactaatctgcaaaatatgatttattttgcagagctcgttttatataaaaaaagagcccacatgttgtgggctctttctattgaaataaatttcaattagcgagttactgttactggtttgaaagcaacaagtttgttattttctgtgtcaactgtatttaaagttgcattatctttaagttctttagctttaagagttaatgtaccagttgcaaagttaacattctctgcagtttctaacttaagtactacttctttagaagcagtttcttttgctgctttagcagagtctgccgctaccgtaaatggcacaccatttaagtcaaatacaagatcagttgcatcaacttttacagcttcagagaatgtaagagttacttcttttttctctacatttgtaactttagctgatttaaattcaggagcttttgtatctttaacttctaataataggtttgttgtacccattttcacaccagatgcatttgcaacattagctactgtaaatttcactgtttctgatttttcgaaagtgaatgtttttggtaattcgattgtagcagtatcaccagataaagtgattagtgtaccttctggtaatttagctcctgctaatgtgtagttgtttacgttagcagctgattctgcaccttggccaccttttactactttatcaaatttcactgtaatagtattttcagccttattgaatgctttttctgttacctttggagctactttatcaactactacttcttcttctttgtttttctcaatttttacatctgcagtaaatgctgctgaattattaccagctgtatcttgaataaatccttttgaagcagaaactttatagttacctgcagctgggaatgttacagtgataccttttttattatctttcgcagcttctacagtcacttttgttgttacatcttcgcttgtatcttgattaatgatacgaacaactgatttatcaaatttagctgtgtcaacatttacttctttatcaaatgtaaatgtagccttttgatctttttctgctacaacttttacgaagttaggagctacaacatcttttgtaacttttacttctttagatactttttgacctacgttgttagctaaatctttgtaagcagtaaattcaactgtaaggtttacagatgtttctttttctgtaagagcagctggcactgttacaagtgcttttgtttgatcgtcagtaagtgcgatttccgtgttaggtagtacttttccatctttcttaactactactttaccttgaccatctttaataagctcttctgagaatgttacttctaaagtagcttttccaccaacaagttctttcactttaatatctttaacttctggagctgtaacatctttttctactttgtacgtagctttaccttcgtacatttccattttgttaccagctaaatctgtagcgccagtcacgattacgttaaatgcttcgccatttttaactacatcttcaacttgagcttttgttaatgtaactgcattgccagcaggcgtagctttgatttgtttaccgttaattacaacagtaacttcatctccacttaatttttcactgaatacaactttaacatttccatctggagtagatactgtagatacagttggagctacttcatcgttaaagaagattacttctaatgcttttggaatgtcttttccatctacagatttaacatctttaacatgtgcaacataagcttgtttatttacaagtgcattttttaatgtaatagttgctgattttttatctttgcttaactcaactttttcaatttcaagttcttttgaaccttctactactgagaagttagcagacttattttcttttaactcggctaaatctttaacttcagtaccgaatttaacttcgatttctttagcatttactgctttaatagactcaactttagcttcttctttttgcccaccgaactgcttgtcagttttagcaataaattgagctgcttctgctttagttacagatttatttggctcccatttgtcgccagtaccaacagagattcctaatttaactaggatgttagctttatctttaccccagctatcttttaaatcatcgaatttagtctctagaggaccgtctactttagtatctaatttgtaagcttctacaagaagagatgccatagaaacgcggtcgatttttccgtctggatcgaatgtgccgtcgcctttaccttgaacaacgccagctttttcaactgctgcgatgattgcagaagcccagtgattttgagaatcagcgtaagatggtttagcacctttttcgattggtaagtttaaaattttagccatcattgtagctgcttctgcacgagtgatttcacgatcaggagcgaatgtaccatcgtcgttacctgcgatagcgcctttttctactaggtagtaaactgattctttagaccagtgaccatctacgtctgggaatgttttacctgctgctgctactggagatacaacacctgctaccattgctgctgtcattgtacctgcgattacttttttgtaagagttagtctttgccattttatatatttcctccttaggaatgtaatactagttacataatgttttaaatagatattctatttatttttgaaactagtagatataaatgtggttaaaatatttcttgtacagaataatagaatatcccgtattaaagatatcataaagaaatcatacactcttttcatctaatttaaaaccttaaattcgacaaaaaagtgaattttcacaattcgaaacgatcgttttttcgacttttgttttaaagaatccagatttcaaaatctgaatatcttaaatgaatagaaaaacgcgtctgaattacatttataacaatcttcttataaccatttacaactataacagaaaaacgtttccaattttaatatttaactataaagatattacgacattaatcgacaacttatttttctatgattcgacatttttattaccatcagatttcccaaaattaccatacctatttttttatcatttactaaataaaacgttaaatacaaacattcaatatatattaatgttaggatttttaaacgtacatcttatctctcaaacttctttctttatgagcatacatttacaatcacttacgtaattcgacatttttctacaaattcatttttttctttcgacattttctttttcaaaaaataaaaaagaggatgtcctcttaaattaagatcccattcctctttttttgaactcttttgaattcaagtcacttatgatgtatcgagacgctgttgaaatttgctctcgtaattcttctactctttgttccaatgtttcttgtacatattctttttgttctaattgcttcgttgcgacattatacaaagtttcagacgtccaatcaccatctacgcttccgataatcggctgatttacttgttgtaaaaatgaatcgatctttggatcatatgaaataccgaccataggaatattagcaaccgcagatagtatgagtgcatgcagtctcataccgattagaagcgaacattccgacaaaattgaaattttctcatgaatatcgagcttatacggaagcatatgagcttcttctcccattaaattaataatatcgcgtgatgcattttgatcaaatggtccatgcattggtacgaataaaatatggtatccatcacgcttaaattttttcagcgtatctgctagcttcttcatataatcttctttcgcgtcccaatacctcacactaactgcaattactttcccttgaatcgcatgtttttgcaaccactccgacttcattccttctggttgacatgccaataccggatctggaactagttcgatatccttcttaataccaatttcttttaaatacaaaaatgaatcttcatcacgaactgatatatattccgcttttgatacttgccatttcactaataaacgattttgtcttttcgtaattggaccaattccttgcgcataaatataatacggcttcttcaaaaaacgagcaattcgcataatacccgtatagtacaaaatacttttaatactcgttttatcttgaaggaggcttcctcctccgctaattaagccattacttctctttatttccttataaattgctcttatatcccagcgatttactgcctctacaccgtacatttttcttgtatagtcggggtcattcgaaagtacaacaagctcaagagtaggatcctcttcatgtagcgcttgaataattgattgcaaaattgcttcgtccccaacattataaaaaccataatatcctgataaaactaaccgcactcttaatctcctccaacatttcgcaatcaactttttgtcattcaacaaatcgctatcaactctttaataagaaaagttggataactttaaattgatttctttcacaaacatacaaatagccatactcatttatggactcatttacttacgtaaaaatgggatttgctttttggatatccagttcaactttaatgcgcatatgccatatatgaacaaggccacacaaaacgctacaccgctatatattattgcaataagtctagaatctaccacatttatgaaagtagatgtgaaatataatcctatacctactatactagataccccaattacagcaaaaaatctccccatgtgaattgaataagccaattcttttcgaatgtatatatagtttacgatacaaatcatgatatatatgataagtgtactataagccgcaccagttatgccaaattgacttacaagtactatatttaatatgacttttacaaaactcgctccaacaactatccacgccgcttgcttagaacggttaattccttgcaaaattcctattgataataccataagtgatgtgaaatacgaactaccaattaaaatagctaacatttcgctccctttcgcatctgtaaacaatccaacatttaacgggactgcaagtgccatgagccagattgttatcggcgttgttaaaacatgggcaagctcatttgttcgttcaattgtttgttttgctaacgctatatccttctttgttaatgcagccgttaacaacgggattaacggaaataccatcgcacttgcaaacacgacaattaattgtgtaaacgcaaatccacgactatatataccaaattgttcttgaatcgttgtagtggattcatgcaacatatgtggaatcgttacagaatcaactaaatttaacaccggcatcgataatgctccaactgcaattggaatcgagacctgaagtatcttttttgcattatctttaaaatcttgtagtgaatatgtattacttttataacgatatatactttttacatacttcattctcaaatagataagtgacgtaattactccaaggcaagaaccaatcattgcgccgcctgttacaacatcactctctttattccaatatacaaataaaaatgcaattgctaacataaagaaaacacgaatgaactgctcaattacttgtgacaccccggtaggaatcatatctccaaaaccttggaaatatcctcgatataccgccatatatggtgcgattaataacgcaaacgaagttacgattaatggaagtcttgtatcttgtccaccaagcatatttgcaaacatacttgatccaatcataataactgaaaatccaagcactccaaatattactccaataatagatgctgaagtaaatagtttggcaattccgttctcgtcattcttctcatgaagttcagcgattaattttgatatagctagcggtactcccgctactgataaagttaaagctatcatatacacaggaaaaacaaggcgaaaaatccccagtacttcatctcctgctatattttgtaatgggatttgaaaaaaacttcccaacactttcgatagaaacgttgtaatcgttaaaatcgcagcgcctttcacaaacttattattcatcttctagctcttttctttcaatatataatttccatacatattacaacataaaacgagatagctatattcttctcttttttgaaaaatttcactttatctcatttagctatcataccaaatttcttatacattgaatactctctttctttctatgttttaaatatagtatgtacactaacgccttatttatatccagttatttcttcaatttactacttctacttattcgggataaacatgtgctataatgtagctattgtcagtaagaggagtgtttacaacatgctgaattcggtaaaaaagctgttaggagattctcagaagagaaaactaaaaaagtatgaacaacttgttcaagaaattaataatctggaagaaaaactatctgatttatctgatgaagaattgcgtcataaaacaatcacatttaaaaacatgcttcgtgacggaaaaacagtggatgatataaaagttgaagcgttcgctgttgtacgtgaagcagcaaaacgtgtacttggattacgtcactacgatgtacagttaattggtggccttgtactattagaaggtaatattgcagagatgccaactggtgaaggaaaaacattagtttcttctcttccaacatacgtacgtgctcttgaaggaaaaggcgttcacgttattactgtaaacgactatttagcaaaacgagataaagaattaattggccaagttcatgaatttctaggtttaaaggttggattaaatattcctcaaatcgatcctgccgaaaagaaacttgcttacgaagctgatattacatacggtattggaacagaatttggctttgactatctacgtgataatatggctgcttcaaaagatgagcaggtgcaacgtccttatcattttgctattatcgatgagattgatagcgttttaattgatgaagcgaagacgcctcttattatcgccggtaaaaaatcaagcagctctgatttacactatttatgtgcaaaagttattaaatcattccaagatactcttcattacacatacgatgcagaaacgaaatctgctagttttacagaagacggtattacaaaaatagaagatttatttgatatcgataacctatatgatttagagcatcaaactttatatcattatatgattcaagcattacgagctcatgtcgctttccaatgtgatgttgactatattgtacacgatgaaaaaattctacttgtagatattttcacgggccgcgttatggatggtcgctctttaagtgacggtttacaccaagctcttgaagcaaaagaaggcttagaaatcactgaagaaaatcaaacacaagcatccattacaattcaaaacttcttccgtatgtatccagcactatctggtatgacaggtacagcaaaaacggaagaaaaagaatttaaccgtgtatataacatggaagttatgccgattccgacaaatcgtccaatcattcgtgaagacaaaaaagacgtcgtatacgtaacagccgatgcaaaatataaagctgtacgtgaagatgttctaaagcacaataaacaaggacgcccgattttaattgggacaatgtctattttacaatcagaaaccgttgcccgttacttagatgaagcaaatattacatatcaattattaaatgcaaaaagcgcagaacaagaagctgatttaatcgcaactgctggacaaaaaggtcaaattacaattgcgacgaatatggccggacgaggtactgatattttactaggtgagggtgttcacgaacttggtggattacatgtaatcgggacagaacgccatgaatcgcgacgcgttgacaatcagctaaaaggtcgtgctggtcgccaaggtgacccaggtagctctcaattcttcctttctttagaagatgaaatgctaaaacgtttcgcacaagaagaagtcgagaaattaatgaaatcactgaaaacagatgaaacaggacttattctaacttctaaagtccatgattttgtaaaccgtacacaattaatttgtgaaggtagccatttctccatgcgtgagtacaatttaaagttagacgatgtaataaatgaccaacgtaacgttatttataaattacgtaataacttattacaagaagatacaaatatgattgaaattattattccaatgattgatcatgctgtagaagccatttctaagcaatatcttgtagaaggtatgcttccagaagaatgggattttgctagtttaacagcaagtctaaacgaaattttatcagtagaaaatatgccatcattatcagcaaataatgtacattcaccggaagatttacaatccgttttgaaagaaacattatctctttataaagagcgcgtaaatgagctagatagccatactgatttacaacagtcgctacgatatgttgcccttcatttcctagatcaaaactgggtcaatcacttagatgcaatgactcacttaaaagaaggcatcggactaagacaatatcaacaagaagaccctactcgtctttatcaaaaagaagctttagatatctttttatacacatatggtaatttcgaaaaagaaatgtgccgctatgttgcaagacatttaggtgttcctgaaaacgtacaataacgaggtgaaagattatgttatcattcctaaaaaaagcgaagaaaaacggaaaagatacgactgtctctagtaatcaactattcggacaagaaagcacaaatactgaaaataaaactgtaaaaccaacgctttacttccaccctagctggggtgcagtaggacaagaacaaaaatacatttatcaatttttacataaagaactaccacgtttagaagaatatcaaatttctttatctggaattgagattgaaaagcgtgataacggttatgacgtagctgtatttattcgcagcactgttccgaaaccaatttctttcgaagaagttacattaattcttctaaataaagagaaaaaattatgcgcacgaaaaacattcaacctttctgcattaggagatattcctgcaaatgtaaatatgccgtttatctttacatttgagcaagaaacaattacagatgctgaattatcgcaaacggattgggaattagcgttcgaacttgaaagtaagcatgtattagatttagatccatcttgggaagctcagttacctgaagcaagcaaagaagctttacgtaatttcgtagacaatttaacacctccaaatgatggtgaaattaacttcctaggtctgcaagctgcacgaaaagaaaacggcgatttacatacaacgcttcttattcgtaacggttgtaaagacaacattcaactagagcaacttcctcttcatattgaagatgccacaggtgcagttgttgttaaaggcgctttcacattaccgaaccttgaaattaaagcgaacactacaaaaccgtggtcatttgtcttccctgcttcatctatattaaaagaagatatggacctatcttcttggaaggcacttgtaccacaagactaatcatagagaagctcgcctctcttactttttttcatacaaaaagcctgctcaaaaagatggtcatcacacctctttggacaggctttttctttatgtaaaatttatttcgttacgaataaacgttcaatatgatattcagcttctaatttgcacatttcatctgcatgctttactttatttctttttaattgctccacttgttcttcgctcggtttttcattaataagctcgttaattttttcatttactttcattgctaacgcttgatggaaatctggatgtcctttcaactcgtcatctactttattgatccaagttgattttgtgtataaatactgtttccactgttcaacaaattgttgcatatcaaacttttcttcgttccattcaatttctttcatatacttctcaaaagaaacaacaattgagcgtgtaatcccaatcttcactccgtgtggtaactgtttgtacatcaattattccctccagcttaaagctcttccttctgaaaaaaaaggaatctcaaaattcatatacattactataatatcacatacctaatctagaatgttactatactgctaagaggaataaatgtcaacagacgcataacatcttgatatacaaatgttacaaacaacaaaaacacccttatataagggtgtttcttcatatagtttccgtttttacaaatagtaatttatctttctgctcattactcgccatcactactaacgtctttttaatatgagcaggtacttgctctaacgttacactcaatcctgacttatccgactgctcaatgaaattcaataacgccatagctcctgatacatccatatagcgtgcatctttcatacgtaaaacaaccggagattttacgtcttgtaaagcataaaaaacacgatccactgttaaaaacgaaagtggtcccttaattttatatgttgcttccttttcttttacaatagaaactttacgttctttacatttcaccatgtatataatgaatgaaagaataataccgaacgcaaccgcgatcattaaatcaaacttcactgtgacaatcatcgttacgagcataacaacgacatcaccttttggcgctacatgcattttcttcatgctctcccaatcaaacatgccaataccagttaaaattaaaatacctgataatacagcaagtggaatgtattgtacgactgatccaagtcccataatgaaaataaataatataacactatgcatacttgctgaaaacgccgttttaccgccacttcttatattaacgatagatcgtacagtcgcacctgcccctgctaatccgccaaacaatccgctcatcatattaccgataccttgtccgacaagttctttattacttttatgacgtgtccccgtcacgttatccattacgaccgatgttaacaacgagtcaatcgatcctaataaagcaatactaagcgctggtaaaacaagttctgctacgcctgttccacttaaagatggaatatgaagcgttggcatcgcttctggaatcgtcccaatcttttcaatcaccttatttaatgacaaatttccgataaccggtaacctcactgtaagcccttctaacgcagaagaaaataaaggaagcatagctgtcacacctactaatgcgactaaactagatgggattgccttaatccactttccggaaacaatcatgacaataatcgttaatacgacgagtagaaaactattttgcacatgtttcatttcacctaaaataataattaatgcgataccgttcataaatcctgaaacgacaggatacggaatgtaacgaacgtacgagccaagcttacatacaccgaataaaatttgaaatagtcccgccatcataaatgctataaaactcgcctctaatccgtgcgtcgcaataacccctgttgcgataaccgtaatcggtccagttgggcctgtaacctgcccaggtgtaccaccaaataacgccgcaaataagcctgcaaaaattgcaccatacaatccaactagtgctccctcagacgttcccgttgctgcaataccaaatgcaatggcaagtggcaacgcaacaattgcaacagtaaaaccagctaaacattcctttgctattttttgaaacatataataaccaccttcatataaagtccattttccattgtacacctaaatagatacattcgttagtccactttttacagtatcgtgacgtaaacgcattcaattacaagtacctatcgcatctttggaaaccattgtaactgtgctataatagataaattaaatcttttattatatatttggaggcactatgctaacttttgaagaaaaattatcgatcattgaatctttcccagaattagaaagaaaaaacgtatcattaaaacgcgtgaactttcactttgaagaaagtcgtttagataaaaagaacgttgtttaccacttacatccaaatggaaacggctttgtatatgcaagtggcattaaaggttacaaaacggatgataaaggtatggttaacatccgcgaattttcagcagatgaattacgctcagtaatcgagcaatcaattgaattactttcacaagaagaagtagtaattcctgcagaacctgcgaaagaagaagaatggcataacgaagacggtcatatccttactcttatctcagaggacgatatgtggaacgtgtacgctggtgtaaatttagacggtacatttaactcttatccagaagctgcggaatatcttgatgaagaaggattttcacgtaaataatataaaaagcggagacttatcgtctccgcttttttctatccatctgtttccgaactaaaaacataagtaccttatttatactctgacgttcattatttttttgaacgtctaaacaaccttgcacctaaaattaatgttaacatccccgcgataacagaagtagcttcagttgatgctccacctgtttgaggaagtacttttaattgcttattagcttctttactagatgttacttcagatttatcttgtacatcttgtttgttttgtacttctggtttgcttgatacttccggttgttctaacacattcggttcttctttcgcctttggttcttccggctttaatagatcttctagttcttctgttgtttcttctttattttcttcttcaatcggttttacccagatctccggttgctcttttacctctggcttctctaacacattcggttcttctttcacctttggctcttccggttttaataagccttctagttcttctgttatttcttccgttatttcttccgttgttccttctttattttctacttcctctaggtttacccagatctccggcttctcttttacctctggtttttctaatacattcggctcttccgttacctttggttcttccggtttttctaagtcttctagttcttctgttgtttcttctttattttcttcttcaatcggttttacccagatctccggtttttctgttacctctggtttctctagcacattcggctcttccgttacctttggttcttccggtttttctaactctttcaagtcttctgttgtttcctcttcaacttcttcttccactggttttacccagatctccggtttttctgttacctctggtttctctagcacatttggctcttctgtcacctttggctcttccggtttttccaactctttcagatcttctgttgtttcttcttcaacttcttcttccactggttttacccagatctccggtttttctgttacctctggtttctctagcacatttggctcttctgttacctttggttcttccggtttttccaactctttcaagtcttctgttgtttcttctttattttcttcttccactggttttacccagatctctggcttttcttttacctctggtttctctaacacattcggctcttctgttacctttggttcttccggtttttctaactctttcaagtcttctgttgtttcttctttattttcttcttccactggttttacccagatctccggcttttcttttacctctggtttctctaacacattcggctcttctgttacctttggttcttccggtttttctaagtcttctagttcttctgttgtttcttcttcaacttcttcttcctctggtttcacccagatttccggtctttctgttacctctggcttctctagcacattcggctcttccgttacctttggttcttccggtttttctaagtcttctagttcttctgttgtttcttcttcaacttcttcttcctctggtttcacccagatttccggtctttctgttacctctggcttctctagcacattcggctcttccgttacctttggttcttccggtttttctaagtcttctagttcttctgttgtttcttctttattttcttcctcaatcggttttacccagatctccggtttttctgttacatctggcttttctagcacattcggctcttccgttacctttggctcttccggtttttctaactctttcaagtcttctgttgtttcttctttattctcttcttctacttctgttgcttcctgtatctttgtatttacaatatcatacccaatcactttcgattgatatcccgatacaggctgttccttcacttcatacttatgtgtttttctattattatcaactgctggtaaattttcaaactcatatttccaaccatttgttgcagtaacttctttcgttgcaataactttaccatcttgcagtaagtccactttaattatttccgggcgatcattcactttgtcgccttcccactttttcgttcctataacagatgtagtttttaacttatttgggatcataagttttattccgtttacatcatccttcttaattgtgaaaggaatttttgctttcggatcaaactctacgtagttcggggcagaaatttcttgcacatagtaattgcctggagtcagattcggagcttcaactattccttcttcatttgttgtataagaaccaccaattttctgtcctgattctgtatacaattcaaaagaaacacctgggataactttcccttcgtttccttcaatatgcttaacaatttgcagcgttccttttgcaggtaaatcgccttcagcttcgccgccaaatgatatattttcaacctttgcgctattagattcagaagtaggcttttcatttaaaatttgataatcaagtttatagtcattttgtaaaaactttaacttcttcccactttcagttatcgtagatttgtaagcaacggtaaatgaagtagcattccccatatgtttataaatgacaacttcaaacgagttatcacccgtaaaatttatatatccatagcctcgctgttgaaattgctcaagagacaaatattctttattattaatagttacagtaaaactatcttttttaagtaattgcccctcttgtaaagtatctttcaaaacgatgttgttgtgtaaatattgtttctttaaattaaaatttaaaaaccaacgtacttcatcactgttgtttggctgaatatcaccaactttatagaaaaagattcccggttcgttaccttcacttttcggatgagtaatgctaaccgattgtttttctaaatctgtccctaagtttgtttgtatatctttcgtttttcctgcttctacattcatagcttggacagtgaaattgaaactcccgcgaatattttcgcgttcctctactgtctcattaaatgtacaaactacactatttgcattaatctggcacgtaccgaaaacacgtcctgactcatcctttaatgtaatcgtaccactaaatcctattaattctggcggtagcgctaacgttaatgtatcccctgccttcatctctttgccgggtttttcgctaaagtttacatgtatgctagtcttttccccataagttaattttgttttttcgattgtaaaactatcgactattcccgatgttcttaattcttgagcatgtcctataataggtgtgaaaacctgtcctattataacggtgaaaataaaacaaattacagaaattctctttaaatatgtactcataacgcctccaatattaatcattaaatttttaatcgtgagatcgattccactcaaaatcccccttaaaaataagggggatacgaattaaagattatttgtagcatcaaaccatcgttagtgatacgacataaaatagtaaacaatacaattctttaactatattattcatttctactttttttgggcagccaacaataaatactattcctattaaaaatacattacaagactttttatttacatattaatttgttattatattaataataccaaaatatacttaatgaccattccagtcatatggtcatctgatgattggctatctttatctttcagcgatgattcttctctcataactttattctactcttactgaaattattatctcaaaatctataaaatccacatgaataaatcaaaaaaaccttatctaaagcgacatatatacattcgtaagcaaaataaaacgctacgaaaaatatttttatataataataagagaacgtttaaataaaagatacatactacttttttaatcgttttaaaaaaataaagctatcttttcttattaaaaaagatagctttatctgtatagacaaccgttctaccgcttactttttcgcgcctttcaacgactctctcaggacaaatttttgtaatttcccacttgcattacgaggaagttcatccacaaataaataatgacgtggacgtttataatccgctaattcatcactttctttacaatacgtttctaaatcagcctctgtaattgtttcatctttcttcacaacaactgccacaacacgttctccccataattcatccggctcaccaagcaccgcaacatctaatataccaggatgactatggagaaaatcttcaatttcacgtggataaatattaacgccgccactaatcaccatatcatccacgcgatctgcgacgaataaatagccgtctttatcgaagtaacctaaatcaccagagtgataccaccctttatacatcgattttgcatttgcctcttctcggttatgataaccagccatcatagttggaccgcgcaaaataatctctcctacttcataaggaggcaatacatcatctggttctgccggtgcatcttcgcttggttttacaattcgaatttcatgactaaagcatggcgtgcctgctgaacctgctttcgtaatttgatcttcttctacgagaaacgcaacaactggtcccatttctgtcattccgtatatttgaacaagatcaatataaagacgttctttacattccttcactaatgctggcgccattgcagccccgccgtatataccaatcttcattgacgttaaatcatactgcgttaaatctttttgcaacagcatattccacatcgtcggtgctgcaaagaatgtcgtaatcttctcttcttgaattgtatgtaatactgtttccgtatcaaaatgatgtaaaataacattctttccgccaacttgaatacgcgggataattccagcattcagctcaccgcaatgatataaaggtgcaacgacaagtccgacactatctcgattatattttaggaaatacgtacaaatcatactatgctcagccatttcacgatggcgatgtaatacacctttcggatgaccagtcgtaccgctcgtatacagcatcgaacaataatccatttcattaatttcgatatctattttcttagaagatgctgcgttcactttttcatggtaagaacttgcataagaaggtgtatcgtcttctacataccaaaaagacgaattcggaaaatctcgttcaatgatagcgacagttggctcaactgctttttcaaaaacaacgactttcgaggatgcatcctgaagaatataagatacttcttttgcttttaagcggaaattaattgggttaaagatcgctccaatttttgcacaggctaagtaaacgtttacaaattcacggcaattatataagtaaacagataccgtatcgccctttcttaccccttcttctaatagagcatgcgccgttttatttatttgctcattccactgtttatacgtccagcgaatatttttttctggttccactaacgcctctttattcggatacttaccaacagataaatcaaatattctccctatcgtcatgtacatgccaacaatttcccccttttctctttcataaatctatcatttcgtccataagtagacattgtcctttaatgatttgactaatttttctgattattatcgacatagttttacaaacagttccacttttgacggtaagtgaaattatatcggcgattttccggatatatcggcgcaacttgaattatatcggcgatttttcgaatatatcgacttaccgacaaaaactgacaagataaaaaagaagctgtcccgactcggaacagctcctttcttcttatgcaaatagctcttctaaaattttcagtttatcttctgtatattttacgaagccatcgttatatgattttggatctttcggattcgcaaagtgcgtaattgctcccgttttcggatgaacaaatttacttgatgcaccacaaccaagtccgataattgattgtacttcttccataatgacaatgttgtaaatactttcttgcgtcggcattgcataaccaacgttctctaaattacctaaaatattcttttgacgatataggtaatatggtacgtaattatgcttttgcgtccactcttctgcttcgtgcatcatcgctgtaatttcttcgcgacctgctactttatatttacgtttgttttgcgtcatttcagaagcacgtttgaatgataaggtatgaactgttaatgactctggcattaacttttctgtttcatctaacgtgtgcttgaaaatatctaacccttcaccaggaagaccaataattaaatccatattaatattgttcattcccatttcacgagctaaatgatacttctcaattgtttcttctacagtatgatgacgtccaattgcttttaatgtttcttggtggtatgactgcggattaatactaatacggtcaatgttccatttatttaacacttctagcttcgctggcgtaattgtatctgggcgacctgcctcaactgttacttcacgcacatttttcacatctgggaacgcttcatacatttcttcatacagcatatccatctcttctgctgtaatacttgtcggtgtaccgccgccgtaataaatcgtcgtaacttttacacctttttcttttaaaaacttaccaatttcacgaacttcataatgtaaaccacctaagaatgaatcaacagagccttggcgtccgttaattgcatacgccgggaatgtacaatatgcacattttgttgggcagaatggaataccgatataaatacttacttcctctttcaaacgatataaatccggaactaccgctaattgacaatcaacgatacgttgaagaagttcaattttctcttcatgaattaaataactttcacgaagttcttggtgtgcttcttcttttgacataccattttgaagcattttatgaagaagtttcgttggacgaactccagttaaaataccccagctttgttcaataccagttaactgctgaagaacagaaagatatacataagaaacaacgtgcttcacttgcttcatacgctctttttcatctgtaaaagcagataaatcttttgcgaatgtttcttcatacacatttccagtcgcaacatctgttaaacgagctgatgctttcacattctcttcaatgtgtatatcaacgataagatttgcttcctcttgttcaaatccaatcgtactatcttcaaaaaataagccgccaatattttgtagcggacgtaaaaaacgatcatcttgtaacgttttaattgaaattaacaacattatcaccttttcatttgcaaactctctttagtttacttgaagggcgtttgcagatcaatacagaaggttttaccttattttcatatcctatttaaaacaaactgaatattgatttttaacgaactttctctagctgtatagacattagaatatactcttgttacaatctagaacgtattagtacttgctactaatttaaatacatataaaggaggactcttaacacgcacgaaagactatcacgtgttaaaacaactatgaaaaaaaagttttacaacattttagcattatctttggcattacaaacatttgtagcgcctacccattcattcgcagaaagtatagaaaaaactgcggaattgtctatggatgaacaagtgttaaaaagtattgaagaacatgcaaaacagcatagacatgacgaagaaaacgaccttgaaatctcgggtgaatatcttctccacttatcaacaaaacttccactatacaattcaaatgacttaaaaacgaaaacaaatattgaaattgctgaaccagtagtaaaagcaacgaagaaaaaagggaatgcatattacatacaaactacgtttggtgctggctgggttaataaggaaagtaatagtttagaagtacaagagattcatacactctcgaatcaaaaactaatcgtaacagaagaagcatcagtatattccttccctttccaatcgtttaaagaagaaacgaaattacagccacaaacagtaactcctactgaacaagctgggaattggtttaacattcaaatgaacggaactgagaaatggatttatgctccttcagctacattcgacggtacgaaagcatcattatttgaaaaaacaggtgctatcgaaaagagaagcgcaactttcttcaaaacaccatctaatttacctacaaataacgtttatggtgttacttttaaagaaatgattgttccaaaaggaaatgaaaatattcgccctggctacgcaatggaaccgaaatacattacaattcatgaaactgctaatacaagtaaaggtgcgaacgctttaaatcatgcgaagtacttagataatcaagctcgcggaaatactgatcgttcagcgtcttggcattttacagtagatgacaaagaaatttatcaacatcttccgctaaatgaagttgggtggcatgctggagataaaactggaaactatgaatctatcggaattgaaattgctgtgaatagtgatggaaattatacgaaagcggtagaaaatgcccgaaaattagcggcttacttaatgaacgaattaaatatctccctagatcacgttcaaaagcatcaattttggagcggaaaaaaatgtcctgcatttatgattcaacgcgggcaatgggatgctttcttaaagggcacgaacgcttactataatgaacatcgtaaagaggttattcctccagaagtccctcatgaaaaagacgacattacaggtggttggtatgaacaagacattcgtcaattagctgctagaaaaatcatgttcggtgacggcaatggttcttactggccaaaccgcctcgtaacacgagctgagtttgcaaatttaatgtcgagagctttaaaattacctgctggaaacgctaaattcacagacttaaacgaagcacatccatctttagtagatggaattaaccgcgccgctagcgctagtatcattaatggtcgtgggaataataaatttgatcctaatgctacaataacacgtgatgaagctgttattatgattgaccgtgcactagaatataaatggatttatagaaaagaagtgaaattaccattcactgaccaaaacttagcatacgataaaaaagcattacaaaatgtttatgcatacggaattgtaaaaggtaacgaacgaaatgaattcgtaccaaaaggcacagcaacacgcgctgaagcagccgcatttttaaatcgaatgcttaaagttattgaagcttaaacaaaacaactaaaaggcataagagataacatttctcttatgccttttataaaactattaactatttttaatcataaatctaagacgtattcctaataaaacaagagcaaaaccaatgaatggtagataattcatatcatgtcctgtagctggaagttgtgcatgagacgcaccttgtcctttttctggtaaggtaggtttttctttatctacgttttccattccttcacttggtgttcctgtctctccacctggcttttctgtttcttcacccggttttcctgtctcttcacctggcttctctgtttcttcacctgatgttcctgtctcttcacctggtttctctatttcttcacccggttttcctgtttcttcacccggttttcctgtctcttcacctggcttctctgtttcttcacctgatgttcctgtctcttcacctggtttctctatttcttcacccggttttcctgtttcttcacccggttttcctgtctcttcacctggcttttctgtttcttcacccggttttcctgtttcttcgcctggcttttctgtttcctcacctggcttttctgtttcttcacccggcttctctgtttctccacctggcttttctgtttcttcacccggttttcctgtctcttcacctggcttctctgtttcttcacctgctgttcctgtctcttcacctggtttctctatttcttcacccggttttcctgtttcttcacccggttttcctgtctcttcacctggcttttctgtttcttcgcctggtttttctgtttcttcgcctggcttttctgtttcctcacctggtttttctgtttcttcgcctggcttttctgtttcttcgcctggtttttctgtttcttcacctggcttctctgtttcttcacccggcttctctgtttcttcgcccggtttttctgtttcttcacctggtttttctgtttcttcgcctggcttttctggacctttacttggttctttttcgttcaatacttctcgtttcactacttcatttgctataacgtttacttctactttaacttctttcactttgtagccttctggcgctttcgtttcttctaacgtatacttacctggcactaagttttcgaatataacaacaccatctttatttgttgtttttatccctccaactatttgaccattttcgtttttcagtctaaattccgcgtcttctagcacatttttgctctcagcatccttcttgattacctgtaagcttcccaactctttcacatttttaactattactgatactaccttgttctcttccacattaacttcaatttcttcttttattaatttatatccctctggtgctttcgtttcttttaatgtatatttacctggttctaatttcttagagattactttacctgtcttatctgttcgtaatgtatctatttgtttaccatctttatacacttcgaattcggcacctgataataactttgtttcatcacttgcatctacttttacaatttcaaattggcctgttactttttcaacggatggcttattccatttcggccaattaaatttaaagttatgaacctcaaagccatctctttgatgtaatccgccaagaaagacttgtccgttaattgaaccaccctttgtatctacaactgcatttggagcaaatacacttcctactacaccataaccctcagttgttaactttgtagcattagggaacacccaaatgactttactagctaactcagtaaaaaaggaattagggtcatatacttgagatgtattaactaatgtgaactcgcccttatctgttgtatcatacaaaattgctccgccaccaaaacttacttcttctgcatctgaataaataacaataaaatctttattatctacattcggaagaaaaacgtcttttacttcaaattctttctttccgttttggcctgaagaaacataaatattaggattatttacatcttcaccgattccaaaggtcatacccattttgggtttatcagtatgtaattggcccgcatcctcaattacactattaacatcttttctaaactctttaaatttagcatcaatctccgcttgctctttataagagatacggtcatatgatgatttcattgcaccttctggatcaccatcttttgtcatcgccactgttccatcttgaataattacttgtcctgttcccgctttcgtaaattgaccacctagtaataatgagggatatccttcctctacccatgttgctccagctaagttatgcgctcctgttgcagctgctaagactgtataacttgatgcattcatatttttttgaatggccatcgcaccttcaatatccgcactcgttgcactatgatttccaaaaatgacggcgttgtaataagatacatcacctaaaccttttaattctattgtagctgcctctgctttatttggtaaatggattaaaaaattcatgcatactaataacacaactatcaaactactacttaatttttttattttttgattaaatgatttcctcaaaaaattcattcccccttttaaaattcctagatttatgaaaagaagctcatttcatatgtaccaatccttactcacattaacttaaaataatccatttaaatagacgaaagaaactctacaactaattaataaaatgactacaatgcatttttgaaatcatacgtgaacgaaactaacatgcgaagtgtttttgcgtatggacgctcaataaaattaacatggagaatatttcatgtggtgtaactattttggcaacatcatccactttacaacagtttgctaaaggattcaagtgaattgtatacattttagacacaattcccctttatagaacgctttcatttctaaaataaaaccaataaaaaaacgtagccaaaaagctacgtttttctctcatcatttcggtgtatttttatgattcttcaaaaacggaagtgggaattgtttacggaaatgctctttaatcatatactctacgccgttctcactatttgaacgtgtaatccagtcggccgcttgttttacttctacaggtgcattccccatcgctaccccgagacccacattttcaataacctctaaatcttccatgctatctccaatggcaaccatttcgtttagcgaaatatttaaatgctctccaagcaattgtaatccacgtaattttgatacattttgtggcaaaatttctattcgttttgaatcacactcaacatactctaaatcttgaaacgcttttcttaatgtattgagccctcgttctttttcacctttcgtttggaaaagaacatcaatttttggcgccgctaccggatgatcacgaagcgcatcacctaatgaatctacaaattgaactggataaaataacggatctgcactcgataacacagtacgtgcaattaagtttggtgtatttctttcgcgatttccgattgaaaaccgttcatgagagatgcggacgttacaatcaaaatgctctaatacttgcacaatattaaatgtcttctcttccgataaccttctttgaacgtacggcttatctaacgttgctgaaatgaaagcaccaccgtgtgtcactaatatcgaatctaattttaacgcctttgctactttatgagcggactgaaaattacggctcgtaaataatgtaacgtatacgtcttttcttttcacaaattcaattgtttctcttaatccttttgcaatttttccgttgttgtatagtagtgtcccatctatgttaagagctagtaagcgataaatcatgtcgcactccccctcttcgctgttgtactctatccataatttatgaaataaatgtagcaaatagaacgagttagaatttctactgaaaatttggtttactatatacatatacactcagtaaaggagatagtacaatgcaggcacctccttccttttatgaaggcgatacgttagaagtcgcaaagaaattactcggacaaaaacttgttcatattgtaaacggaataaagcgaagcggaatcattgttgaagtagaggcatataaaggtcccgatgataaggccgcacatagttatggcggcagacggactgatcgcacagaagtcatgtttggtgcaccgggacatgcttacgtatatttaatttacggtatgtatcattgttttaacgtcattacagcaccagttggtaccccgcaaggagtgctcattcgagcccttgagccagtagatggaatagaagaaataaaactagcgcgctacaacaaaacggacattacaaaagcgcaatataaaaacttaacgaacggacctggcaaactatgccgtgctctcggaattacgttagaagaacgaggcgtatcattgcaaagtgacacattacatattgaactcgtccgagaagaagaacacatatcatcacaatataaaataacagcaggacctcgaattaacattgactacgcagaagaagctatacattatccttggcgtttttattatgaggggcatccgtttgtttcaaagaaataaagtgaaactttaatcagtggggagtgccttcatcccccactgattattagttgaaccaatcggacttttatgggcagttgatcccccgcctaacttctttgctttcgctgaatttggaggcggggatcttactgcccattaaagcgagataaacaatatcgacttaccgacaaataaaagaagatgttgtctcataagtctctttcgaagtaaaatcacatgaaattgaaaaggaagaaacgttattaaatcaacgtttcttcctttcactttctattcggttttggctaaaaagcaccttttgggaaagcctctctcccttttactccgcaccttccgcagtcgcaatattatcctctaagttttctcttgataattcagccgccataaagtcagctgtttctggaagtgctaaatgcatatgagctttttgacaaatttggatcgtacagttttcaacaacatagtcgaaaacatgtccgcccccgcttctttcatcatcaatgtaatgtaaatggaatccagctacaccaataccttgcgcataatctggtgtccaaaatccagcaagcgtaccttctgtattttcaaatgagaagattggttgtgatttcgtcacttcaacgagtggtgtatacggtttttcttgtcttggaaccgttcttgttcttacttcgcggaacgtaccgtccattcgaataccgtaaaataagtttttactcggcattaattcatgtaataatgcttctacttcttcacgtttcatcggacgttctaccttataactcatttctttttcaaaaaacgttacagtcgcaaatggcgttgtttcttctggctctactttttctgctgaaccgtctgaacgtaaatgataaaattcgttatcaaacgcaatcatttcaccatctaactgatcaaatgtgccgataccgaaatcaccatgttttttcaaatcttcaaagctaatcacaccatcatatataccatctaatagcgcaagcattgtagatgtttgatatacttcattactcgttttcgttttttttgcatcaatatcaattaattgcgcaaccgtcatctcaaatctgcctccattagtttaattgatttggtaataatttttcgcttaatttaatgttgtcacggtaatcgattggaatatcaataatgacagggccgtctgctgctaatgcttcttttaataccccttctaattcatcaggcgtgttaacacgaagacctgtcgcaccgaaactttccgcatatttcacaagatcaacatcgccaaactctgtagccgatgttctaccgtatttcatcatttgttggaatgcaaccatatcatatgtgccgtctctccaaacaagatggacgattggagaatttaagcgtaccgccgtttctaactccatcgctgagaataagaaaccaccgtcacctgatacggaaactactttcttacctggttctactaaagtagcagcaattgcccaaggaagtgcaacacctaacgtttgcataccgttactaaataataatctacgtggttcataagaacggaaacatctcgccatccaaatagaatgggaaccgatgtcacatgtaacggttgtatcgtcactaattaaagaacgaagtgtacgaattacttgaagtggatgcgtaacaccttctgaaggacgatttggaacttctgcttgttctgataatttcgcacgtaatcgttctaacactgcttctgatttcgtacttaatacaagtttcggtaatttttctgcgatgctatttactgttaaggcaatatcaccaattaattcacgctctggttggtaatcatgatcaatatctgcttgatggtcatcaagatgaataatcgttctgtccccaagtttattccagaatttcggatcatactcaattgggtcataaccgatagaaataacaaggtccgcttcttctagtaaaatatcacctggttggttacggaataatccaacgcggccgaagaaatgatcttctaattcacgtgaaatcgcaccagctgcttgatatgtttcaacgacaggaagttctgtatccgcaattaattcacgaacagctttcgtcacttcatttgtgcttgctctcataccgagtaaaataaccggcaatttcgctgcttttattttttctactacgtatgtaatatcatgtgtgggagcgattccaagctgtggcttagaaagcgcaccgatagactctacagtcgtttccgcagtcataacgtcttgcggaagacttactaaagtagcgcctggatttgtggaagtcgcacttcgaaatgcatttgatattgcttctggcacattatcaggatgctctacttctacgctatattttgtgattggttcgaatagtgcagcattatccatagattggtgcgtacgttttaatcgatctgtacgtggaactgcaccagctaaagcaacaacgggatcactctccgcattcgcagtaacaagacctgtcgctaaatttgatgtccctggtcctgaagttacaagacatacgcccggttttcctgttaatctaccaatcgcagctgccataaatgccgcattttgttcatgacgacaaacaattaactctggtcctctttcttgcagtacatcaaatacagagtcaatcttcgctcctggaataccgaaaacatgtgtaacaccttgtttaattaaacaatcaacaacaagatctgctccttttgtttttgtcttcacgtcgtttgcttttacacctgtactcaaactaaccattcctttgtttcataatttgtgtaataaagattttaaacttcacctagttaattaacgtggtgaagtattatttatcattatattacaaatacattatttttccaacaatatgaatttgacagttttttgacaccgattaacgaatgcgcttacaaccctttatttatcctaaaataatattttctcgaaaaaatctaaaaaacttccatctcatcgcagtatttttaaaataacagtaccttgcaaagaacactactaaatgatatatttgtaaatattggaacacccattaattggaataatattcgtagttagtatatccccctctcaacaaagagcggattctcagctataattcattattttataaagggaagtgatcgcaatgaacaaaagtgagtttttaagccaacttagttcctacctacggaatatacctaattcagaaaaggaggatattatttcagaatatgaaactcattttattagtggtaaacaagatgggaaatgtgaagaagaaattgctagaaaactaggaaaccctaaaacgatcgcgaaagaacttactgtttcctatgcaataagcaatgctgacaagaaacgaagctttaaaaatatgataaccgcactattttctgttatgagcttaagtgttttaaacttttcctttatctttatcgcctttttcgtactactctttttattaccgattattctagcacttatcattgctactccagtattaatcatttcacctattttattaatagggttaggattttttaaagggtttcatcaaattagttactccgatgtttataatgtgtttatcgctttttgcgtcggtttactcatatccgtcatatcttaccaaatggtcaaacatatatacgcacttttagtaaagtatttgaaatggaatattgctattttacaaagacactaatgaatgtaaaaggagattaaaatgaagaaatatactttatattcactcatgctacttactcttttatttctatcagcttgttcaaacagtgcacaacctaaggaagaaaacgatgtacaatctattaaagatgttacggttaaaattccagaaacgatattcacttcctcaaaaaagaatgaaacgattaatgaagatgaaatgagaaaaaatataaaagattatatagattatagctgggagttatctgaaaacatcattccacttgcctcaacaactcctgataagaatttcactgattccgatcgaaaaaaattacaaaaactaatcgatctagcgaaacaaaacgatatgaatttccatgagtttattagtaataataatttacctactgattataaaaaaccttcaaaagaaatctatgaatttatgtcatcatctacggctattttcgtagaactagatcaagaattaaacaaactcgcccaagatggtaacttattcaaagccgatttttcttttacgaagcaccttgagaaagctaatggacggaagcaaaaagagattgaaaagtttttaaacgaaaaaaacattaaaacttcaattaacagcaataaaaagaattaacggatgtactacataccactttcaaaatagctattttgaaagtgaggttttgtggtctaactatcaaattccctaaacaaaaaagacgcccctatccgaggggcgtcttccactattacgcttgttgttgcgcgctatataattcttcaagtggcttcatgataattttgttaacgtcgccgattacaacatttaagcgttgctcagtttccattaactttgtaattttagcatcttgttgaatgcgaactacaacttcttgtgcttgttggttgtcttcttcagtgatttcttgaccttgcatcattttttgttgtaggctaagttgcattgtacggaactcatcgaataagttctttgaagctgcatcagcttgaactgctgcgtagctctcttttaaagttttgaagtcatcgttttcagcgattgctttttgtaattcatatgctacatcatgaatgttttttgtcattttattttcctcctttagaaggctagcgcttatcatacgcactgccttttacgtgcatttacatacgcacctcttcttaccatatcaaactatgcaagagatgtgaagaaatttcacttttatttgtatgtacgtattttattatttcagaaacaacagtaataaaccttgcacaattccaatcataccgcctaataaggcacctaaatacgtaatcatttttagttcattttttgtaatggacagcactaaatcttctagtctctccgtggaaaatgtggacacttcttgctgcacaatttcagccaagtggagattatttagtatactcgctacgttttctgctccccacttcaagcctttcgttactacgcctgggactaccttttccataattgtttctcgaactggctcacatacttgctgcacagattgatttaaaaatttacttactgtttcctccactttaactgcagacaatatggagcttacaatcatttctttttctacaaacgtttctacttcttttacatctcttccttttaacttttccaactctttttgcagtacttcagttaaaagctgctttgtgccatcttgccctaaaaacttgataacctcaggctgaacacgatccactacacttacattccctaaaaacattccgactaagttaagcaatgtccccctagaagcaaagaaatcatcaatcatttttgaaagacgtgctttaccttcttcactctcaaaaaactgagttgctcgccctaaaataaatgccgaaacatttggaatcgcattctctattttctcatgaacagaatgaggtaaagcttgttcccatgtatatgtatagtactcttctaaaaatgcctgaatcttttctgtaatcacctgttcgattttctcagttgcttctttttctacatgcgctacgtcccatttttctaacatgtgtcgcagtgactgttcattcgtaattactttatccacttctacttgtgcccagtggattaaacctttttgaaactcttcatttgttaacttcttgccgattccttctggcgttaacaaatgttctacaaccattttccctaattgaacagcaagctcatcgcggcgcttcggaattaatcctggtgtaaatggcacttgaaacttcccaatatatatagggcgatgaggacgaaataacatttttatcgctaaatgatttgtaaatcctccaataattgctccgagccctgtcgtcgttaacatacttaaccatatattcattacaatcaacctttcgcttctccaaaactatagcatatcatcatacggacaaaagtataatggtataaaaacgtatttgcaatatatagcttcgcctattatgccaacattttgttagtaaaggagtgatttcgttggttctcggtattttaacttctcaccctcattatgagcaaacgtattacaccgaaatcgctaaacgcgctcggctttatcataatgtcgttgcccagtttacgccatttggtattgatcctaaaacagatcttgtttctggtctgatttatgatacgaatacaggaaaatggaaagagcaaatattccctattccttcttatatatatgatcgttcttcttttaacgaggaaacagacgtcgaaaaagcaaagtcaattattcgctcattacacaatcgtccttccactacctttttaaataacacactcattgacttaagcaaactacatgatgtatttctcacgaataaaaaattatctccttatataccaaaatttgaaatagcaacgatacacaacgttttcaaactgttattaaaaacaaaagatattattatacgtcctactaacgcacattccaatgaaagtttgtaccgggtcgtttataaaaataaaacgtttcatgttgatacgataaatgatgcctaccatacttctactccaattaaacggactgatgaatttatatcttggtacaaatctcatatacgatcagcacgttacatcacgcatacaatgctgcaacctccaaatcaattaacatacccactccatattcgaaccattttacaaaaaaataaagaacagaagtggaacgttatcggtcagtttatacaaaaaagttcatttccgaatcaacttttactttcggtaaccgacgattcctctctgcatgcattttcaaaaattaaatacgtactatctaataccggtgtacaattgttacaagacgctttacaagacattataaatgaagtgtttcaaacgctagatgcatcttattcttcattattcgagctagagctttccactattatggatcaaaaaggggcaatttggcttatgtatgtcaacacgattcccccttacgaacattacattcgccatagtgattcattagccgaaaaaatatatcatggaccattacaatttagtcgctttacaccataaagaaagggggtaagtctattttgaaagagcacatatatacgttaaatatttcagatgaacatccaaatagtattactttaccttatattttttccatcacaccaccaattacatccctttccttcggcctacgccatgttgcaagtgaagaggtaaaaattcattattcctttactcgcgaaatcattattggaaaacaaattgcagagaaacttttactgcctcattccactactatccatgcattcacacaaaaccaaacgattattttcggaccattaatcgggattttcacaactggttttaacgatgacgcttctaatcctttagggaaccgttcaacttctcttggcgagttactaacgccaccattcaccttacgaccatttgtattcgtttttggtgtgcaacatatagactggcaagacgaaacaattgaagggtatttctttcatgaggaaaaatggataaagaaaaaagtccctttaccgaatgtcatttacgatcgattaccaaatcggaaagccgaaaattataaaccgatcgtaagagcaaaaagaaagttagagcatgactatgcgattccatggtttaacccaggtttttttaataaatgggaagtgcatcaacttcttatgaaagatgaatccattatgccgctattaccaaacacagaaacatttcagcacttcgaacaagtggaacgatttctcggaacgtataaatccatttatatgaaaccgattcatggtagcttcggtagaaacattcatcaaatattttattcccaaacagagaattgctactactgtcgttatcgcgaaaatgaagaaaataaactaagaaagtaccaatcattagaaacacttctgaaccatgtgttaaaaggacatgatttaaaaaagtttatcgtacaacaaggtatctccttgctacgcttcgatgggcagcctgttgatttccgcattcatacaaataaaaatcatttcggccaatggatggtcagtgcaatcgtcgcaaaaattgctggcaaaggtagcttaacaacgcatgtaaatagcggtggcgatacgaaattgctgcaagaactttttcctgattcaacgaaacaaattcaaattgaaaataaattaaaacatacagccttacaaattagttacgcactcgatgaacaagtaaccggaaatattggagaaatcggttttgatatcggtttagacacgcaggaaaacccgtggctctttgaagcaaactctaaacctgggcgaactgtattccaagatgccaagttaaaagaacagagtgaactaacgcgccaattattttacgaatatgccatctacttaactgaacattctttgcgcgatacaaaagaaaaaatgtctcaaataaaattagagacttcctcaaataacgagcatatcccgtctcctatgattcactcacaaatacaaaaacaaaaacttccacctcattcataaggtggaagttttctatttacacaagttttactacaaactctgtttccacgttacatactccgcaataaaaaatatgattgcaatattcatttgaattattatatgtcaatccatctactgcacttaataattcttggtccatatacgcactataatcgtctatgtaatctacagccttcccataatcttggagtatactttggcaattttgacaagaatatgtttgtgattctaatgcgttgcaaagcgggcaaatccccatcacgattcctccatataattgtatctagctatgtataggagcagcttgccccattcttacttacatttacctcaaaatagcaggatacaaaaagaaaaatatatttcatatcgctcttagtttagccttctttctaaaaaatacaacgattactcttatttcataatttacgaaatcactaagattttttacaaaatttacaaattattatttcgtatatctttctaggtaacatccatactatgagtacaaacttaattaccgatggattagcgccaaacggggcgataatctggttcaactccagctagtccaaccaaaaaaatttttataactctaaggaggatatattcctatggcaaaccaaaattcttcaaatcaattagtagtaccaggagcaacagctgcaatcgaccaaatgaaatacgaaatcgctcaagaatttggtgtacaattaggagcagattctacagctcgtgctaacggttctgttggtggcgaaatcacaaaacgtctagttgcaatggctgagcaaagccttggcggattccacaaataaatatatatggcaaaaaggtctcaaggcatatgccttgagaccttccttcatttattgcaacatttgtaaaaacttcttcgtacgttcttcttttggatttgtaaatacatcttctggtgtaccttgttcgacaacgacaccgccatccatgaaaataacacggttcgcaatttgatgtgcaaagcgcatttcatgcgttacaatgaccattgtcatgccttctttagcaagctctttcatgaccttcagaacttcttgaacgagttcaggatcaagcgctgacgtcggctcatcaaatagtaacacttctggttccattgcaagcgcgcgagcaattccaacgcgctgttgttgtccgcctgataattggaacggatataaatccactttatctgctagacccactttttcaaggaaatagtttgcttttttcttcgcttcttctttccccatctttttcactgtaacgagcccttccattacattttgaagtgctgttaaatgcgggaatagattatggtgctggaataccatacctgtttgcgtacgaaggttgacaatatctttcttcgttactttttgagagaagttaagctctttattaccgatacgaatatgaccagcgtttggcgtttctaatacgttaaggcaacgcaggaatgtcgttttaccagacccagacggcccaataataacaacaacctcgcccttctcaactgttaaatctatatgctttagtacggtattatctccgaaacttttttgtaagtgctgaattgaaatcataaaaacaaaaactccttttgtaaaaggattattttaatgtgtagcgttctgaacgcttttctaacatctgttgtacgattgataataagaaacaaataacccaataaataagacctgcttcgaaataaacaattaaaaattcgtagttcattgccgcaatttcctgtgcttttctgaacatttctgttactaaaattaacgatgctaatgaagtatctttcactaagctaataaatgtattcgaaagcggcgggattgatacgcgcgttgcttgcggtaaaataacacgttttaacgcttgtgggtatgtcatcccaattgtataagcagcttcccactgccctttcggaattgaaaggatagaagcacgaataatttcagatgcatacgcaccgacatttaatgaaaatccaacgactgctgctgtatatggctcaacttcaatattaagagttgggagaccatagaaaatgataaataactgtacaagaagtggcgttccgcgaatgatagatacatagatacgagcaatccattgtaaaatacgactacctgaaatacgtgcaagcgccgttaacgttgccagtataagaccgataataaatgtaataagcgttaatggaattgtcgtaaaaacagcttccttcagcataggcatgaaggaagtctgcataatatctatccaagtagacaatcgatctgaaatcaatgcactacttagatacattttcaccaaaccattttttcgttattttgtcatacgtaccgtcttttttcatatcttctaacgctttatctacttcttgtacaagcttagtgctacctttacggaataagaatccactttctgaagcttctttttctgtatctacaattttaattttcgcatcttttttcgtttctaaataatttaacactgataatttatcattgattgtgaaatcaacgcgtcctgaagctaatagttctgctgcttggctaaatccttctacaccaacgatttccgcaccatttttcttagcgatatctgcatagttacttgttaaagattgtgctccttttaatccttttacatcagcaaatgtagcaggtttatctttatcttttgcgataactaatgccgctgaagatgaaatgtatggtttagagaagtcgtatttcttttgacgatcttcacgaataccaacttcgtttgcaaccatatcgaaacgttttgcatctaaaccagcaagtaagctatcccattgcgtttctttaaatacaggttttacacctaaacgttttgcaacttcttctgatagttcaacgtcaaatccagttaatttattgcttgaatcgtggaacgtaaatggtgggtatgtaccttctgtaccaattacaagttcaccgctttgtttaatcttttgtaacgcgtcttgactagctgtatcttttttctcttctttaccgcagccggctacaatcccgatcgctaatgtagttactgcaagtactgaaaataatttcttcatgatggtaatcctccaagtattctgataggaatttaaaaactatattgattgtatgcaatcttgaacaatttttcaatgaaaatgttcttatttagtttatcctttttcttcataatcaaacaaaaaggaaaaataatgctacatacaaaaaataagtaacattttttaatatagcatttattgtacgaaaggtaaaataatacttcttatttaattgccgtgattcactaaaaaagaacttgtgaaaatcacaagttcctccccatacctattaagcgctctgattcccttccatttgcgttttgtacatatcgtaataacgcccgcgctttttcattaattcatcatgagaccctttttctaaaatcgtccctctatcaagcacgataatttgatctgcacttttaattgttgaaagacggtgggcaataataaatgtcgttcttccttttttcacaacttctagcgcttgttgaatcatcgcctctgtttctgtatcgatactagatgtcgcttcatctaaaattaaaatggctgggtcaaaagcgagcgccctagcaaacgatataagctgacgttctccggttgaaagtgtacttcctttctccgtaatttcttcatttatattgttcgcaaatctttcagcacctacatcacgcaatgcttttacgatgcgctcttttgaaatattttcattttctaaactaacattagatgctactgttccgctaaataaaaatggatcttgcagtacaattcccatatgttcacgagttgcttgtttcggcatctcttttacatcatgaccgtcaattgtaagctttcctttttcaaactcgtaaaactgaaagagtacattcataatggaactttttcctgagccagtatgaccgacaagtgcgactgtctcgccttgtttcgcttcaaatgaaatattttttaacacttcatcttttccattataagaaaacgacacattatcaaacttcacatttccttgtaagcgaggtatacgttcttcttctactgcttcccctttttcctctaataattcaaaaacacgttctgatgcaacgcgcgattgttctaagttagcaagctgattcaccatatttgtaatcggtgagaataatcgtgttaaataatcaacgaacgcatatagtatccctagagaaatgacgcctgtagcacttaatgaagcaccaccgaaataccaaatcacacctgtgaaagcgatatttcttaatacacctactaagttatgagaagttgctgcatttaaattcaaaattttattttgatacttaaaataatcaccatttaattcttcaaactcttttttcgtttcacgctcttgacggaacgcttgaataattggcatcccttgaatggattcattcactgttccgttaatatcagataaacgagagcgcattttatgattgtatacagacgcatactttctataaagaattgcccaaacaattaagattgggataataagtaaacataatgtcgccaattttacatcgagtaaaaatagcgcagcaaatatcccaataatatagatgatactagaaacgaatgttgccagcaccgttacatataaatcacgaatggcctctgtatcattcgttacacgcgacacaattttccctgctggtaaatgatcgaaataacgaattggcaacgtttgaatatgagaaaagacatcttccctcataatttgaataattttgttcgctgctttctgcaagaaaaattgctttccgtatgcaaataatgaaacgactactaataaagcaaaatagcctccaccaagtaataatagtcggtttatttctggtttataaaacgcaaacacttcttctttcgttaatgctttcgctttatacacttgcaccgccttaccgttttgaacggtaatcatatcaccttttacattccgcgacccttccacattcactttattcggtacaaaataatattgaaaaccgacttgcatcacgcgtacttcttttccttttttctcaccttcttggaagcgatcgcttcgcttataaaaggtgccattatacgaaacagcctcttcactcttttctgtttcataccaaggtttctctattccaacgatatgatcgtcaatcatcgttttcgcgacgaaaggaccagcaagctctgcgatgacgaaaataaataacattagcatcgctgcaaaaattgttccttttactttcatcgcatattgaaacaatcgttttgacacgctcatattttcaccccactatccgcactttcactttcaccttgttgtctttcaaactgttccgcataccagcctcccttttggataagctgatcatgcgtaccttcttccattacttctccctcatccatcacgagaatccaatccgcatgttgtacggcagataaacggtgcgtcgtaataatcgtcgtctttccgcttctctctgttcttatattttcaataatcgccgcttccgtacgagcatcaacagctgataaagaatcatctaaaattaatatttccggattttgaataacagctcgtgcaatcgaaatcctttgtttttgccctcctgataaagaaacacctttctctccgacgagcgtttctaacccttctggtaaaaactctaagtcttttttaaacgctgcaatttcaatcgctttctcgagttcctcttcagtcgcttccctatttccgaataaaatattttccctcgctgtttttgagaataaaatatgttcctgcggtacataaccaatccacccaagcacattttcattcgtcatttgatctaatgtcacatcagagactgcaatatctccatctccaagcggatattggcgaagaagctgacgtacgagcgtcgtttttccgcttcctgtttttccaacaacaccaagcgtttccccttgttttaatgtaaacgaaaccttttttaaatttgtttcagttgatgaaggatatgaaaaggtaacatcatcaaactgaatataatccggctcttgtacaagctttggatgtttcggatcctttacatctggttcatacgctaacgtttcatttacacggtcgagtgacgcatttcctctttgcataacattgattaattcaccaattgcaaacatcggccaaatcatcatccctaaatacacgttaaatgaaacaagttcaccaagtgtcacctttgattggaatacaagatatgcgccatacactaaaccaattaaataactaagaccgacaagcattttcacagttggctggaatagtgcatcaattctagctactttcatattcttttcgtagacatcatctcctaaatgatgaaatctttcttgatctgcattttcttgtacgtatgcacgaatcacgcgcacaccagcgattgactcaagtactttatcattcatatcaccgaacgcatcttgcgcaactgtaaatctttcatgcaatttctttccatatatattcatcgcatacgccataattggaagcggtataagtgccgcaaatgtaagctcccaactaattgtaaatcccatcataaagacaatcgtaagcatatataaactcgaatctacgagcgttaatataccgaaaccagctgtcatagcgattgcttttaaatcatttgtcgctctcgccattaaatcaccagtacgatttttttgataaaaagtcggcgtcatcttaagtaaatgccccataaatttagagcgcatcgttttctcaagcacgaatgcaccgccaaacaattgatgttgccatacgaaagtgaggccatatccaactatcgtaaccccaattaaaataagaatagactgtataatagcttcgttcgataacgttcctgtttttatattatctatcgtaacccctaacactttcgggggaataacttcaactatattcacaattaaaagagctccaatggcgatactatatctcctccaatgctctttaaaaaaccactttaactttagtaatactgaaaacaatgtaatctctcccttctcgttctcgtttacctctcatttctctatccactatccagacccatcacatttacatttcgtaacccatacaatctcatcacatttttccaccttccaaagttttatttagtaacatggaaaataaacaaaaaaaagcataccgccgcttgacgatatgcacaaaaatgcataaaagcgtacgttacgatatacgcaacgtacgctttttataagacaaaaatgccctatatatccgcacgggttgcgtaatgatataaatgttttctgccatttaacagagctaaacccattacatttacgattacaatcattacgcacacccccttcatttattttccatttataatcttataactttattgagtattctgtcaattgtttttttacaaattgaataaaaatatatgatccatcatttcgaaataagggaatgttctgtaagaaagggcatacaaaataaaaacttcataagaaatcgttttcacaaatatttcatttgaaaaatgttatcaaaccccatacaatcaccttatactcactcttacaagttgctattttaggaggactaatcatgacaactagcaatacgtacaaattttatttagatggagaatggagagaaagctcttcaggagaaacaatcgaaattccatctccatacttacacgaagtaattggacaagtacaagcaattactcgcggagaagtagatgaagcaattgcatctgcaaaagaagctcaaaaatcatgggcggaagcttctctacaagatcgcgcaaagtatttatataaatgggctgatgagctcgtaaatatgcaagatgaaattgccgatatcattatgaaagaagtcggtaaaggatataaagatgcgaagaaagaagttgttcgtacagctgatttcattcgttatacgatcgaagaagctttacatatgcacggagaaagcatgatgggcgatagcttcccgggcggtacaaaatcaaaacttgcaattatccaacgcgcaccacttggtgttgtattagcaatcgcaccatttaactacccagtaaacttatctgctgcaaaacttgcaccagcattaattatgggtaacgctgttattttcaaaccagcaactcaaggtgcaattagcggtattaaaatggtggaagcacttcataaagctggccttccaaaaggtcttgtaaacgtagcgacaggacgtggttctgtaattggtgactacttagtagaacacgaaggcatcaatatggtatcgttcacaggtggtacaaacacaggtaaacatttagcgaaaaaagcttcaatgattccacttgtattagaacttggtggtaaagaccctggtatcgttcgtgaagatgctgacttacaagatgctgcaaaccatatcgtaagcggtgcattctcttactctggtcaacgttgtacagctattaaacgtgtacttgtacacgaaaacgtagcagacgagcttgttggcttattaaaagagcaagtagctaaactatcagttggatctccagaacaagacagcacaatcgttccattaatcgacgataaatctgctgacttcgttcaaggtttagttgacgacgctgtagaaaaaggtgctacgattgttatcggtaacaaacgtgagcgtaacttaatttacccaacattaatcgaccacgtaactgaagaaatgaaagttgcttgggaagagccatttggcccaatccttccaatcatccgtgtttcttcagatgagcaagcaattgaaattgctaacaaatcagagttcggtctgcaagcaagtgtcttcactaaagacattaacaaagcatttgcaattgctaacaaaatcgaaactggttctgttcaaattaacggacgcacagagcgcggccctgaccacttcccattcatcggtgtaaaaggttcaggtatgggcgcacaaggtattcgtaagagccttgagtctatgacacgtgaaaaagtaactgtattaaacttagtttaatcttatacaaagaagctgatctaaaattagatcagcttcttttttatatagatacttcccaaaaacgaaggatttcgttctacttccgatttggttttccaaatcgaactaaaacatgccataataattttaattcctgaagcacttcttcataagttccacgatcactccaagataatggattgcgtttcaaatccgctacagcagaaccaattatatttgcatcgatacaatgattccgtgcaatgcgtcttgctaaagatggcatttttgaacctctaaaatccattggaacgtcgtctaccataagtacaaaacctgtgtgccaatacaaatcaatagcatacttcaggcaaatcccttctaattttcttcctacatccgtacctttaaatgaaggatctacaacaagagcttccacgtcttctttaagagaaatatctccatgaacttgcgcttcaatataatgattaagattacgggctggctctttgcttactaaatctataaacggcctttccaggttagccagtaaatgattaactaatcttgttggagtcaaattcccttcaccaattgcacactctcttacgaatgtctcttccaaaagagcagctaaaatcatatcaaactcctcataagtccccttttcttttggatcttgatgcgaatctaaatacgtatatgtagagcgagaagaaacttttggagataagagaaaataacatgatccaaaacgcggagctggcccatctggatgtaacatcaaatttagcgccccatactttggccgttgatcattcgttacaccttccaattgatatgctcctccaaatattctctgttcccaaaggtcacgttcaccgccaggataagcagatacgcttccgttagatagcaatgtttcaaactgacttttatatattccttgttcaaacaatgcttcagcaacacttttcatactcgaatcgagtctgtctggatgaaagtgtaaagcaatccttgcatgagattttaagttagcgacaacttcttcaaatatttcatctgtaatattacacatgttaagtatatgattaattgttgctttcgcctcacgtttttcgttctctgcatattttgaaatatactctaaagcaaataattgagaccttaataattccataatccaatctcccctttaattgaaatgaccttaatcctttcaattaaaagtgcattttttccttcttatgcaactaacctgatttattgaacaaaaagtactttcatacagtctaattacagatgcgagcattctttacgggtaaatccacacattctacagaaatgtgatatcctagccaacgctcagcaatatgttcaaatgataaggcagagcctgttgtaaaaaatcgatgctcaggattcagattgtcagacaaaattcctttatgctgtaaaattgtgcttaactctatcgctgtttcttctgcagaactaataatcgttacatcctctcctagttcctttttaatataagactctaaaagtggataatgcgtacacccaagaattaacgtatctatatcttctttcgttaatggcagtaaagcttgttttacttgctcggttacatatgctgtatcttctaattgattttctacaactgtagctaaggtcgggcacgcatgactatgcactttcaaatatgtatcaagctcatgcaatgctttttcgtacatattagattttatcgtacctacagttccaattactccgatttcccctttcttcgtcactttaattgccgctcttgctcctggatggataacgccaataactggaatagaaagtgcttcttgcagcgcagtcaatgcagcagctgcagcagtattacatgctacaactagagcttttaacggaaactgtttgaggaactcaaccatttcaaatacgaaagattgtacctcttctacacttcttggcccatacggacaacgttcattatcaccaatataataaatgctctctttaggcaattgtcttataatttcgctcgcaactgttaatcccccaactcccgaatctaacacacctattactgaatgtttatgacatacagacatatacttcatccccttttcaatcatctagcgccaacaacatttattatattatgaaaattcaatattacataataatccctcttgcttttaatcacaaactcttctctataatctgattattattatatccattgacgtataaaaattcatttgttactcttaaatacgttaaattaatatttaaatcctcattcgtatctcggtgaggtagaggttgcagtcattaagagtatcatttcaggagatgtagtggcattgatgaacgaatgagaaaggaatgattgccgaagtaagcccgtgtccaccatgcacgcttgctgggtctgctacttaataagtgcagaactgtcacaaacgtttcgtttgtggagagctatcgagaggtatgtcgtgggtttcttataagatagaaagcatgtagcggcaaattacgtgctttttttgttttgtttgggacttctcttcctgactcaggaagacatacatatctcctcgcttgacttggttatactaactttggaggtattttctatgcaacaaaaaaaatggggcttttgggtactcacagctttcgttgtcggtaatatggttggcgctggtattttcatggtgccaagtacgttggcacaaacagcaagccctctcggtgtcactttagcttggttaacaacagggtttggtgttttaatgctagctcttgttttcggtaatttagcaattcgtcgtcctgatttaacgacaggaccacaaagtcatgcatatgctttattctcaacaccaaaaaagaaaaaaatggctggtttcagtatggtatggggctattgggttgcaaactgggcaagtaacgttgccatcattacatcatttgcgggatatttatcactcttcttcccgattatgaaagatacacgactactattttcaatcggttcttttaatgtagaagtcggaaaactaattacatttacgatttgttccatcttactttggggaactcatattatattaacaaacggtgtaagcggagctggaaagctaaacttcttagcaacaacaacgaaagtaactggattccttttatttatcgtcgttacgttatttgcattcgaagcttctaagtttggacaatggtacacaccaatgatcgataaatcaggtgtatcacacggtctactttcacaagtaaacttagctgctcttacgacgctttgggcatttatcggaattgaatcagcggttcttttatcaaaccgggccgtttctccaaaaacggtaaaacgcgcaacagttgcgggattacttattacagttgcgatttacttaggaattacaattttaacaatgggtgtacttcacattgataaattacaagcttctgaacgtccattagcagatgcactaaacgctgcaatgggtcatggcggcgggaaactgatggcattacttgctcttacttccctattcggttccatcttaggctggattttattaagctcagaagtaccgtatcaagcagcaaaagaaggtttcttcccttccttcttcacaaaaacaaacaaaaaaggaagtccaatttattcattacgattaacaaacattatgtcgcaagtgttcttattctcaacattatcaggaacaattgcggaagcttatacattcgttattactgtatcgacactggcctacctcattccatatctcgtttcaccaatcttccagttaaaactagtcgcaactggtgaaacgtataaaaatgaaatacgggcaagaattacagatggcatagtcgcagtgattgcactttgctacgcactatgggttattaaaacgggcgcagccgatataaaaacattccttctcggaattggtttattcgtaatcggctttgccttctatccattaatgaatcgtgatcagaaaaaaaataacgaaaagaaaaacgggcaagttgcataacgcaatttgctcgttttttcttttacaaaacatatataatagaacaaagaggtgaaaaacatgtcaatcgaatcactatggagcagccgtttccaacaacatatgcaaaatatcattacatactttgcacgtatgattaacggtttactatatagctttatctttatttcatgtgttggtgcatactattatgctcagtttctaaaagcatctccttctaaaggaatatctttactactcatcacgattgtacttacattcattataacgagatgccctattcgtacatttattcagaaacctgacgctgtctatttactagcactagaagagaaattaacttcttatttcaaaaaatctcttctatacaattacatcattcagcttttcccattgttatttacgtttcttattctcgttccgcttgcactgcaatcattacaattaacgatacctttcttatgtacaatctttatcattttaatggttacgaaagcttggaacatatacatacattggatgtggcgtgattgtcacgaaaaaaatatatggctgattattcgtattgcttgtaacgccctagtcatttatatgctgttttatgtagcaaatgttctcatattaggtggattactcttactacttgctttcctacttctatacacgaaaaaacagcctacaaaacgaataccatgggattacataatcgagcaagaagaaaaaatgaacgttcgtttttatcaatttgctagcatcttcactgatgttccgcaactaaataagcaagtaagtaaaagaaaatggcttacaaattggattgaacctttattacataaaaaacgagcaactttcttctatttacatacactcgcatttttacgcgggaatgattatttcggtatatatattcgcttagggttgatcggtgcctttgccttatattttataccaaacgtatacgtaaaaggcgctatcgcatatatcgtcctatatatgatttctatgcagctccgttccctatggaaatatttttcgggaaatattattgtagcattatatccaattcatactgaaaaacgactgaatcaatttcttcacttaatctttatattgctacgcattcagctcattatattttcaattgttatactcattgctacaggtcaatttttacatagccttatcattatgattgtcgggttactctcgatcaaatttattattgtaccaaaaacgaaacaacgcatttcttcgttttaacgaaaagaattatcttaaaaggcaaggagaaaataaattctccttgccttttttatttttcctcctcaaacaagaatcaccggcacaatcgatattttataattttacatacaaaaacgataatacatgtttacgtcctaataaaaagggtatctattaattaacagcgtaaaggaggggcctatattgtgaataaaaaaatggaacaattgaagcaccacgttaccgacaatcaacgcaaacacgctttaacaacaaaccaaggagtaacaatagccgaagatgaattttctttaaagatgggcttaagaggcccaactttaatggaggatttccactttcgcgagaaaatgacccactttgatcatgaacgaattcctgaaagaattgttcatgcgcgaggagttggcgcacatggtcattttcagctttatgaatctttagaggcatatacaaaagcagattttcttactaatccttcaaagaaaacacctgtatttgtacggttctcaaccgttcaaggctctaaaggatccaacgatacagtaagagatgtgcgcggattcgccacaaaattttatacagatgaaggtaactatgatttagtaggtaataatatgccagtattctttatccaagatgctattaaatttcctgattttgtccatgcagttaaaccagaaccacataatgatattcctcagggagctagcgctcatgatacattttgggattttgttgcacataatcccgagtctactcatatggttatgtggcagatgagcgaccgggctattccgcgtagtttacgaatgatggaaggttttggtgttcatacatttcgacttattaataaagaaggaaaagcccacttcgtaaaatttcattggaaacctaccctcggggttcattcattagtatgggatgaagctcaaaggattgatgggaaaaaccctgatttccatcgtcaagatttatatgaagcaattgaaaaaggggattatccggaatgggagcttggattgcagctaattccagaagaagatgagcatgcatttgattttgatattttagacccaacgaaattatggccagaagaagaagttcctgtaaaactagttggtaaaatgacattgaacaaaaatgttgataacttctttgcagaaacggagcaggtagctttccaccctggccatgtcgtaccaggtattgatttttcaaatgaccctctcttgcaaggaagattgttctcctatacagatacacaattatctcgtttaggaggccctaattttcaccaaattcctattaaccagcccgtatgtccttttcataataatcaacgtgatggcatgcatcaaatgcagattcatcgcggtcaaacaagctatcatcctaatggcttaaataataatcaaccagcaaccgtgcaagctgaacagggcggatatgagcattatcaagaaaagattgatggacataaaattaggaggcgcagtaaaagctttcttaacttttattcgcaagctaaacttttctacaatagtatgagccctattgaaaagcaacacataaaagatgcattttgctttgaagttgggaagtgcaaatcagacatggtgaaggcaaatgtgattgctcttttaaaccacgtcgatcgtcaattagcaaaggaagtcgctaacatgattggagcccctttgcctaaagaaaatcacgaaataaattcggatgcaaaatcacctgcactaagtatgtccaacactatttttaaagctgattccaaaaatgtggcaattctattgaatggtgacccaagcgtctcccttctgtccgaatggattcaagcttttgtacaacaccgaatgaactatagcatcatagataataaaattcatcaattcaatgattccattaaagtaacggatacttatacaacagcagactctgcactttttgatgcggtattagtgtttagtagcgaatctgtcattcaaccccctgttttagaatttgcagaaactacttttaaacactttaaaccgatagcctatgtccttagcgatcctcatgctttagacaatagtaaaatcaaattagatggagcaggaatttacaacttaacaaacacttcaattgagtcatttatagaaggcattgcccaaggacgattctggaaccgataatataatataatataaggagcggattagaatgagtaaaaaaattgctattttaataacggattatttcgaggacacagaatacacagagccagcagaagcttttaaacaaaagggatatgaattaacaactattgaagcagaaaaaggtaaaacggtacacggtaagcaaggaaaaagtgaagttgtaattgataaaggtatcgatgatgtttctccagaaaactttgacgcactcttcataccgggtggattttccccagatatacttcgtgcagatgagcgtttcgttcgctttagtaaagcatttatggatgcggaaaaacctgtttttgctatttgtcacggaccccaattactcatcactgcacaaacacttgaaggacgcgatgtcactggatataaatctattgaagtcgatttaaaaaacgctggcggaaactttcacgataaagaagtagtcgtatgccaaaatcagctagtaacaagtagacaacctgaggacatcccggcgtttattgaagaatcgttgcgtatattgggatagttattaaagattaatcaaagtagctatttagctactttgattaatctttttatttgtatgaaaaacaaaaaagaaccttatttttaatgatcttttcatacaccctcttttctctccccggaacttctaatcacttttcataagcagttctcatatagtgaaaatgactatacaattcctatccataagttaaatcatgattttacacatatataaatacaaaagatgggagccttatttatgaataacaatccaccttcaacgcccccaaatccagcggaaacgaataataatgaagtgagcttacaaacgttacgcgtcatcggacttattgtactgattagtggctacatattagtcactctttctgaagtaggaacgttaaaaaatcttttactacaaccgagcaccactccaaatttagctgaagttgatccgttttaaaagccatatgaaaagcgatttctagcatcgcttttcatatcgttttatccaatctgagaaacctccccctcatacttctctctcccaatcgccttcataaataataaaatactgctcataccaacgataaaatatagagcactcatgccccaagatgcgataaatgaacctagcataacacccaatgccccgttcatttttgccacttgaaagaccattccgttaatcgccatatatgaacctctcgcctcatttggtaccatatctgccataatagattgacgcactggcacatacatcatctcgcctaccgtttggaaaagccctgcaattaataaaatccataaactattgctcgttccgagtattgtaaatccaattgtataaatgaataagcctacatataatattttcaaatcgttgaagcttttcagcattttaataagaagtgctgaacataatacaactaaaattgtattctctgcagaaatccagctcagcatgcgaatacctgttaaatcaaacgtaacaccattcccgaataaaaagtgcaccgtttcaaattccttctgcaaacgtactcctaaataattattaatctgaaactctaacgataatgtacatatacttgctgcacaaaaaattaaaaatgctttatctttcattacgactttataactatccgccatatcttttaatacatttttcttctctactatttttctagctacatacacctcttccatatatacagccatcacatataaagtaataactgcaatcactgttaatccgataaacaattgcaatctatagttctcaaatagtaacccgccaaatatcgctccaatcgcaatggataaattaattgcccagtagttaatgctgtacatcacttttcgattctcaggtgtactcacatcaattaacatcgcctctgtcgcaggattcataagtccagatcctaaactattcactaacataaatataaatgttagccacggtgaatctacataatcggaattcgcaatccccatacaagcgatggaaatgacttgtatactttgaccgataatcattacttttttacgaccgagccggtctccaacatatccaccgtataaaccaattactaatgaagctatgacattaataagtagtaacgcaccagcaatcgcactacctaactttattgaaaaataaatcgccataaatggaaaaatcatcgtggatacagtacgtgttaaaaacgaagttataattctaatttttatatttcgatgcatactccaaaatcccattgtttccccctccttacgcttacttattttactttgaaaaaaaggaagaaaaaggttagaatattctaaagagtttccccttttatgatagaaggaagtgtatatatgaaaattatggactattacattagactaagactacatgcacaagatcaacaacatatgcgaaatagcttacaagaattagcagatgttttatattgtagtacgaaaaacgtaaagattttattaaagaaaatgagtgaggaacaattaattagctggactccagggcgaggacgcggaaataaaacagaaattctatttatacataatttcgtagaagcgattgagtcctatacagatgaactgttagcgcaagaaaaattaaaagatatctttcttcttttaaaagaacccctaccccttgcacttcaaaaaaagatagaaaataaactacatcatcattttggatacgaaccttcaaatgatatgtacgacatattaaaaattcctatatcgagaaagatattccccttagatccggcttttgtggctgtaactacagagagccatcttacgaatcaaatttttgatacgttagtcgtttataacgatgttacggaaaaaatggaaccacacattgcgcatacgtgggaattaagtgaagacgggctgacgtggactttttatttacgaaaggacattcattttcataacgaaacagttttaacttctaaagatgtacaattttcatttgaaagactaaaggaagttcactctcctttcgaatggttaacagcagaaattgttcaaattgaaacaccatcaccactgcaaattcgatttcatttagcaaaaccaaatttatttttcttacactatgtaagttccatacaactagcaattttgccgcgtgatgcagttattcaaaatcaccattatataggtactggacctttcaaactttctcattactctgaagataatatcgtactcgaagcattctctcattattttaaagagcgcgctttattagaccgtattgaattttggagtattcctgatcatgtgcaaatcgatgctgattatgaactaccaaatgaagaagaaaatgaaaggcatgatatacaaatagaagaaataggttgtatttatgctggcttcaactttacaaaacctggtccccatcacgacatttactttcgaaaggcttggagagaactatatgatgttgaaacgatacttcgtagcatagagggtagacgaacaattgctgcatcaagctttttccctgaaagaagtcgccaagcttctaaaaggtcttactctttagaaaaagcgaaagagtatttaaaaaagagcacctataatggagagacgatacatatttacttcttcgcatttaaagatagtgcaaatgatgcatatttcttaaaagaacgatgtgaaagtttaggtatacaagtagagcttcacccatttctcgtttcagattatatgaaccgttctatcgatcaacatgccgatattattttcatcggagaagtgtttgctgccgatcatgaacttgcatttttaaatgtatttaaaaataaaagttgctttgtaaaccggttcatggacccgcactatgaaaaacaaattaactgtttgttagatacatttttattagaagaaaataaagaaaagcgctacgagctcatgtatgagatcgaagaatttttacaaacagaacacatcattttatttaactatcacgttttaaaaagaaagacatacccttcttctttaaaaaacgtaacaattgattcattcggttgggcaaattttgcgaagttatggatacagccatccatgtcttaaaatgcgattcattataaaaggagaaggtactacatccatagtagtaccttcttcacatacaaatataaactattatttaattacttcatctaagtgatctttcaagttcaataaatattgttcaatatccggattcttcaccacatcataacaagcaaaactctttaacggactcatcccaagaaacttctgcacgcggtgtaaatgactaagcgttgattctagactttccccttcaaagaacttcgtcttatctccaaatgaattttcaggtgcattccaagttgtagagaacatgtactctttctctgttaataaaccacctgttccgtattcatctgcacctttaaagaacaaaccgtattcatatacttcatccatatacgttttaaataatcctggaacactaaaccaataaatcggtgtttgataaatcacaacatcagcccataaaaatttatcttgttcttcctttatattgtatccatcttgaatcgttgttgttttcacttgacggttctcgcttaataccgtcaccatatgatccactaatgttttatttaatcgtccttcctttgtaccgtatttttcatgtccatttataataaatatatttttcatcgtttttctctcccctactctattcctcgtttattaacccaagttgctgtttcaacgtaagattatcttctaaatgccagtcttccgtaatctttccgtctttcacatgtaaaatgtcaattgcaaaaaaattaattttcttaccgttatgcgttcctgcaaaagaaagacgagctgttactttatcaccaacaaccaataagtcttcaatcttgcaatgtatatcaggcacaactttacgaaaattttgtgctgcaaactttaacccttcaatgccttgtggtcgcccttttggcaacgtattatcaaaaaaatctttcgtaacagtctgcgaaagaagctcctctttacctgtatcccaaaatgcataaaaacgctgcgctgcatgaaccatttcggtcgcttccattttacttagtgaaggatcgattgtcattgtttttgcctttggcatttcttttaataactggacttcagttttttcctccacgccacatgctacaagcacaatacaaataacaaacaaactaagaaatccaaacaacttttttacccccatgaaaatcacctccccctcatctaaaccctttgtatttcatattgctattgtatatgcactaacttcctttatggaagtagtgatatttttttcatatagttaccaaaagtatagttttgtgatactataaagcaaattcattcaaaaaattttatggaggctagttccatgaacaatatagatccagttgaattaacgaaaggtttacctggcataccttgtcccatcgctaaaacgcttgatgtaattcgtacaaaatggacgtttttaatcattcgcgaccttcttatcgaaggaacattacgctttagtgatttacaaaaatcaatggacgggattagcccgaaaacattatcgcttcgactaaaagaattagagtctcaaggcattataacgagaaaagtatatccagaagttccgcctcgtgtagagtacacattaacggataaaggaaagcaattagagaggatttttattgaattaaaacgatttggattaagtttataaaccaaaaaaccttaccattgttaaacaggctataattagaagtaattatagcctcattgaaacgtaagattaagaagttaacagaagagaagaaacaattacgtgagcaattgaagattgcttatgcagatatatacaaaaagaatttagaatatgagggggaactttgtccacctttattctgtcactaagtagcgtataaatttatattttattagtttatcttcacactattaaacgtctccatatgtgtgcatcaacttaagaattcagaattaccccaaaatgaaaaaagaactttttgttacaaattaacacaaaatttcgttctggagatgatcacgaataataaagttattgaaaaataataaagtcgtttaatttataataaaatcatgtaaaaaaataatttagtttctgtatgcgtgatttttctttttctataaaaggacattgtgaaaaaagttggcaacatcaagaagatgatttctgtatccaacaggagtcatttttataaattccattgatatctattccaaattttccttttattatacaagaaataccctatagaatatcctttttttattttatggtgaaatattatctaagattttttagaaacgggttttgttttcgctcagtctgaatatctgtgatgtctccatgcccacttaaaacaagtgttttttcaggcagactaaatagtttttcctgaattgttttcattaatctattttgatctcctccgattatatccgttcgtccaataccacctttaaaaagtacatctcctgagataataatactttcatcttttatatagtaagatatacttccaggtgagtgcccaggggtaaacaatactttgaatgaaaaggaatcgatatgaatctcttcttctatttcaatcagataatctgctgattttgccgtagttttaattctaccaggtaaagcagaacgatttaattctgtgttagtgagccaatcctgttctgcctgatgaagatacaaagggatattccacttgcttcttacttcatctactgccccaatatgatcaaaatgagcatgagttaaaagaatagctttggggattaaatcatgtttttttatgtattgattaattttgtctgattatgatgataggtaaggctttgatgtaatctccaccttttcccccacctcacaccgtacgtgctagtttcctagcatacggcgttccatcgtttccaactgactttaaaatcaaattatgttactatcggttcatttccagctttagttcttagcacattcagtttatccatttgtttcttgttaagtttaaaagaccgaaggtaatgtgtaatcttattaagattcgtcatgtgaatcagtttgtgtataaaccaatctacaattaccaagttgttgtacttgtcatccccaccttgtttaatgggaacaatgtgatgacaatgaacacgttcaataccaatttcctcaccagttacataacacttaccatattgagcaacgtattttgatatcctattatcgttgtactcaatacttttattcttcgaataagtcctcataacttggttgagaacatccttaggtattgccttaagattactatgtactttattacgccccgtttccgtatagttacagataacctgcgaaaaattccacgggtttttatgatgtattcctgtaactggtaagagtggagtgttctgtacaacgtaaatcttagtgttaggttgtattcctttggtcttccttttaaaattcacagatgtttcacagaacttcatgtgcttcatattgtttctaagtctggttcttatgactcttcgcagagagtaatttacctccgttaaatccatgtaaattgtaaccgcatatttaaagtaattttgtataccaagaagggttgaattaaattgagtaactttctctgaagtgggctccttttgaattcctttgattcgttcttttagttgtcttttagcttttgtaatagctttgtcggacatactggtttttgcaatatatccaaatttagctttaccttgtttaaccactttgattttgaatccaaggaaaactgacgagtttttcttgagattaaccactttggactttttggggttaatttctaatcccaagcgggatttgagaaaatcaactgtcgcatgataaaagcgttgtgcttcatcataagtccgacacattattttgaagtcatccgcgtatctcactacataaccacattttagattcgtgtacttcctagcatattgtcgaaaccctaaatgccgagtagagattctgtgaggtttgtaggtttcccattggctacttatccaccaatcaagttcatttagaacaatgttggaaagtaaaggagaaataattcctccttgcggagtacccttattgggaataccctctccttctatctcagatttaaggatttttgaaataacacatagaagtgatttgtctcttattcccagagtccacatttgccttaatagctttttgtggcatacattatcaaagaaccccttaatgtcaatatcaacacagtagtgttggtgacctatgttaataagacttacaactctacttagtgcatggtgtgtacttctgttcggtctaaatccataactatggttatgaaacttagcttcacaaataggttccaatacttggaggatagattgttgtactaatctgtcccaaattgttggaatccccaggggtcgcttcttatcactgccctcttttgggataaggactcttttaactgcttgtggttgatagttatttaatcgtttcctaacttcatgaataatctttgtatcgtttaggtgccaaatatctttaatggttaaattgtcaactccagccgtgttactccccttattagttttgatgttgcggtatgctaatctaatattttcttccgaaccgataatatcaattaatttatagaaattgttaccattaaggctattagaatataactcatcatactttctttgcatgtcgtaatattcactgtgccttagtttagttttctttaacatgggctgtaacctccccttatttactggaggtttacatctctttagtcttactcgaaaccatgtcaaccataagtaacagtcagttttcaatcgactagtggctatccctccacgttcattacacgtttcataggtactgtgccaccactttcactgtcataaacctaggttatacaatttacaattgttttccctagaaccacttcatcggaagcaagccctcagtgttgacagcttaccacgttccgtcattcctatctgtgcatataccgttaggtttctcctatgagcctgctaccttgatattgcctgtaacaatatatggactttcataaaggcgagttttactcatccacagtagcgacactaattgtgtcagtaagcctttcgacttacttccgatatagacccgtaccatcagagattcgtccgcacataccatactctattggttcatagtgcatactaaccataggtaatttatagacttccggtttataggttacaccacccacctctgagtgactttcgtatcctataggattacggtaactctcaaccgacttcaccgagcttcatacagttcagttcttgctaacttcactgcatgtcggagtattaaaggaagcccttcaaggcgttaccctatcatttgacttcttggaatgacagttcactgttgaactgtaagttcgacaatgcctaagcttttcacttaggaacgtgtcgcaccgccaccaggatcaattattacgcatgctttatcttcattagataaaatgtatgcatttgctttaagtggtcctacaggaattcgtatccatttcatgttgtacacttcctttgcgtttacattactgaagttactataaaatacaattagaactttacatttaaaaacatctttattctatctaaaactactattatcatttaacacaatattcttgtaaaccttgtcggaaaaagaaaggttgtttaataattattctactgaaattgaacaactttattatccctacacaggaggtactaaaaaaattttgcctgatagtaataggatggggcctctatataaaaaaccacagtttacactcaaactgtggtttttcgacgtacaatgatttatcaacatctcgttttattctttaaaatttgcaactgaatcaggattcccctcaaattataaatttcaaggggagatccgttttttatttacttatatacgtacagctgtaccacttacagcaaccattaacattccatcacgaactacttcgtaatctacgtcaacaccaacgatagcgttcgcacctttttgttttgcaagttctttcatttcgtccatcgcaatatcacgagcatcttttagcttactttcataagaaccagcacggccaccgacaacatcacgaactgaagcgaataaatcgcgtacaatgttggcccccataatagcttcaccatttacaatatcaatatactcaataatttctttaccttgaattccagaagttgttgttacaatcatgtttgacaccctcctattttttacaatcttcaattacatgtgtctctctatcacatatgtaattaaaaaatagcattaaaattgtttaacatatgtatcgctataacatatgcaagggatctattagaaataagataagccgcagtaagcatcaccgtgccaggtaaatatatagcaagatccgaaagttgatttgaatgaagacctgcaaaaattataatcgaaacgatggatgcaatagcagtaccaatatattctgaaaaacgatttactaatatatgacgaaatataatttcttcaattattggtcctataatcccaaatagaagtactgtgaatataataggcacctctgcgccctttgaaaggacctgttcttggttctctagctgacctatgtttagaaaatgcataatagaattttccacaattaccataagtaaaaccaccataggaacgcttactattttcaaaattgttttctctttaaaataagtaaaactttcaataatttctttcctaaagaaaatgattcctacaatagcaggtacagtcaaaccgatggcactaagagcaaattctgattcaactaagttgctgttagttaaaagggatatgccaaataatatgaacaagccaatttgaagtagtgcaaacagtatataaactattagcataacaagttcttttgtattcatttttataaagctcactttattacctccataatgaaattacttagaatctttgatttttcttgttgcattaggttctccttctaaaatataattatataaataccaaaccggacggttcggttcgaaaactaatgatactataagtttctaattttttaaaccccttttataaattattaataaaataaaaataaaagcaaaaatattaagatgttcgcatagttaagaaaagggtagtttttaatgttgttgtaataattgaatatgaatttgaaaggatgtacatcatgattttagttagttcttgcttagctggaaaaccagtaagatataatggtactgcatgtttaaacgatacaattcaaaaattaattgatgaaaagaaagcgatacctgtttgcccggagttattaggtggttttgttacaccgagagaaccagctgaaatcttgggcggagatggatatgatgttttagagggcaaagcaaaagtaatggaacgttccggtaatgatgtgacggaattatatataaatggtgccatgaagactttaaatttagcacaagaaatgcaagctagccatgtagttttaaaagaatatagcccttcttgtggcagtaaagaaatttatagtggtgagtttgttggaaaaaaggtaacaggagtcggcgtaacgactgctctattagaaagtaagggcattaaagttatatctgaattagaattagataaattaattaataaaatataatattagagggcacattttaacaattcgcttaccgaaattatcaaactttattataaaaataaatagcttgtaaaatttcaactcacgcattttaatcaaatttttttcaaaatgcgtgagatttttttgtgatgaaatcaatggtttcgcttaaattttaatcaaacttaatttcaaaccaacaaattcacttattttacatggataatataatttgattaacttcttttcaaactgtattgtttgagattttcataagatagcgattgataagatatttctgttccgaacttatttatactcacaaaaaaatcaagaaaatagagggtaaacattacctagaatattaggatcgttttcattaggaggacaaagcatgactaaagttgataaggtaaaagaaaaaattattgaaacatctttatatttatttaatactaatgggataactcgcacatccattcaggatataatgacagccactgaactaccgaaaggatctatttatcgtagattcaaaaataaagaagaaattgttcttgctgcctacgacaaaagtggtgagattatgtggagtcattttcataaagcaatggaaaataaaaaaacagcaatcgataaaatccttgcaattttccttgtatatcaagatgcagctaataatcctcctattgctggaggctgtccattacttaatagcgccattgaaagtactggcgtatttccagaattacaaaaagcagcagcaaaaggctatgatgatacagtaatgttaatggcctctctcataaaggaaggaatagagaaacaagaacttaaagaagatatagacattatatcgctcgcttcttttcttgcctcttcaatggagggagctattatggcaagtcgagtatctaacgataatatacaccatcaatatttcattgaacaaataaagcatcatctttactcttattctaaataagtgagaacttgcatcgccttcattcaatttttataaacttaaattcaataaatactcctcataaaaagtatcttctgtttatgagggggagatatttttttagcagaggtagcttacagaagaaatagggttgtttaattcgaagtacataaacacaaagtggcccatcacatacccacttggacctatgttatctgaaaaatggttaggcaaaatattcattagacgaatagcaattacaggtatttttgaatttggtttcagtttatcactcactgtatttacataatacgaaacttagggcaagtaattggaatttctgtacctagtttatggctaagtgaccaactaaagaaattcaagctaactttgtatctatataacgaaaaaaacgctattctttttgtagaaaaatacagaaaggatggcgttttgtatgactctatcgattcaatatgagtttcatttattcgctgaagaattacagcgatatctatccccaagcatccttcaacagctcgcacaggagacgggtttcgtaaaacgtaaaagtaaatatggcgcacgtgatttggccgctttatgtatttggattagtcaacacgtagcaagcgattctcttactcgattatgcagtcagctttatacaaatacagctacactcatgagcccagaaggactgaatcaacgctttaatccagcagctgtcgcatttcttcgagaagtctttacttctcttctcaaacaaaaactctgttcaaatcaatcactttctgcacatatgatctctactttcaatcgtatccgtattttggatgcaacagtgtttcaactgcctgatcaattggctactgactatcaaggttcaggtgggagtagtaatacggcaggcgtaaaaatccaattggaatatgatttacttagtggtcaatttcttaacgtgcagcttggaccaggaaagaataatgataaaacatacggtaccatctgccttgagaccgtagagaccggcgatttgtgtttacgtgatcttggttacttcgatttaggagacttacaaactattcatgataaaggggcttactacatctcgcggttgaagttgaatacgcgcatttatatcaagaaccctgaaccagaatatttcaacaatggtatgttaaaaaagcaaacagaatacatccagcttgatatgacacaaatgctgtctggtctaatccctggtgaaacgatggaaatccccgaggcatacattggtcaaaatcagaaacttccagcacgtgttattatccatcgtttaaccgatgatcaaacgcaaacacgtctgaaaaaccaagcgatacgtgaaaagaagaaaggcattgtcatgaaggataaaagtaaacgtttaatgggcatgaatgtatatatcacgaacacgtcgctagaagaagtaccgatgaactacgtgcatccattatattcacttcgttggcagattgaaattttgtttaaaacgtggaagtcactctttaaaattgatgaatgtcaaaatataaaaagagaacgcctagagtgccatttatatggacaactcatcggcattctcctctgttcttctacgatgtttcaaatgcgtcagtttctgcttgaaaagaaaaaacaagagctgagtgaatacaaagcgatttatatgattaaagattactttccattactgtttcaagcgatagccgttggcacagaaaaacttttaaaaattttgcatcgcctttatcagctgctcaaaaagaacggtcgtaaatgtcataggtataagaagatgaccgtctttgatattctagggattgtgtataaaacgacagtgaagcatagataagctgcctagcgaaaaaatcacgttttaataggcttctttagcatgcctatttttctatcaattactagttttgaaccaagaatcgtttcatatctagtaagttacttgtttagcttgatggacatggggtatacacgcaaagcaactaaatctttggcttgttatttactagttcgttgcacaaaccctacatttctagcaggatctcgtaaaatattagaggataaaagaattgaatttcttgagtaaatagttaagagttctctatatttttaattatttctttttcaatcttctcaagttattttatctaaaatatgattaatgtgcgccacttaatttaactaaaatttttgcttgcgctttatcatgaattaacgcttcaaaaccttgttcagcaatattatctatatcaactttgcttgtaataatggattgtgcaggtaatcttccattagcgagtaattgaatgacctcattataagtttcattactgtaccccacagatcccaataattttacgccactaaagagtaaggaagcaggagcattaaattggatatcttgagtatggaagctgataaccatcattgtgccacgaactttagttgattgaatggcttgattaaatgttgactcaacacctgcagcttcaattgtcacatctgctccatctgggaataatttacgaatttcttctacagggtttacttctttagcattaaagacatgcgtcgcacccacttcggttgctttggcaagccgactatcaaataaatcaacaacaataatattagaagcacctgcagcttttgcacctaaaacagcaaatagcccaatagggccggcgccataaacaacaacagtatctccttctcctacatttgaatccttaattgattggaatgatacagctgctggttctaccattgctgctacttctagtgataaattatctggaattttaaaaatcgttttttgtggaagtatcacgtattcagcaaaccctccgtcgatttgtgcacctactgcgtctaaagtgataaaacgttcagtttcagcatttgaaggatctttaagcatcattggataaatacatactctgtccccttctttaaattttgttaccagggaaccaacctctgcaatttcaccagagaactcatgtccgattaccatattcttattcattggtactgaatctggatgcaagtatgcatgtaaatcagaaccacaaataccagcccatgccactttaacttttacatcattgggttgtaactcttttgtttctctttcctcgatacgaatatctttttcaccataccacactgcggctttcataaaaaatcctccctcaaataattggaatattatatataattttcatttaatattagatcgtaattcgttttttaaagcataacggtaattttattttgctctttaaccttactcattcctcctttgctatgttcaataatctatcataggtttttaaggaagacgatgagcaaaaaataatatacgtctcgaattgagacatttgttttaatttggttcatttatcaataagttcttagaaatctgaatcaactcttcttttgtataggaatattcattgcttaaccatttttttataatctcaaaaaagccactacagtaaaaatcacacagtaccattggataatctgagttttggatttttttcgaaagcggatcattatattccattgagttttcatataaattttctgcaccaaatcgaatcaatttttcgtataactcaaggctattatttttactagtaatattaaaaaacaatgcacgattaacatctatgtattcaattatttcctcaaacaatgtatgttctaaatccaatccttcttttgtttgttcaaaaagattgattgcgatggaatttgatacatcgctaaataattcatatttatcctcataatgacggtaaaatgtgcttctatgaatcattgctttttcacaaatatgattgattgtgatggatgaaaatgttttttcttttaataaatccataaacgcatcttttattatgttttgtgtgcgtaaacgtgtgaaattactcaattttagtatcctcctatattgaatctaagtactgcatgaatttgtaattgttttcctaatccttatctccttttagtatgcctaaattaatgataatctggcatttccccacgaatataatccttttatgaaactgagatggatcatataaatttggctctggcgcgaatataccagagccaaaatatttaatttagttcactttttacagggaaagaatgtaatccatatatagaactactatttgagataggaacaggaagatcctggtcaataaatgaaaatgatttatatctttttattaattccgttaatacaattttcgcttctaatctagctagaggagcacctaaacaaaaatggatgccatgtccaaatgtaagatgaggattacgtctacgatatatgttaaaactatcgacatctttgaattgatgcgagtcacggttagctgatccaacccaagctgaaatgatttggtctacttgtaaagtttgtccttttaattgaatctctttttttactctgcgtacaattctttgaactggtgaacgataccgcaatacttcttcaattgctttcggaacaagagatacatcctgttgtaattgatcataaacatttggatgttctatgaagcaatataaagcgtttccaagtaaattggttgttgtttcatttcccgctactaaaagtagtttacaaaacggtactatttcttttcctgaaatatttttgtccgcttcactttgaactaataaagaaataatgttatttgaatcttttttggatttccctcgattggattgtataatttcttcaaaaaactctcctaattcattttctgcttgtaaacgtgtattaaaaaattcctccaaataatccgaatcatcatgactcggtgaacttacgataatatcagaccatctcttaaacctttccatatccttagcagaaacacctaacatttcagcaattactataactggtaacggataaaataactctctaacaatatcaaaagtttcacgattagataattgattgagtatatcgtttgtgatttgctggattctaggttcccattcccttaatgctttaggagtgaaagaccgatttacaatagaccgaatttgcgtatgctttggcggatccatcccaagaatactttgtggaaatggagactttttcttctcaggcataatactagaaaagtactctttatcctctaagacagtttttacatcttcgtacaaaaaaacattccacatgtctgcctgatgattaaaacaaataggctccttttctcgcatctctttataccatgcaaatggtttatacggatcttctaaagccttttttcccatcaacttatttgtaggaatcataacaactgattgataaggtgttttcatatacaacaatctcctctcaaaaaaatttcattacaccgaataatattcaccgaatgtcattcggtgtaatgaggattatacaacaagaaccaaaatattcaaactactttttcggttttaaaatatccgttaatatataaataagggggaatagacattgcacaaaaaaactctgacaaatagaaaacaacaagctttactaacacagaacaatatatttcatgtgtttttaaatttaatgagagaaaagaaatttgaaaatataacaattgaagatatttgtaaaaaagcaaatgtatcagtaggaactttttatcattatttcacttccaaagaggatatttataaaaaattatttcaacaaattgaagaaaatctacatgttgaattagaaaatatagatcaacatacaacaatgcaaacaactattttaactttcttccaatgcatagctgaatatacaactaaattagagttacatataaatcttcttaacgatttcaacaaaaggtcatttatatatgagccttcactcatttacgaagctctaaatggctttgtttacaaaggacaacttgaaaaagaattaacaaatgatatgagtgtagaagaaataacaacgtatctttttacaattgctagaggacttatattagattggtgtcttttagatggaaaatactcactagaacagagaatgaatacttatatgaatttagcattgaaatctttaaagccttaaattttaatcaagccctacgctttgttgcttcattttgtacatttcattcagttttattttttccaggtgttaaagcagctggaataaaagaaaaagcatgccccttctttatactgcgagaagggcatgctttttctttttttacaatacaacttataaatcccacatcaatccatttcaagatagttaatttcccttttcctatcccctcggaaaaggagaataacagtcaaaatacatataaaaaatcaagaaaatgaatatttcatacaggctagttttagtactgtgtatactttatatcgttaaaaacccattaaaaaatgaaccactttgagatatatgtcgcattttgaaacacataaacatttttgattatcgttttcctctaatgcctatgataaattgctatacatagctagcttacaattatatttctaaaaataatatttcacctttcataaaaaataaaaaggagtttttaaaatgaagaaccgagtaaacccagcattattaccaggcttagaaatgtatccagatcaagatttacgcccagagtgtttgccagtaatgagagaagaagcatcaaaagtcttccctcctaccattgttgatgaaactctttctgtaacaaatgaagtcattgagggacctgatgcaaatccattacgattaaaaatttatcgtccaaaatcaaataatgaatccttacctgctctgttgtggatacatggtggcggatatatcttgggatctataaatgataacgatgatcttgctgtaaaaattgcaaaagaggctaactgtatggtcgtttctgtagattaccgtttagctcctgaacatccttatccagctccaattgaagattgttatgcagcattaaaatggattgctgataacgcggagacattgaacattgattcgaatcgaattggtgttgcaggagtgagcgctggtggcggactaacagctgcattaacattattagcccgtgatcgccaatatccttctatttgtttccaaatgccgctttatccaatgattgatgatcgtaataacacaccttctgccaatgaaattaaagaagggtttgtttggaatcaaaaatcaaatgaagctggctggaaaatgtatttaggagaattacatggaacggatcatattcccgcttatgcagccgctgctcgagcagaagattatcgtaatttaccacgtacctacacatgcgttggtcaattggacccattccgtagtgaaacattaacctatgtaaccaaacttgcagaagctggtgttgatgtcgagttccatttatatcctggagcttatcatgggttcgaaatgatgcatccggatactgatatatctattcacgcttggaatgattatgtgcgagcagttaaaactggtttcgcaagaaagtaactaaggtagctacaaaaaatttcataataaaggagaatttttaatgaagaatagagttcatccagaattaagagaaatgttttctgtattacctgaagtagataatagtccggaaaatttccaacaatataggaaatgggctaaagaatcttttactgcaacagttctatcatcgaatgatgaagttactgtatctaatcgatttatacctgggcctgaaagagcgcctgaagttagagttcgcatttatgagccaactaaaaaaacaaaagctttacctggggtcctttggatacacggtggtggatatcaagtgggatcacccgaaatggatgacaaactttgtgaaaagttcgtattggaagccaactgtatagtggtttcggttgactatcgattagcaccggaaaatccattccctgcaccacttgaggactgctatgcagctttacagtgggtttctaataattcggaagatcttggtgtcgattcttctcgaattgcaattgccggaatgagtgcgggaggtggactaacagcagcccttgcccttttagcaagggatagaaagggaccttcaattatattccaaatgccactatgccctatgattgatgatcgtaatataaaaccttctgcttttgagataacggattcaaaattatggaacagaaaaactaatatctctgggtggaaaatgtatttaggttcagtttacggtgaagaggtatccccatacgctgctccagctcgtgcaactgaccttacaggacttccaccaacttatacaatggtgggtgaaatagacttattccgagacgagacaattgaatatgcgaatagattaatgcaagctggagtaccaacagaatttcatgtttatcctggtggctaccatggattcgaattaatagtgcccaatgctgaaattagccaaagagctgaggaagaatatatcggtgcattaaagcgagcattacaaaaaacagaagtttaaatatatatgaggattttatatagcatatagtaaaaaataagagaaagagtctatgaagagagcagctcctctgtcactaagtcttatagagataaaaaagtactggcaatgccagtacttttttattattatgctcgctgttcaacattgactcttttaataaagaacgagattattaatccaacaattactacaatgatagcaaagataaaggtattttgaacaccgtttgtaaaggccagaacttggtttaatggattttctttatcagatactgtctgaaggaagcttcttgaacctgaggaaagaattgaaattccaacagctgttccaatagcaccagcaacttgttgtaaggtgttcataatcgctgttccatgcgggtatagttcaggtggcagctgatttaatccgtttgtttgagctggcatcataatcattgaaattccaaccataagtgcaatgtgtagtgcaacaataaatcctgtagatgtttccaatgttaaagttgagaaaccatacagtgcacatgctacaatgacaagtccaggaataactagccatttaggaccaaaacggtcaaataatccccccataacaggcgaaagaattccattaataattcctcccggtagaagcataagacccgctgcaaacgttgataacgctaatgatgtttgtaagtataatggtaaaatcatcatcgtacaaagcagcaccatcatgcatactaaaattaagagaagtccaataacgaacattggatatttaaaagccttaaggtctaacattggctcatccatcttcatttgacgaagggaaaatgcaattaatccaacgactccaataacaagagaaagaataacgtgtgagcttccccagcctccactttctccagcgctactgaaaccaaatacgataccgccaaaaccaattgttgaaagaatgattgagaaaatatcgattcttggctttgttagttttgttacgttttgcatgaagaatgtaccaaatactaatgcgataattaataatgggagtgaaatccaaaaaatccagtgccacgttaacgtttttagaatcaaccctgagacggttggtccaacagctggggcaaacataatgacaagcccgataattcccatagctcttccacgcttatgtggtggaataataacaagaatggtgttaaacataagtggtaaaagtaaagctgttcctactgcttgtacaatgcgggcaatcattaatacgctaaatgttggtgcaatagctccaattaatgttccgataatggagaatacaagagatgcgataaaaagctgtcttgttgtaaaccattgaagaattaaacctgaaattggcacaagaattcctaatgttaataagtagccggttgtcagccactgtgctgttgtctctagaatatcaaaacctgtaattaaatcttttaacgccatatttaaggctgtttcactaaacaagccgataaatccagcaataagaaatgacgtaataatcgggagagctctgatgttagagttctctgctgttgtttgttgattccccatattaaattgtcttcctctctcttacctaattcttttatttgaattttcgattttaataacctttccttaacacctcgtggcactcccaaatcagctcttctattcccgtctggcctttcagcctacggcgaacgatttctgaggatagattctggactttgagcgctcttggtgctcttctttcgaagtatgcctgaaaggctgcttcaatgtcattattgtttttgagctcttcggcgagaacgattgcatcctcaatagccatggctcctccttgcgcaagagtcggagctccgacgtgggcggcgtctcctccaatgacgacgcggcctttgtaccatggctcttgcactgcgacttgttccaatttgttaaaaataacagggtaatcttttgacatatgctttgtaataaaatcaagtcccggaaagcctaagagaatctctttgactctattaaaccgggtatcttcctcatcccagtaatcgctggcgcaaggctggagcacaaagacatagccggcgcgttcagctaatggtacgacgccgatttgcgtttctccgcttatatacatcaatgacgaatcctcaaatttgtaatcaggaagctcgaaataaaatcgccacgctcccataccgagatgctctttttctatttccttttgcagcatcatattccttacagttgaatgaatgccgtcaaaacctactaaaatatcagcctttatcttttctccgtcgtcaaatatggcagagaccgattcagccctttcttcataagcaacaacctttttcccccacttgatatctacacccgctgcatcagcatgcttgatgagaatatcacttaatgtttttcgcgggatattattgcgccctggaagtgtgtcgtctaaaaaggattcactgacttgaaactgcagattcccctgtgcatcaaatgttttcagccattttgtttgaaagccatgttcacaacactcttcaaatacatccaattctttcaagacagccagtgcgttttgcggcataagaatccccgcaccggttttgcgattttctaaagccgcctcgcacaaggtaacagaaaatcctactttactaagggaaatagacgctgacaatccgccaattcccccaccagctatcaaaatatgtttcatataaataaccccttttagttctttaaaaatagttaggcacctaactacattactttactacatcctcagaaaaattgtcaatcatctttaagtcaggttgtattatgatattaactcctttataatcgtgtcataactaacgaacgggagcttattttaatggaattaaaacatttacctaaatataaatatttaacagaacacaccgagacgtattccaatatagatgccagttctcttgaattgtttttatctctatttgatatatcaaaaaaaatgaatcatgtgatggagcgttactttgcaggcagagggctgtctgaaggaaaattcaaaatcctgatgctactcttcgacgcaaaagaccactcgttaagtccgacagaacttgcaaagcaatcaaacgttacgaaagcaacgattacaggtttgctggacgggctggtgagggacggttttgtcagccgcacgcatcaaaataaggataaacgaaaaatcagcattgaactgacaaaagagggaaaagaacaactgaaacaatttctacccggtcatttcagtaaaatctctgcggtaatggaaaactacagcgatgaggaaaaagaaatgtttatcaatatcctgggagatctatttgaaaaactgagcgtgtttaaagactaaaacgcatttttttggtcccaccacatcgttattcagctgaaattttatagtatatagtacccctaggacgaaattttgtactaacttgtaataaaatattcatgttttcattttgagggtatttgtattgcttaggttgatggcggtgaggctagttccatgaacgatataaatccagttgaattaatgaaaggtttacccggcataccttgtcctatcgctaaaacgcttgatgtaattcgtacaaaatggacgtttttaatcatccgtgaccttcttatcgaaggaacattacgctttagtgatttacaaaaatcaatggatgggattagcccgaaaacattatcgcttcgactaaaagaattagaagcacaaggcattagcattatcactagaaaagtatatccagaagttccgcctcgtgtagagtacacattaacggataaaggaaagcaattagaggggatatttattgaattaaaacggtttggattaagtttataaaacaaaaaccccttaccgttgtaaggggtttgattacttcgcaaaactttcagctagctgtttttctctccacataaatgtaatagcgagaccaactattaaaacaattcctgaaaatgcatatggataatgaatattcatatcaaataatattccgcccattgctggtcctgcgatatttcctaaactcgtataagtcgagttcataccagcaacgaatccttgctcttttccagctgcttttgataaaaacgtcgttaaagctgggcgaagcaaatcaaatgcaaggaaaataaagcacgtaacgagaagtacaatccaataattaaagactacagttgaaacgaacgctaatactgcacctacaattaaacagatttgaattaacactttttcaccgaatatatcaactaattttccaaacataaatacttgcacaactaccccaaagattgaactaattgtaataattgccgcaatatctttcggtgtgaatccaaacttatgatcagaaaacagactgaacaccgtttcatatgccgataaaccgaacgcaagtacaaatacgataataaatgcgattgcatacattggatgtaatgatttctttaaatcaccaataaagcttgattctttcgtattagaagaaatctctgcaagctcttctttcgttaacggttcttttaaaataaagatcgagatcacacatgctacaaaggcaattactgctgcaacgaaaaacggcacacgtataccgtattctgcaataaatccgccgattccaggtcctataataaagccggtactaatagcagcagataaatatcccatcgcctttggacgttcctgtatagatgtaatatccgcaacatatgccgtaacaccaggcataataaacgcagcactaattccgcctaacaccctcgctgcatagagcatccatacatctgttcctaatccaaacagaagctctgaaacaccaaaaataaataatccaatgattatcattttcttcctaccataaaggtcgacccaccggcctgtaataggtgaagcaataagctgagccattgcaaacactgcaacgagatatcccatcgtcttacctgttaaacccatatcattcataaaggacggcataaccggaatgattaatccaatccctaaaaaagcgataaatatattactcaaaagaatgaccagtaccatcttttgttcttttatcggtttcttcactttcaacacctcttcccgtaagctcccctcaaaaaaataatacccaagaagctttttctttatcctgctatttgtgggctaatcatgagtagaaatgcccctactcgttagaatttcactgtatccttccacacatacatactcattaggtgaatgactatcattcagttttcctcaaaaatgaacctaccttctcagacaggttcatcccactatttctttatatgtagtgcatgtgttaaaaaatctagtacttctgccttttgtaactcaacttgctcatcatctttatgatcatataaatacacttgttccgctgctgattcaacaagagcgataaataacttcgctgttcgctccgcgtgaaccgaatcacgaatttcaccagcttctttcgccgcacttaaaaactcgcttaaccacatataaagaggctcatacacagcttcccattcttttatatgttctgtagatgcaagaccagcatacattaaagcttgtatttcacgatattccgctataaagtgaaacaccgcatctattacttgcgtcactttacttgaaaaaggcgcatcattttgcactttttctttcactgcaagtatcatcttttcaaccatcacttctgctattgcaggcataacagataacttagaaggaaaatataaatagaaagttccttgtgcaatgccagccaatttcacgatatcagaaatcttcgttttttcaacgcccttttcctgaaacacttcaatagctgcatagacaattttctcttttttattcatcatctaaaccctttcaaacgcgtattgaatgactgtcactcattttataagataatcgattgtactgtcaatgatagtgaactttgcgaggaaatcatttttttcataataaaatctcctaacaaaaaattaggagataaaaatgccaagtacctttaagaaagagcctttaaccctgtcactccacatacaataagagccacactaatgatacgtgctttacttttcgactcaccaaacaagaacatgtttaataaaacggcacctgctgttccgataccaatccaaactgcatacgcgacacttacttgtaaaaataagaaagatgtatacaagaatgcgaaggatgtagcaaacccacctatataaagtgcaccatttgctaacgttttatctttactatacattttcagaccgatcacaccgactatttcactaattgcagcacaaaatacgaaaaaccaacccatctttaagcagctccttccatagtatcttctttattatcagctagctttaaaccgataacgccagctacaaccatcacgataaagaataattttcctacactgaaactcccgccgaaaaggaatacatccattaagaaagtacctaccgtaccagctccggcgaaaacagcatatacagtccctgttgcaagatgttcacacgctttagaaaggaagtgaaaatcaacagcgataacgcctaaaataataatccaatgccaccaagtattggctgtattaaaaccaaacacccaaaaaatttcaaagatacatgttaatatgacatataaccaagctctatttttcatacctctcacctcttatgactgactatcagtcatttttgttttaaaaaaatatgatctttcattactactatataaacaactatcatcctcatttactattgtatttgttacatttccaagcaaatgacatcctgcctcagaaaatgactgaatgtcattcatgtgtattgtacatgaatattgtaaaaactgtcaatgccgaaagtttatttaaaatttctttcatccgatttgtatatttcctaataatctgtcaatactgctagtaacataatattttctccactcccccttggagagatcccttaaatagagcagttagcttttgctagctgctcttctttacatttatttcacccaacataccgaatcatcgccacctcatcacaataatcaaccttcggacaatgtctacaatcaatccacactttctcaggtaatgcatctctattcacaaaatcaaacccgcacttttgaaaaaattccgtttcatatgttaaagaaataactctactcacttttattttcgccgcctcatttattacatggtttactaacatacgtccgatcccttttcctgcatatgtatgcgaaacgactaacgatcgtacttctgcaagatcctctcctaacacatgtaaaccagcaactccaacgatttctccctcttctttcataacatataaacattgtaaatattgatagagagacaaaagagaacgcggtaaaaccactccctcttttgcataaacttcaatgagactataaatttctttcacatcactcgtaaccgcattacagattttcatatgctattcccttgcccccgatattaatatttataactctaaatgaattttaatacataattttatataataatacatctctcttttcttctcgtcaatcactttatacaaacaaaaaaccaagcaatctaatcgatgctcggttcctcatttcgtatcggtaataccgtcgaatatttaatttcacgaagtgctaaactcgtctgtatctttgtaataccaagcttattcagctttctaataaactgctctaattctttacgatcacgatttgcgacctttaataaataatcatattctcctgttaagcagtgacattctaacacttcaggcatcgcttctaattctttttccaacacttcaagtttatccgattgatgaatattcgtactcataaaaatgaagcataacaaatcaaaaccaagcttttcttggtttaaaatggctacttgcttatcaatgaatccttctccatctaatctttttattctcgcatgcatcgcagctggtgataaattaacacgtcgcgcaagctctgcattacttacttgtgactccttctgtaatatatctaaaatttgtacatctaaatcatccaacactttaataacagacgactccattataattcccccttatttcttaccgatgattattcgaaaaaacaccttataacttatataaaactgaacatctttctttaaatatcattcataacaaaacattttatcgatttttatccattatacaaaagaatatattacacaataaagaaaaatgctaaaattatttacaattcacattgattacaacaaaggggattttaatatgccttatttttatgtctttttactattactaacgagcttattatggggaggaaactttgtcgttggaaaatcacttgttgatcacgcatctccaatgacacttacaagtttaagatggatgattgcgattgtttgtttattaccaatggtatggtttaaagaaaaaaaaatcattccaccacgcgcggcgatacttccgttaatattgatgggaatttcaggggttgctctttttaacatctttcaatttttagcattagaaaaaacatccgcaacaaatgtagggcttatttctacattaaacgcgatttctattgcactattttctgtcttatttctaaaagaaaaagtaaatacacttcaaattctatccatgattctttcattctttggggttattcttgtcctattaaaaggtaactttgcacttttattttcattacattttaatagcggtgacttatggatgattgcggctgtttgcatttggggaatctattctgtttgtagtaaatgggcaacaaaaacaacgacaccgcttatggcgacgctttactctggtattttcggcgttattttattactgccatttaacattgggagcttcactgttacaaatatcaacacttcttttataacatcacttttatatacaggactcatttccacagttctttgtatggtattttggaatgttggcgtacaaaaattaggagcaactacatccggcatttttctaaacttcaatcccattttcacagctattttagcattccttttcctcggagaagaattaacgtggattcaaattttagggacaatgatcgttgtgacaggatgttatttattttctcatttcaaaacagttgccgttcagcctgttagacctttaatgcgaaaacattcttaatgaaaaaacatcgtcatctgggttggcgatgtttttattttctcttcatttcttttatatactgcttttcctcttctggcgataaacgttccgtcgccttgccagtatctccaccttgaaggctccataaaaagttatgctcctcaacagtttgagaaaaatctcctttttcccatctatttataatagaaaataacttcattttatattgaaaacctgtgctattttcaatatctcttttcacattagaaatttccttgtttgtcatttctacaaatccccatttttcagaggattttaccttttggtgtaccattttgtgcatagtagaaataatttcaccttcactaacttgcggagattcttctgcaactttcttctctttttcgtttgccacttgctgggtttgaatatttttattttctttttccacatatgcaagcaatttctttccgccaactatagacgagaaaattattataattgtaatgcatatacctacgccccatttaaaaagcattaactcttcatcgcttctctaacaagatgactatctacatattgcttaaacttcacaatttttccgttctcaagttgccatacatgaacaaatgctgcttcaaatgattttcccgtttctttataaactcctgaatacataccttcagcaataattacatcttttccgcttacttcatgatatgtatttacacttgctttataatcatcccattctgatcctaatcggctaaatacattttccattattgcttctacaccgatataagttcccccgtacggaaacccttctgcctctgtccattctgctttttcagagagagcttctactaaatgttttgcattcgaagaagctgatccttcatacgtgctttgaatcatttctaaatttgatttaggcatatgacttcctcccgttttatttatttttacacaagatgtaactcacacagttacatcttgtgtaaaaaaatatttaaattgttttattcttaacctacacgttgtaatcattatagttacaataatcctttaagtcaacaatttataaataaaatctacttcgttttcattactttctcttttaagaaacgatctacatatccttctgcttttacaacgaataaatacgcacccattgataataatgcaagatctaattcatatcctggattctttccatctcctaataaacctgctgctccatttacctttacgatagctccagctaaaataagagcgaataacaatcctacatatcttacgcctaaaccgataattaataatataccaccaactaattcaactgttgctacgccatatgcaagaccacctggtaagccaatgcttgtaaaccagcctgctacgttatcgatacctgattgaaacttcgctaaaccatgtgcaaagaacgttactcctaacacgatacgaataattaaattcccaatatattgattcatttttttctctcctttttgttttgttatggtgaacttttatttacaagtcaaaacaatacggtatttcatttcattcgtcaaatacttttttaaagaaaacaaaaaacattatcccttttaaggataatgttttcttacaaaatagcgctaattcaggcttttactctattacacaagaaatttgaaacatttttccagcgccaacatacggcaataaagaaatatcctcttctacaaccatgccaacaacgttcactttctcatctgcaggcaaatcatgtatagcaacttgcatctctcctgcatatctaccgtacaattcattatcaattgtaatgctgcctttctttcttaaaattgcattcattggctgtaaaatcactttattttcttctcgtgattctacagaccgaatgacatcacgggctggatccagcctatttgtatgcactcgttccactatttttaatacttctttatcagttataaacgctttgtaccgcagcggaataacccctctactcgcactcgctatctcttgtacactttctacacttccgcttatatccccgattaacaccttatcgacaccacaatattgtacaagttctaaatacgcttcaagcgggcgcatattgcggtgcttttctaacgttggtaatccttcatataacgggccccgtttctccccatcccctggaataaatgccatcgtttttattccgcactcatgcaaatattgattttgctgttgcaagaaggactttgctagtcctgtttctggacgcggataaaaattatgccatgcttctacattctcgacccgtatcttttcagtaattaactctttccaaaatgaatctgtaatcgtactcgcatttaaggctactttcattttatgggatacgcgcgcgatttctttcggcgtgatgccatagtccattcgtaagccagtaatgccccactctactaactcttccgcattttcgtacgtcattcctaaatggtgtagcgattttggagaaacatcgaccattaattccatttcactttcaagagcttgcttcccaaggatttgaattaactctttatacgtaccagggtcatcttctggtatatgaagtgatgtaaaaatagatgaaaatccgtttttcttcgctacttttagccattcttcttgtttctttactcgctcttttgaaagataaattgatactcctagcatatgaatctccctttccatgaatagaaaaagagaaaggaatccctttctctatatgttttctgccatttcttctttaaatccgaagaagtacgtaaagatgaatccgaacgtatatgccactactaatccaaggaaatataataaatatttattatcagcaattaacggaattaatgataatccggatacaccgattccgagtgcagctgttttcataactgcttggaatgcaccgccgacagctgcccctaaacaagcggtaagaaacggtttcccaagtggtaatgtaaccccgtataataacggttcgccaattcctaaaaatccaactggtaatgcccctttaattacgttacgaagtcgtttattttttgtttttacaaaaatcgcaatggctgcacctacttgaccagctccagccattgcgagtactggtaataaaggtgttacgtgcgtttgattaataaactccatatgaatcggtgttaaaccgtgatgtaacccgaccataacgagcggtaaaaatgttcctgcaagtactgctcccgcaaacgcgccgccaatacttaaaataccattaattccgctcgtaattccttcagataagaaacctgctaccggctgaattgctaacatcgttacgatacttacgactaacacagtaataagcggcgttataataatatcaactgcatttggtacagcttttcgaacttgtctttccactacaaccataagccacgctgcaaaaataactgcaaacaatccgccccgtccgggtacgagcgcttcaccaaataactttacgttcgccatcgccggattgaaaattaaaataccagcaattgccccaagaactggtgtcccgccaaactctttcgctgtattccaaccgactaaaatgcctaagaatgtaaagataccgccgccaataagtagtaacatttgtagccatgttgcattcggatcagcacctgcgtttttcgcaaagttagcaaccccgtttataatacctgacgcaacaagacccggaattaacggaatgaaaatacttcctatttttcttaaaaagtttttcaccggtgtattatttttcttcttcatctctgacttcatctcttgcccaagatcttcaaggtgatgatctgccacctcaccaattcgcagtcccgttaaaccttccatctctgctgctactttatttaccgttcccggaccaacgacaacttgaagcgtctcatcttcaataacccccataaccccttcaacctttttcaaaaggtccatgtttactttactttcatcatgaagcgttaatcgtagtctcgtcatacaatgagcaatgccacgaatattttttactcccccaagttgctctgaaatttctttcgccattctctcttctttcttcataatagaatccccctccctattattttatagtgccatcttcacaaacccttttgcttcttttagtttctccagtgcttccccatactcacactgcaacaacaccataacaatcgcagctttcacgttacgttctgctttttcataatgctctgctgctacttcataactaacccctgttgcttccacaataattcgttttgatcgttctactaacttttcattcgtagattgcacatctaccattaaatttttatatacttttccaacaccaatcatagaagctgttgaaatcatattcagtactaatttttgcgctgtaccagccttcaaccgcgttgaacctgttaaaatttctgcgcctgtttctacttccacatttagttttgcatatttacttatttcagcatttttattacaggagatactagctgtactcgctcctacgctattcgcgtacttcaagccaccaatgacataaggagttctgccacttgctgcaattccaattacagtatctttctcgtttaatccaatattttttaaatcttcttctgctaactcttcgcggtcttctgccccttctaccgctttagtaaacgctttcaatccacctgctataaatccttgcaccattttatcatctgtgccaaatgtcggcggacattccactgcatctagaatgcctaaacggccactcgtaccagccccaatgtaaattaaacgtccctcttcttcaaaagatttaataacagtctgtacaaccttttcaatttgttctatctctttttcaactgctaatgcaacagttcgatcttcttcgttcatactttgtagaacttcttttatgctcatctcatctaaattcatcgtcttctcattgcgatgttctgtcgataaattttctaacatattaccacctactttgaaatttaatttcatacttttattataactttaagaaatttaaaatcaatattactttattattttatgaaatttcatttcttttcatgacgaatttatgtccgtatgcaaaaaaaaagatggggtccccatcttttcattttaacttccgtaaccgcaaagcttcttctcttgtctccataaattgatccaatactttattaccaatacgattaaacgtaatgacatataaagcatcaatcatattcaattgtgtcattctcgaagcaatacttgcaatacgatgatcttgttctacatctggcatacaaagacgaatatccgcctctttatataacggtgatgactgatcaagcttcgtaatcgcaataactgttgcaccttgtctcttcgcatattgcgccatttcgagtacatctttcgtacgaccagatgttgaaatcgctacaaatatatcgccctcttttaaattcgtcacaagcggcaacatcatatgaaaatcagatagcatcattgcagtaaatccgagtcttgtaaatttataagccccgtccatcgctggagtagctgatccgcctactccgtaaaatataattttatccgcatttacaatatgatctgctgctttctccagctccttcttatcaatagccgtaacacttgcctcaattgcagctttattcacatatgtaactttattaaacaagtcgtacggtccatcttccgtattcatcactgaaaaatcgttaatattataatcagcaatcgttaattcgcgaacgagcgcgattttaaatgctttaaaacttccgattccaatcgacttacaaaagcgaacaacactcgcctcacttgcgcccgcattcgttgacacttctttcgtcgttaagttcggaacaatctctgcattctccattatgtacatggcaaccttcttttcagctggtgaaaattgatccatattactttcaattttaaatagtaacgttgaagctttcactatttaacctccacttcttacggttgcgttcactgattttctcttgcttcaagaaggtaaaaaccatcatcgccaggaggatgaaacacatttacaatgcgattccctttttgataaacagttctttccccttctgtccacttcttttcccaaccgttcatccaaatcgcaacatcaggtaaaaaagcagtatatttcagcttctgatcgtactcaccatctgcttcttccgagaaaatagaaaccggaaaatctttcacttttgattctttccatgcagtaaagggtatgcacaataaaagaagtataattacacctataatctttcccttcgtaatcctcaaacacatccctctccttgtcatatcacatacatagattttaccataattacagacctttcatgccacatgaccattgctttttgcaataaaaaaagagcttacctacttcagataagctcttcctctttacacgaaatacttcttcaaaagcggcggcgtaataatcgtcgtcaatataacaacaataacaatcgctgtgaaattttctttcgctaataaattcgctgtaagtccatttgctgcgataataagtgctacttctccgcgcgacaccattcccgcaccaatacttatagaagattgaaggttgaatcctgttaaccttgctcctaaacctgatccgattaactttgtgaaaatcgcaatgagcgtcataatgataatgaaccaaagctgacttccaatgccttgaaatgtaatttccattccgatacttacgaagaacaccggcacaaatatcgcataagcaatcggttcaattttatgttctacttcgtgcttatactctgtttgagaaatggcaattccggctgcaaatgctccaataatacctgcaattcccatcatttcactgtaatacgaaaaagaaaaacaaataataagagccgcgctaattagcgcttctgttacacgaagcggcacgagcattttcataatccaaggaacaactttccatgcaataaaaacaatactaacaaagaagataattttctttacgataacaagtgttatattcacatcttgcgttcctaaaaagctcataacaaacgctaataaaataacgacgatgacatcatcaaatacggcagcacctaaaatcgttgtactttctctcgtattcatttttcctaaatctcttagtgtttgcaccgtaatactaactgacgttgcgcaaagtaataatcctaaaaaaattgcatgagattgtattaatccaaacagcaatcctgttacataaccaccgatgaaaggaaaaataattccaccggccgctactgcaaatgatgatttcaaattccgatttaactcttctaaatctgtttcaagtccagccataaacataagtagcaaaacaccaatctcactcagttcatcgattaattcagaactatttataataccaagtacagctggaccgataataataccaataattaatttaccaagtacagaaggctggccaagcctcacgctaatatcaccagctaatttcgtacaaagtaaaatgacgacaagttcaaaataaaataacataacatcttctcctactttaactttaatcagtgggtcgttaacccccgtccatttctgcaagtagtttcccctattgatccgcattttatttgtcatatttttatttgacaaaatattctgaattatattaagattaatccagcaattttaaaaagctatgccccataactgtacctccacttacttacatactcttttctaatgggctcatactacattcgcagttatggaaatgaaaaaacggggggagagtccagagtgaagtcattattacgaaaaaaagcgcttagtactgaatcaccaaagcagctagatagaacattaaccgcacttgatttaacgtttttaggaattggcgccgtaattgggacagggatctttgtattaacaggtattgttgcagcgaaacattctggtcctggtattatgctatcatttcttattgctgcatttacttgtgcttgtgtagccttttgttatgctgaatttgcttcttctattcctgtctcaggaagtgtgtatacttacgcatacatgacagtcggagaagtcgtcgccttcatcgtcggatggtgtttaatgctcgaatatttacttgccgttgcagcagtagctgtcggttggtctggttatttacaatctttactacaaggatttaacgtccatcttcccgccatagtcgcctcggcccctggcgtaggaaaaggtggtctcattgatttaccagctgtttgtattttactcatcattactggccttttaagttttggtatacgcgaaagcgcacgcattaataatattatggttcttattaagttagccgttattatcgcctttatcgtagcaggtgcaaaatatgtaaaacctgaaaattggacgccgttcattccattcgggtacgacggtattattactggagctgctactgtattcttcgccttcttaggatttgatgcaatcgcaaccgctgcggaagaaacgaaaaaaccacagcgtgatttgccaatcggcattattggctctcttcttatttgcactgttttatatatgatcgtatctttcgttttaacaggtatggttccttatacacaattagatgtttctgacccagttgcgtttgccttacatttcgttggcgaagatacaattgcaggactactcgctgttggagcgatgactggaatgacaaccgttctcttagtcgttatgtatggacaagttcgcgtttcgtatgcgatgagccgtgacggtttacttccaaaagcattagcacgtgtaaataaaagagtgaaaatccctttattaaatacgtggattactggtgttgtcgccgctttattagcaggacttttagatctgcacgtattagcgaatttagtaaacatcggtatattaacagcctttacattcgtttgctgtgcagtacttattttacgaaaaacacaccctgacttaaaacgcggattccgcacacctttcgtacctgtactaccagttgtcgcgattctttgctgcttatatttaatgatcaatttgtctaaaacaacatggattagctttgccgtttggcttatagtcggcttatgcttctatttcttctactctagaaagcatagtcacttagctaccgaaaaaacaaatgatgaaaagaaaaaagcataacaaaatagctcgccgttttagcggcaagctatttttctgtactattatattttttcgttaacgattgtaaaatgaaaaatatgccgatgcaagctgtaaacgatgcccaatttcctattggcgttgcgtatttcacaattccaatacctacaagtaataggaaaataatcacctgatatatgagcttccacttttgcatatattccctcctttacttcgttcccttctttttcttcttccatgcatttaaactatcaaagaagaaattaataaataacgtgcctaaacccgctaataaaaacgtcattaaaaatagaacccatatacttttttcttttaagaaataatatcctacaaggagcacaaccgcgatccatacatattcaagaattctttttagctttttctcttccaaattattcgctccttcattctatgctacttttagtataacaaaaaagaagcctatcatgataagcttcttttcttcactcttatttgtttatgcttttttcaacgagtgaaatcgcatattccatagtacggttcatcgtttctacttgtgcatcttttactttcgcatcttttaatacagcttctgccactgtaattttttgactcaatgatttcactgaaccgtccgttacatttgcagcttgcgcttttttcaatactgcttttgcagattcaatattaatttgtaatttttctttcaatgttttcggttgctctactactttagattgtataaatgtttgatttgcagtttttaattcgttatacgcttgaacaatttgttctcccgtactcgctacattttcaaacacttgttttgcatgattatagcttttctctaattcttgaaatgcttcctttgaatattgacctgacttatcaccaaactcatacgtaccagctagcacttctttcacttttccaagctcttcaaataacgcatttacttgctctaatttcgtacggttagaaaactcattgtacgccgctaatacttctgaagaacttaacgctttactatataatttcgcaagcgcgatttgtccatttaacggaatgccaccatttccattgctatcaggatccgctccaagtgcaaatggtacatttggatgatacactttccctgtagctggttggctatttacttttttaccatcgacataaatagctacttcacttccgttatacgttcctgttaagtgatatgttttgtttgcttctaattgaacgccaacacgtttataactaccgccaatgtgagcccataattcaacatagccacttcccgtagactcaaaaccaattccgccaccctctgtattttgcaaaataccttgtccacggatttcattcattgaaaatacagtttctaacgtaaatgtatttgctactttttctttttgtggtgctgaaaacggaaggtatccaaatgtatttgcttttccgtttagcttcatcacattctttttcaatgctttatcatattcaatagtcacattgcccttcacatcaccttttgtaccaaatggtgaattgtctttaaatgtaccatctgcaaaattcacatcgaaaacatcagcctttggcacttttacattcggatcaatatcatcttttttcgtagtaatttctgccgttaaaggctgcgcactttcattaccaaacgaatcaattgcaactacttcaagtgtatatgttttcccgccatctaaccctgcaagtgtaaatgtaagatctttcggcactgggtcacgataaaactctgagaatgctaacagcttgtttttaatttctcctgtttgcttatctctagcttgtacacgataagaatgaacaagaaggttgtccaacgcttgctggaatgttaccgttgccgcattttctgttacatttgatacagcaagctttgcatccttagcaaagtaaggtttttctttatcacgatcttctacatgtgtaaatgtgtctttctttgctggtaatttaattttccaaggctcgcctgtccaagaatttgtatggaaatcacggcgattaatcgttacttctttatcgtctacttctactaataaaccttggcttaatgtactagctcctggcgggatcgtcccttgtactttaccaccttcaacttccatataacttactgaagatgtaccaactgatgtaaagtctttttgatgaatcgatctcgggtcatctaacggataatgtgaatgacctgaaaacgtaataacttgtggatattcttttaacacctcgttaattttcgcactatcttttgttccccactcttggctaccgtatactgtatctttaatatgctggtgtaaaaatacgaaaattggtttttctggatcatctttttgtgcctttgccatttcttcttttaaccaattaatttgcttgtctgaataatatccatgagttgtcccatcttccggagacataacaaggaaatgatacccttttaccactttgtgatagtaaatcgattccattcctgttttttctaagaaacgcttctgtgcgccctctacagataaaccgttccaataatcatggttaccaagagaattcattcgcacagcatctttatttgcattttcattatacacttgcatgaaacgatcatattgttgcagtgatcctgaatcagtaaaatctcccacaattacaaacgcatcttgtttaggtgcaagtgtattcagttgttcgattgctcgtttccagcgaaacgtatcatctgtcccactattcttaatatgtacatcacttacaactggaaaaactatcttcttctcactcggtgccttttcttgcttcttctcttccgctttaactgatgtgctccacggaaatgatacaaatgctaatacaaaaaccattaataatccaataagaccttttacttttcgtaaagctgttctttccacatgaatcctcctcatataataaattaattacattggttattgtatcgaacatatattaacttaatttaaactaaaaatgtattttatttaaattttgtaaatatacagtcaattttatattaaatgccacatttacataaaacaagtactttttgtctaatagataactaactttttcctataaaaactatgaagagatatgagcctatgaaactatcacgattttattttttttatccattcttaacacatcggccatgctgttacatttaataatagtaaacagtcttatgaaaaggagggaacccattgaaacctcataaaaatatcggctgttttgctcctttatctatcatttgtcaacctacttgcccctgtcctcctcctattctcccacctgaaagaggcgacgccgaattagttaccaatgagttcgctggagatattcttatctcaaatgattttattccaatttctcaaaaacaactaaaacaaaccaacaccacagtaaacatttggaaaaatgacggaattgtttcattatctggcactatctctatatacaataataggaatagtaccaatgcactatctatccaaataataagttctaccacaaatacttttacagctttacctggaaacactatttcatatacaggctttgatttacaatccgtttcagttatcgatattccatcagatccttctatttatatcgaggggcgttactgcttccaattaacttattgtaaatcaaagcgagattgcctataacaaaaaaattattgcttttgaatctaatcaaaagtctactaaaaaacgtgcaaacacatgaatcgtttgcacgttttttggtaatctttaaatcaccatatattaagacaaagtgtagcgaatagtcatacaaaattctcctgtttcagcagccgctgttccaagaattgtaaccgtatcaaatcggcgaactgtaaaagatgcgctacttccagtggcaactacaattgtttccactgcagtccccgttactcctccactataaaatacaattgtaacaggacctgttccagtatccactttcaaatatcctgaagcataaatatcttgcgaaatattatcagcataaatgattgctgcagttgcagctgctgtccaatcgatacacaccttatcttggacaattgttttttgtccatttgcacaacatgaaagatttgtactacaattacccatactaattcccctctctatgccattaaatatctagttgtaatacaaaattccccttgatacgtacctatcggcgttgcaggagttgtaatttgaatgatgttaaagcggcgaaacgtaaatgaaatgctagtcccttcatttactaggaatgtttggattgtccctccacctgagtctaaaaccgttactgtaatttggttcgcaggactcacgccaggaccaacatcataagttaaatatcctgtaccaacaatattctgattcacattgtttgcgtaaactgtaaatgtactagcttcagcactagaccgcgggttacatactttatcttggacgaagttactactattatctgagcagcatgttaatactgtacttgagcattcacaagccatagcctttcccctctctctttgttattccctatatgtgtatgtcccccacatccatcaacttaacgtatatttttatataaaatgcggtctttccacgtagttttttattatcttttatagatgttataaaagtaggcacatcaaataaaccctgacgggtttcaaatttttcgctatgctacctgatgggcagaagtggtatactcatacacaacacctaaaatatcaaagactgtttttttctcatatctgtgagattttcgtccgtttcgctgtaggaggttaaacagacgaaggagaatctttgataattcttgggtgtttttatgtagtgcttgatgaaaaagtaagaaataatctttaattatgtacatcgctttatattcacttagttctttctgtttcttacgtaacaggagttctctcattttaaacatagtagaagaacataataggatactaatgagttgtccataaaggtggcattctaatcgctcttgtttaatagatttacaacgatgaattcgaaaccaagatttccatattttaaataacagctcaatttgccaacgcagtgaatataaatcatagattttctctttcggtacccattccgtaggaatgtttgtcatatataccgtaattccttgtaaaagtttcgtacgctctgtatatgtaatcccttttttcttttcacgaatagctcgatcatgtagacgtttctgttttgctcctc

SEQ ID NO: 6165 - protein, 682 aa, Methanobrevibacter smithii
MTEEYDLQDDLNTKLKHYFEGKIVRKDLTKRVKEGANVPVYVLEYLLGKYCSQDDALVEQGVQTVKNILANNYVRPDEAQKILSKLKELGSYSIIDVVTVKLDYKTDTYYASFSNLGLNDIPINPEFPQRYERLLGGNLWCMVNLEYDFDEADFRSQTIKIRNLQPIQLPNIDLADILSNRKNFTKEEWIDILLRSCGMEPTQFDKRVKWLLIARLIPLVENNFNLCELGPRGTGKSHIYKEISPNSILVSGGQTTVANLFYNMRDKQIGLVGMWDCVAFDEVAGIKFKDQDGIAIMKDFMASGSFSRGKEEKNANASMVFVGNINQSVESLLKTSSLFDPFPSEMGTDTAFFDRMHCYIPGWEIPKYRPEFFTDDFGFITDYLSEFFREMRKRSFTDAYQEYFRLGRDLNQRDTIAVNRMVSGLVKLVYPDGNFDKEDIREILTFALESRRRVKEQLKKIGGMEFYDVNFSYIDLEENRDCPVGVEEQASSTLIPEGDLKPGHLYSVGPSENGKLGVYKFETEMMKGNGKFTPNGIGSKKDVNEAVKIAYQYFKSNAGSISGQISYKDKDYVMQVKDLHGVGMTRYLTLATFIALCSVATNRKVLPSLAILGNFSLGGTVDKIQNLADTLQVCLDNGAKKLLIPMSSYVDIGLVPSDLLVKFTLIPYNTPEEAVMKAFGIE

SEQ ID NO: 6166 - DNA, 2049 bp, Methanobrevibacter smithii
atgactgaagaatatgatttacaagatgatttgaatacaaagttaaaacattactttgagggtaaaattgtaagaaaagatttgacaaaaagagttaaagaaggtgctaatgtaccggtttatgttttagaatatttattgggtaaatattgttctcaggatgatgcattagttgaacaaggggtgcaaactgttaaaaatattcttgcaaataattatgtaagacctgatgaggcacaaaagattttatctaaattaaaggaattaggttcttattcaatcattgatgttgtaactgtgaaattagattataaaacagatacatattatgcgtcattttctaatttaggtcttaatgatattccaattaatccagagttcccacaaagatatgaaagacttttgggaggaaatctttggtgcatggtaaatttagaatacgattttgatgaagcggattttagatcacaaactattaaaattaggaatttacaaccaatacaattaccgaatattgatttagcggacatattatcaaatagaaaaaatttcactaaagaagaatggattgatattcttttaaggtcttgtggtatggaaccaacacaatttgataagcgggttaaatggttattaatagctagattaattcctttagttgaaaataactttaacttatgtgaattgggtcctagaggaactggtaaatcacatatttataaagaaatctcaccaaattccatattagtttctggaggtcagacaactgtagcaaacttgttttataatatgcgtgataaacaaataggtcttgttggaatgtgggactgtgttgcttttgacgaagtggcaggaattaaattcaaagaccaagatggaatagctattatgaaagattttatggcatcaggttcgttttcacgtggtaaagaagaaaagaatgcaaatgcatctatggtgtttgttggaaatattaatcagagtgttgaatcattattaaagacttctagtttatttgatccatttccttcagagatgggtactgatacagctttctttgataggatgcattgttatattccaggttgggaaatacctaaatataggcctgagttttttacagatgattttggatttattacagattatttgtctgaatttttccgtgaaatgagaaaacgttcatttactgatgcatatcaagaatatttcagattaggtcgtgatttaaaccaaagagatacaattgctgtaaatcgtatggtatctggacttgttaaattagtatatcctgatggtaactttgataaagaagatattcgtgaaatattaacatttgcacttgaatctagaagaagagtaaaagaacaacttaaaaaaattggtggaatggaattttatgatgtaaacttctcatatattgatttagaagaaaatagagattgtccagtaggtgttgaagaacaagccagcagcactttgattccagaaggtgacttaaaaccaggacatttgtattctgttggaccatctgaaaatggaaaacttggtgtttataaatttgaaactgaaatgatgaaaggcaatggtaaatttacaccaaatggaataggttctaaaaaagatgtaaatgaagcagttaaaatagcttatcaatatttcaagtcaaatgcaggttcaattagtggacagatttcatacaaggataaagattatgtaatgcaggttaaagatttacatggagttggcatgacaagatatttaactttagctacttttatagcattatgtagtgttgcaacaaatcgtaaagttttaccttcactagctatattgggtaacttctctttaggtgggactgttgataaaatacaaaatttagcagatacattacaagtttgtttagataatggtgctaaaaaattattaattccaatgagttcttatgtagatattggattagtgccttcagatttgcttgttaaatttacattgattccatataatacgcctgaagaagctgtaatgaaggcatttggaattgaataa

SEQ ID NO: 6167 - protein, 279 aa, Halosimplex carlsbadense
MTLISDGGDAPIPSLSGTISPDEVNMDLTMCGLLVERAEELTRLYADHGNWNEVKNIWFDERLSNRSTRGSSQKIFRVLTSRFKNAPPTLPNPSLLPQVFEQCETTRDKAQILYLYLVSDDTLVRYVVTEYSDRLVSEEAKPLDFSNETLIEILNSLTYSDGSSFDYAESTTERWCEGIRSVMREIGVLEGQQAVTGATPSVGTVPLLVAMDYSYEIGDEEWITSPRGFLYLFQPENRWEELFDRAASTSAWEYLELHGDLDLRPAEKPYSWISRGGVS

SEQ ID NO: 6168 - DNA, 840 bp, Halosimplex carlsbadense
atgaccctcatatccgacggcggtgacgcgcccatcccctctttgtctgggacgatctcaccagacgaagtcaacatggatctaacgatgtgtggtctcctcgttgagcgagccgaagagctcactcgactgtatgcagatcacggaaactggaacgaagtgaagaacatctggttcgacgaacgcctatcgaatcggagtacacggggaagctcgcagaaaatatttcgggtcctcacatctcgcttcaagaacgcaccgccaacgctcccgaaccccagtttgctcccccaggtgttcgagcaatgtgagacgacacgagacaaagcacaaatcctctatctgtatcttgtttccgacgataccttggttcgatacgtcgtcaccgaatacagcgaccgtcttgtttccgaggaggcaaaaccattggacttctctaacgaaactctcatagagatcctcaacagcttgacgtattctgacggcagcagcttcgattatgcagaatcgacaactgagcgttggtgcgaagggatccggtcagtgatgcgcgagataggggttctcgagggccaacaagcagtgactggagcaactccttctgtagggactgtgccgctactcgtagcaatggattattcatacgaaattggcgacgaggaatggatcacctccccacgagggttcctatacctcttccaaccagagaaccgctgggaagaactgtttgaccgagctgctagcacctctgcatgggagtatctcgaactccacggtgaccttgatctccgccctgctgagaaaccgtattcgtggatctccaggggaggtgtcagttga

SEQ ID NO: 6169 - protein, 235 aa, Enterococcus faecium
MKKMVGLFRVMTFEELDKAAEVMLKYSPTDAYQILDETFAKTIKGDTFRRKALNNLMNVWGNGQKPLSDFQEKVLERYAISNYDEKKSLQVLMMLYSFSFFSDTINIIGKYLRMQDTFQSKTIMEEVRSTYGMTETVNKGLLTVLGSLVDWGFLFRSKPGVYELTKHKILITDEFIKNVLIRSILAHTDAEYLPLEIINNQAGLFMFDYQVSRLEVHLDDLNVLRERTDTFIGLK

SEQ ID NO: 6170 - DNA, 708 bp, Enterococcus faecium; identical to SEQ ID NO: 4913

SEQ ID NO: 6171 - protein, 98 aa, Halorhabdus utahensis
MRNIGVLETQQTLEGKIPNIGTAPLLVASGYSWETHGDDWFSQPTGWLYLFQPEQYWDSLAERLSGHPSWEASGLHGNLRLQPVGDTYGWAEPREGNA

SEQ ID NO: 6172 - DNA, 297 bp, Halorhabdus utahensis
atgcgcaatattggtgttcttgaaacacagcagaccctagagggcaagattccgaatatcggtacagctccattgctcgtcgcttcggggtactcgtgggaaacccacggggacgattggttctctcagcccacgggctggctttatctcttccagcccgagcagtactgggactcactggctgaacgcctcagtggacacccgagttgggaagcgagtggtctccatggcaacctgcgtctccaacccgttggcgacacgtacggctgggccgaaccgagagagggcaacgcatga

SEQ ID NO: 6173 - protein, 873 aa, Caldicellulosiruptor kristjanssonii
MIEKGHFVYVKSLKKYAKVLGIKELWGYKIYVVLDTSSNEVYEVTDKDIEKDIKFSVYEFKYILNAAKLKNIISGGILSPLSGSILPLPHQIYALKRALSSDKVRFVLADEVGLGKTIEAGLIMKELKLRGLIKRILILAPKGLILQWQEEMKEKFSEDFKIILPQDLDVLKRVYDKENIWTIFDQVISSHDSVKPIDNRAGWTAEKIEEVNTQRFLNLINANWDLIVIDEAHRLAGATSNVARYKLGKALAAASPYLLLLTATPHQGKSDSFLRLMRFIDQDAFPTEKAITKEQVAPFIIRTEKREAIDFNGNKLFKNRYTKLISIRWQEKHSLQKLLYEKVTEYVAKGYNPAVKEKKTYIGFLLVLMQRLVTSSTRAIKDYIERRIKILENQEFLNKDIDFEEIYDAAMEYAQQSLLQTVSFNIKKEITQLKDILSVANQAEAQFIDAKVEALLDLIFKIRMEQKDSRFLIFTEFIETQEYLYEILTNQGYNVVKLNGSMNIEERKEILSKFKENADILISTDAGGEGINLQFCNIVINYNIPWNPMKIEQRIGRVDRIGQQKDVFVFNFVLEDTVENRVRQILEEKLRVIFQEFGVDKMGDILDSFEAGIDFTEVYIKSISNPSNLERYVYSIENKIREKTEILHKIKDILKDEKVLSVSLLAELPSDKVDDYIQKMYLYKEISLGNQADILNISGETLSLENDKIKELLNIPEYPISKRVPIVKLKNNTIYEKGYWSLWEVGIKKHSKILQSISSIYLRGGLTRHINGMGYFVKRIFFFSRYYRNFIGKDKNYSYISIPFNEKRIYRADKQRNRKIDSIFFEKRSCTEFRHKYKKAITTDEGGNCCIKIIRPSGDNTLLKITVYGVCGV

SEQ ID NO: 6174 - DNA, 2665 bp, Caldicellulosiruptor kristjanssonii
atgattgagaaaggtcattttgtttatgtaaaaagtctaaaaaagtatgcaaaagttttgggtataaaagaattgtggggttataaaatatatgtggttttagatacatcttctaatgaggtttatgaagtaacagataaagacatagaaaaggatataaaatttagtgtgtatgagtttaagtatattttgaatgctgctaagttgaaaaatataatctctggcgggatactgtcacccttgagtggcagtattctgccattacctcaccaaatttatgctctgaaaagagctttatccagcgataaagtaagatttgttttagctgatgaggtaggtcttggtaaaactattgaagcaggactaataatgaaggaattgaaactaaggggattgataaaaagaattcttatcttagctccaaaagggcttatattgcagtggcaggaggagatgaaagaaaaattttctgaggacttcaaaataatcctgcctcaagatttggatgttttaaagagagtatacgataaagaaaatatctggaccatttttgaccaggttatatcctcacatgattcagtaaagccaattgacaacagagctggttggacagctgagaaaatagaagaggttaatactcagagatttttaaatctgattaatgccaattgggatttgattgtgattgacgaagcccacagacttgctggagcaacttctaatgtggcaagatataagctcggtaaggcattggctgcggcaagtccctatctcttgttgttaacagctacacctcatcaaggaaagagtgattcttttttaagattaatgagattcatagaccaggatgcttttccaacagaaaaagctataactaaggagcaagttgccccttttatcataagaaccgaaaaaagagaggctattgactttaatgggaataagctttttaaaaatagatatacaaaacttataagcattagatggcaagagaaacatagtttgcaaaaattattatatgaaaaggtaaccgaatatgttgcaaagggttataatccagcagttaaagagaaaaaaacttatatcggatttttacttgttttgatgcaaaggcttgtaaccagtagcacaagagcaataaaagattatattgaaaggcgaattaaaattttagaaaatcaagagttcctgaataaagatattgattttgaggaaatttatgatgctgctatggaatatgcgcaacaaagcttacttcaaactgtaagttttaatatcaaaaaagagattacacaactaaaagatatactctcagtcgcaaaccaagcagaggcacaatttatagatgcaaaggtggaagcattgttggatttaatctttaaaatcaggatggagcaaaaggattcaaggtttctgatatttactgagtttattgaaactcaagaatatttatatgagattttgacaaatcagggatataacgttgttaaattaaatggttctatgaatatagaggaaagaaaagaaatattatcaaaatttaaagaaaatgcagatattttaatttcaactgatgcaggaggagagggaataaatcttcagttttgcaatatagtcataaattataatataccatggaatcctatgaagatagaacaacgaataggacgtgttgataggattggacaacaaaaagatgtatttgtgtttaattttgtccttgaagatactgttgagaatagagtgagacaaattttagaagaaaaattgagggtaatatttcaggaatttggagttgacaaaatgggtgatatacttgatagttttgaagcgggtatagattttacagaagtatatattaaatctatatcaaatccttctaatttggaaagatatgtttattccattgagaataagataagagagaaaacagaaattttacataagataaaagatattcttaaggatgaaaaagttctaagtgtaagtctgcttgcagaattgccttcggacaaagttgacgactatatacaaaagatgtatctatataaagaaatctcattaggcaatcaagcagatattttaaatatttctggtgaaactcttagtttggaaaatgataaaataaaggaactattaaatattccagaatatccaatttcaaaaagagtaccaattgttaaactgaaaaataacacaatttatgaaaaaggttattggtcattatgggaagttggcattaaaaaacactcaaagatattgcaaagtatttccagtatttattaacttagagggggactttagacccggcacatctaaaatggtatgggatattttgttaaaagaatcttttgatttttctcaagatattgatatagatgaaactttattggaaaagacaaaaattacagctattgaattagcatataaccattttagtgaaatgagaagagaatatatagagcagataaacaaagaaatagaaaaatttaagatagcattttctttgaaaaaagaagctgcactgagtttaggcattgaaaatataaaaaggcatagattacaacagattgagaaggaggaaactgctgtatttgaaagattatccgcccttcaggagataataccttacttaaaattactgtatatggtgtatgtggagtga

SEQ ID NO: 6175 - protein, 955 aa, Dethiosulfovibrio peptidovorans
MSNIWKYSTIHKSACKVVDEQTLWGQTVCRVWLPNQDAVVRVSQSDLQSLSSDWHPRIEGHRIAYISAAAKVAEVLEGSSRGSDGHVLLAPMESNVIPLPHQIHALSRAISSDRVRYLLADEVGLGKTIEAGLVMRELKLRGLVRRTLVVAPKSLAMQWVSEMSTHFNESFSLVNPSDLDALERPGQYVIGKTDHISDYNPWMRFSQAIVTLDSVKPIARRRGWSKEKIRAYNRNRYERLVQGQWDLIVVDESHRMGGSTDQVARYKLGQGLAEAAPYLLLLSATPHQGKSDAFQRLMSLLDPMVFPDLESVTREKVSEFVIRTEKRKAVTAEGKPLFMPRITQTLGVDLERNWAQVALYDAVTDYVKKGYNRAIKDRKPHIGFLMVLLQRIVTSSSYAIRCTLERRLHALENLRETHASPGEEELEDFTDLDGQTQLDLLVEVNEPGRAKEMAEVNALLDLARSAEIAGPDVKTEALMSLIFQLQGEENDDQLKLLIFTEFVPTQAMLQTFLEERGIPCAILNGSMSMDERRMAQRDFRDNARILISTDAGGEGLNLQFCHVVVNYDLPWNPMRIEQRIGRVDRIGQSKIVRAVNFLYENSVEGRVREVIQTKLSIILNEMGIDKTNDILDTSLSGEVIEKMMTHVIMEDADLDAEVDQTVQNLQEEMQQVREQCAVYGISEEPDLAAMEKLRSHPLPYWIEQMTTHYLQTKECKLEKDLLGWNFTWPDGEKVQGAVFQSRDLSTDGDLLSLENARIRGLAMNLPQFIPGQPLPCVSINGLPKIVSGLWGLFEIRLSVGQPDNFQIRVSLTRRSYFPVFMSNEGKLFMPTARHIWDQLLTNDLRIDSLKGSKESIVAGEKLLWAAEKVGQELFETMQEAHFAALSREEERGMIAFTSRRKAIKRLGLPEVRQFRLARLNEDELQWRSELKSARQIVPEMRPLLMLNIENGGICE

SEQ ID NO: 6176 - DNA, 2868 bp, Dethiosulfovibrio peptidovorans
atgagtaatatatggaagtacagcacaatacacaaaagcgcctgcaaggttgttgatgaacagacattgtgggggcagacggtatgccgtgtctggttgccgaatcaggatgcggttgttcgagtttcccaatctgacctgcagtcgctgtcgagcgactggcatccgagaattgaaggtcaccgaatagcctatatctcagcagcggctaaggtggccgaggttttggaaggatcctccagaggatctgacgggcatgtcttgctggctcctatggagtcaaacgtgatcccgctgcctcaccagattcacgcactttcccgggcaatatccagtgatcgtgtccgctacctgttagctgatgaagtcggtcttggaaaaaccatcgaagccgggcttgtgatgcgtgagttgaaattacgcggtctggtacgtcgtacattggtggtggctccaaagagtctggccatgcagtgggtgtcagagatgagtacccatttcaatgaatccttttccttggttaacccgagcgatctggatgctttggaacggccgggtcagtacgtcatcggaaaaacagatcacataagtgattacaacccgtggatgcggttttctcaggcaatagtgacgctggattctgttaaaccgatagcgcgtcgtagaggttggtcaaaagaaaagattcgggcgtacaaccggaatcgttacgagagactggtccagggccaatgggatttgatcgtcgtggatgagtcacatcgaatgggtggtagtaccgatcaggtggctcgctacaaactgggacaaggactcgccgaggcggcaccgtatctcctccttttgtcggcaacacctcatcaagggaaatccgatgcctttcagcgtctgatgagtttgcttgatccgatggttttccctgatttggaaagcgtgacccgtgagaaagtttctgagtttgtaatacggaccgaaaagcgcaaggcggtgacggcagagggcaagccgctgtttatgcctcgtatcacacagacgttaggtgtggatctggaacgaaattgggctcaggtggctttgtacgatgcggttactgactacgtgaaaaaaggctataaccgcgcgataaaggaccgaaaaccacacatcgggttcctgatggttcttctgcagcgaattgtcacctcaagctcttacgcaatccgctgtacattggaacgaaggctgcatgcgctggaaaacttgcgagaaactcatgcatccccaggcgaagaagaacttgaggatttcacagaccttgatggacagacgcagctggacctgctggttgaggtgaacgaaccaggcagagccaaagagatggcggaggtgaatgctctgctggatcttgcccggtccgctgaaatagccgggcctgatgtcaaaacagaggctctgatgagcctcatctttcagttacaaggagaggaaaatgacgaccagctgaaactgctgatttttaccgaatttgttccaacgcaggctatgctccaaacttttcttgaggagcgaggcataccttgcgccatattgaatggctctatgagcatggatgaacgacggatggctcagcgtgattttcgtgataatgctcggattcttatatcaacagatgctggtggtgaaggtctgaatctacaattctgccatgtagtggttaactacgatttgccgtggaatcctatgcgtattgaacagcggatcggtcgtgtcgaccgtattggtcaaagcaaaatagtccgggcagtcaactttttatatgaaaactctgttgaaggccgggtgcgggaagtgattcaaaccaagctttccatcattctgaatgaaatgggtatcgataaaaccaatgacattctggacacctcactgtccggcgaggtgatcgaaaagatgatgactcacgtcattatggaggatgccgatctggatgccgaggtcgatcagacggtgcagaaccttcaggaagaaatgcagcaggttcgagagcaatgtgctgtatatggaatatctgaagaaccggacctagcggcgatggaaaaactgcgcagccatcctctgccgtactggatcgaacagatgacgacccattatctgcaaacgaaagagtgtaaattggaaaaggatctgcttggctggaatttcacatggccagatggcgaaaaggtacaaggtgcggtcttccagtctagagacctttcaaccgatggggacctcctgtcgcttgaaaatgcccggattcgcggcttggccatgaatctgccgcagttcattcccggacagcctttgccttgtgtatctataaacggactccctaaaatcgtttcaggtctgtggggcctttttgaaatccgcttgtctgtggggcaacctgataactttcaaatcagagtttctctgacaagacgaagttacttcccggttttcatgagcaatgagggaaagttgttcatgccaaccgcaaggcatatctgggatcagttgttaaccaatgatcttcgcatagatagcctgaaaggttcaaaagagtccattgtggctggcgaaaaacttctgtgggcagccgaaaaggtcggacaggagctttttgagacgatgcaggaagctcattttgccgcattatcccgtgaagaagagcgcggtatgattgcctttacatcacgtcgtaaagccatcaaacggttgggactgccggaagttcgacagttcagactggcccgtttgaatgaagatgaattacaatggcgcagcgagcttaagtccgcccgacaaatagtaccggaaatgcggccgctgttaatgctcaatattgaaaatggaggtatttgtgagtag

SEQ ID NO: 6177 - DNA, 1299 bp, Kingella denitrificans
gtgatcgaacggcaggacgtgtggggcgaggtcgcctaccgcgtctggctgccggccaaggacgccgtggtgcgcgcccgggcagcggaccttgctgcgctggaaagtgtgcgcccgagcgtggagcagatcctgcacaccacggcggcagccaacccgatgcggatcgagcagcgcattggccgtgtggaccgcatcggacagaagcacgtggttcgcgccatcaactttgtgctcgaagataccgtggagcatcgggtgcgccaggtgttggaggcaaagctcgaggtcatcgcgcaggagtttggcgtcgacaaggcggccgacgtgatggattcggtcgaggccgacccgatcttcgacgagttgttcgtgcacggtctgcagaacccgaatgccatcgaacaggagtgcgacgcggtggtgtcacaactgcgctccaccctggcagagtcgaagaagaataacgatctgctcactactgaacatgatctggatgccgacgatgcccgcaagtggctcgaccacccagcgcagttctggctggagcgcgccatcaccagcgggttggctgtgcgcggtagcttcgccatcaaggcgtgcaatgcatggcggttgaagtgggcagacggcagcgagtcggcacaggcctgttttgacgcccgcacggcggatgagaacccggagttggaatgggtcacgatggaagacccacgcgctcgggcggtgatcagcgagctgccgcgctttgtcgccggccagccactgccggtgatccgcgtgacctggctgccggattcggtacgcggcatctggtcgctgtgggagatcagtttggcggctgaaggcctgagccggaagcgcttcctgccggtgttcatcaacgaggaaggccggcccttcgtgccgaccgccaagcgtgtctgggatctgctgctcactgaaaccgtagacgtgcatgccgtaacgggttccgaggagtcggtgaggtggttcgaggcatcgcatgtggctgccagtacccagggtgaacggatcttcaccgagctgctgaccgaacaccgcgcccggctgaaagaagagcgcgaacgtgcgctgtatgcgttagaggtccgaggtcaggccattggacgaattggcttacccgccgtgcgtgagcaccggcgcaagcggctgcaacaagaacacgatgcacgcatggccgccctggacgagatggaggccagcgtgccggatttgaatgccgtgatgatggtgcgcgtctccggcgatgtgatgcccggaggacaggtgggatga

SEQ ID NO: 6178 - protein, 1061 aa, Bacillus cereus
MQIGDIINGPFFPESIEIKKLDAFGEGYYLLEGIGRQTNQYYEQLLTKSDIEKINVLSTSTTSKVTLTGQAIQQRLIHLMLELEDKYSKTRALGNQKVIPLPHQIEAVYSRVLQTSNIRYLLADDPGAGKTIMSGMLIKELKARESVQRILILVPPLVLRQWQEEMAEKFQESFKIINRAVLNEYGSSNPFIENDCCLASIYWSTRDDIKGLILEAQFDLVIVDEAHKMAAYSYGKIKKKTSKTKLYHLGEKLLAKTEHCLLLTATPHKGDVENFRLLMKLIEPDLFNHVSASETLREKTNPFIIRRLKESMVNFDGTPIFPKRTTKTIQYELTKSELDLYEAVTQYVQTHFNRAMNAGNNSTAFAMMLLQRRLSSSIEAIHKSLGRRYKKLLAILDNTEMERKKYTQKLERLYENNLEENVTESSDMFERKLELSIDIIDLEVLKKEIAQLKKLLIMTTSLKKYGLEKKYLELEEMLFGIDGLIYTGEKILIFTESVDTLKYLEEKLATRVEQIAKIVGSYSMDERRKQVEFFRHHAQIMLATDAGGESINLQFCNQMINYDIPWNPNRLEQRMGRIHRIGQKNEVFIFNLVAANTREGYVMSRLLEKLDTMKEDLGNDLVYNFMGDLLDGDINLADLMKEAILSREHLDDVIAKMDKELSDEHKELLKTMKKMQFNSESIDITAIKQSQFDIEINKVPNRLYIDLMGYAFTESNVKVCDSHEHRVKRIDRFPKIIRDQFAKETTMYDSYRYTGFIEHSNEEIHYVTKTYPLYTLAKKLLQKNNDQFAFKRYLLTYNVPEHLEIDIYRLVYKDGIGKTLKNHLFYIAKREDGSVIQLNPYWLSLELFTSNITELPINEKPILQQQILKLAFEDKSILEKKHTSQLNRMHDYLVETFKQQYNDVLERLLQYQADNVDNKNSVLINQMNAKLIDIEEQKTKRLEIINKQRTITLQPPKKIAQFELIPNGLSYRLMAVDYYELIESYEKSNGRKLLKIYDNLGLVDFYSERFNGEERFIILTNNPDFMINEAHLEDLNSIIDKTYVYLIKSEGLEERKLTNYY

SEQ ID NO: 6179 - DNA, 3186 bp, Bacillus cereus
atgcaaattggagatattattaatggacctttctttccagaatcaattgaaattaagaaattagacgcttttggtgaaggatactacttattagaaggtattggtaggcaaacgaatcaatactatgaacaactattaacaaaatccgatatagaaaaaattaatgtacttagtacttcaactacgtctaaagtaacgttaacgggacaagcgatacagcaacgacttatacatttaatgcttgaattagaggataagtattccaaaacacgtgccttagggaaccaaaaagtcattcccctacctcaccaaatagaggctgtatatagtcgcgtgttacagacatctaatattcgatacttattagcagatgatccaggtgctggtaaaaccattatgtctggtatgttaattaaagaattaaaggctcgtgaaagtgtacaacgtattttgattttagtaccaccattagtactgcgacaatggcaagaagaaatggcagaaaaatttcaagaatcttttaaaatcattaatcgtgctgtcttaaatgaatatggcagttcaaatccgttcatcgaaaacgattgctgtttagcttcaatctattggtctactcgcgatgatattaaagggttaattttagaagctcaatttgatttagttattgtggatgaagcgcataaaatggctgcttattcttacggcaaaattaaaaagaaaacgtctaaaacaaagctctatcatcttggcgaaaagctattagccaaaaccgaacactgtttattattaaccgccacaccacataaaggtgacgtagaaaacttccgtttattaatgaagctcattgaaccggatttatttaaccatgtctcagcaagtgaaacgctacgagagaaaacaaatccgtttattatacgtcgtttaaaagaatctatggtgaatttcgacggtacaccgatatttccaaaacggacaaccaaaacaattcaatatgagttgaccaaatcagaattagacttgtacgaggctgtaacacaatatgttcaaactcattttaatcgtgcgatgaatgctggcaataacagtacagcttttgcgatgatgcttctgcaacgtcgattaagttcgtctattgaagctattcataaatcgctaggccgacgttataaaaagttattagcgattttagacaatactgaaatggaacgtaagaagtacacgcaaaagttagaaaggctgtatgaaaataatttagaagaaaatgtaacagaatcatcagacatgtttgaaagaaaattggaactatctattgatataattgatttagaagtattaaaaaaagaaatagcacaattaaaaaagcttttaatcatgacaacatctttaaaaaaatatggcttagagaaaaaatatttagagctagaggaaatgttatttggtatagatggcttaatctatacgggtgaaaagattttaatttttacggagtctgtagacacactaaaatatttagaagaaaaactagcaactcgtgtagaacaaattgctaaaattgttggaagctattcaatggatgagcgacgcaaacaagtggaattcttccgtcaccatgcacaaattatgttggccacagacgccggtggtgagtcgataaaccttcagttttgtaatcaaatgattaactatgatatcccgtggaatcctaatcgtctcgaacaacgtatgggacgaattcaccggatagggcagaaaaatgaagtatttatttttaatttagtagcggcaaatacacgtgaaggttatgtgatgtctcgattattagagaagctagatacgatgaaagaagatttaggaaatgaccttgtctacaattttatgggcgatttattagatggcgatattaatttagctgatttaatgaaggaagccattttatcccgtgagcatctagatgatgtcatcgccaaaatggataaagaattaagtgatgagcataaagaattgttaaaaacaatgaaaaaaatgcagtttaattcagaatctattgatattaccgcgatcaaacaatctcaattcgatattgaaattaataaagtacctaatcgattatatatagacttaatgggttacgcctttacagaatcaaatgtaaaagtgtgtgatagtcatgaacatcgtgtgaagcgtattgaccgcttccccaaaattattcgagatcaatttgcaaaagaaacaacgatgtatgattcttatcgatatacagggtttattgaacatagcaatgaagaaatccattatgtcactaagacctatcctttatacacattagctaaaaagctcttacaaaaaaataacgatcaatttgcttttaaacgttatttactaacctataatgtccctgagcatctagaaatagatatatatcgacttgtttataaagacggcatcggaaaaacactgaaaaatcatttattctacattgctaaaagagaagacggctcagttattcaattaaatccatattggctatcactggaactattcacttcgaatataactgagttacctatcaatgaaaaacctattttacaacaacaaatcttgaaactggcttttgaagataaaagtatacttgagaaaaagcatacatctcaattaaacagaatgcatgattatttagtagagacttttaaacagcagtacaacgatgtattagagcgattattacagtatcaagcagataatgtagataataaaaattcagtcctaatcaatcaaatgaatgcaaaactaatcgacattgaagaacaaaaaactaaacgtcttgaaattattaataagcaacgaacaattacactgcaaccaccaaagaaaattgcacaatttgaactgattccgaatggcttatcttatcgactaatggctgttgattattatgaattaattgagtcctacgaaaaatccaatggtcgtaaactcttgaaaatatacgataatttaggattagtcgacttttacagcgaacgatttaatggtgaagaacgttttattattttaacgaataatccagattttatgataaacgaagcacatctagaagatttgaatagtatcatagacaaaacttatgtttatttaataaaaagcgaaggtcttgaagaaagaaaacttacaaattattattaa

SEQ ID NO: 6180 - protein, 1066 aa, Bacillus methanolicus
MFNIGEIVHGPHFPESVEIKRCELFGEFYIIEAIGRETNQFYELMLEKEKLTDLKSLKENKSEGNIQAIDIQRYLQYLMLHNEVKYSRTRALGNKKLLPLPHQIEAVYGRMLQVPQIRFLLADDPGAGKTIMSGMLIKELKARYSMERILILVPPLVVRQWQEELLEKFNEHFHIINRNVLKEYGGKNPFVANDLCLASMYWAAREDIKLLIQEAEFDLIIVDEAHKMAAYTHGTIKKRTSRTKLYQLGESILRKVPHCLLLTATPHKGDMENFRHLMKLIDEDIFSNISGNESLREKTNPFMIRRLKESMKNFDGTPLFPKRTTKTIKYTLTDEELALYDAVTQYVREHFNRAISNGSNSTAFAMMLLQRRLSSSLEAIHLSLKRRYKRLVQLYKQTEQERQKYIKKLGHIELENYLEEASEQQELIEKQLEHAVDSIDTTELKKEIMVLKKLIDQAENLKLYAVEKKYQELEKTLFGTNGLLQQNEKILIFTESTDTLNYLERKLLEHVPKIAKIVGSFSMDERRRQVELFRNECQIMLATDAGGESINLQFCNQMINYDIPWNPNKLEQRMGRIHRIGQKNEVFVFNLVAQNTREGSVMIRLLEKMEQMKEDLGSDLVYDFIGEVLEDKFDSLADLMQEAILNRERLDDVIANMEKTLSEEHQKLLKLMQEERMVEDPLDLSILKREQNDLTVKRIPIRAYTDLATYILEKKKVRVYDTNDGKVKRIERLPKFIRDSLPELARYQGESYRFTGVREYESEEVALLDSDHPIFKLSMDLMKKENEKRSWGGYLVTYDVPERLMVEVYNISIVDGTGKELENHFIHLAKRENGEMVALDPYWLFAGHFYENVIELSDYASNECIGHVLKQSSLIRDQVQAKRQKKLDKLLVFLEKSFNEQYRNTLEKLEKYQQENIENRNSALINQMNAHLIDLDMKKEERLNIIRRQKNISMKPPKKILSLQLAPTGRSKRVMSIDYKDVVEKYEKANGRMNIKMFDCLALVDFYSERFNGEERYIILTNDSNYMPSEEHLEDLADILNKVYIYVVQDGEIIEERAMEKEIFVF

SEQ ID NO: 6181 - DNA, 3200 bp, Bacillus methanolicus
atgtttaacatcggtgaaatcgtacatgggccacatttcccagaaagtgttgaaattaagcgttgtgaattatttggtgagttctacattatcgaggccattggacgagaaacaaatcaattttatgaacttatgctggagaaagagaaattaacagatttaaaaagtttaaaggaaaataaaagcgaaggtaatattcaagcgattgacattcagcgatatttgcaatatttaatgttacacaatgaggttaagtactcgcgaacaagagcattagggaacaaaaaattattaccattaccgcaccaaattgaagcagtttacggcagaatgcttcaagttccacaaattcgctttttacttgctgatgacccgggtgctggtaaaacgattatgtctgggatgctaatcaaagaattaaaagctagatatagtatggaacgtattctaattttagttcctcctttagtagtgagacaatggcaagaagaattgttagagaagtttaacgaacacttccatattattaatcgaaatgtgttaaaggaatacggtggaaaaaatccgtttgtcgccaacgatttatgtttagcttctatgtattgggctgcacgggaagatattaaactattaattcaagaagcggagtttgatttaattatcgtcgacgaagcgcataaaatggcagcgtatacacatggaacgataaaaaaacgcacttcaaggacaaaactgtatcaattaggcgagtcgatattacgtaaggtgccgcattgtttgttgttgactgctactccgcataaaggtgatatggagaatttccgccatttaatgaaattaatcgatgaagatattttctccaatataagcgggaatgaaagtttacgtgaaaaaacgaatccattcatgatccgccgtttgaaagaaagtatgaaaaactttgacggaacaccgctatttccaaaacgaacgacgaaaacaattaaatatactttgacagacgaagagctagctttatatgatgcggtaactcaatatgtaagagagcattttaaccgagcgataagtaatggaagtaatagtactgcatttgcgatgatgctcctgcaacgacgcctaagttcgtctttggaagcgattcatttatctcttaaaagaagatataaacgtttagtccagttatacaagcaaacagagcaagaaaggcaaaagtatattaaaaaattaggacatattgagttggagaattatttagaagaggcgagcgagcaacaagaattgattgagaaacagttggaacatgctgtagattccattgatacaaccgaattaaaaaaggaaattatggttttaaagaagttaatcgatcaagcggaaaatcttaagttatatgcggtagagaaaaagtatcaagaattagagaaaacgctgtttgggacaaatggactacttcagcaaaatgagaagattctcatttttacggagtctacagatacattgaattatttagaaagaaagcttcttgagcatgtaccaaaaatcgcgaaaattgttggtagtttttcaatggatgagcgtagaagacaagttgaacttttccgaaacgagtgtcaaattatgcttgcaactgatgcaggtggagaatcgataaatctccagttttgtaatcaaatgattaactatgatatcccttggaatccaaataaattagaacagcgaatgggacgtattcatcgtatcgggcagaagaacgaagtgtttgtatttaacttagtagcgcaaaatactcgtgaaggtagtgtcatgattcgtctgcttgaaaaaatggagcagatgaaagaagacttaggatctgatttagtttatgattttattggcgaagttttagaagataagtttgatagtttagccgacttaatgcaggaagcaattttaaaccgagaacgtctggatgatgttattgccaatatggaaaaaacattgtcggaagagcaccaaaagctattgaagctcatgcaagaagaaagaatggttgaagatccgctcgatttatcgattttaaaacgtgaacaaaatgatttaacagtaaaacgcattccaattcgggcatatacagatttagcaacatacattttagaaaagaaaaaggtccgagtctatgatacaaacgatggtaaagtaaaacgtattgaacgtttaccaaaatttattcgagacagcctgcctgaattagctcgttatcaaggagaaagttaccgttttacgggtgtgcgtgaatatgaatctgaggaagtggcgttattagatagtgaccacccaatttttaaattaagtatggacttaatgaaaaaagaaaatgaaaagcgttcttggggaggatatttagtcacttatgatgttcctgaacgattgatggttgaagtatacaatattagcattgtagatggaacaggaaaagaacttgagaaccattttattcatctagccaaacgagaaaatggcgaaatggttgcattagatccatactggctatttgctggtcatttttacgaaaacgttattgaattaagtgattatgcatcaaacgaatgtataggacatgttctaaagcaatcatctttaataagagatcaagttcaagccaaacgtcaaaaaaaattagataagcttctggtattcctagagaaatcttttaatgaacaataccgtaacactctagagaagctagaaaaatatcaacaagaaaacattgaaaatcgcaatagtgcccttattaaccaaatgaacgctcatttaattgacttagatatgaagaaagaagaacgtttgaacatcattcgtcgccaaaaaaatattagcatgaaaccaccaaagaaaattctttctttacaacttgcccctacaggacgcagtaaacgagtcatgtctattgactataaggatgtagtagaaaaatacgaaaaagcaaacggacggatgaacataaaaatgtttgattgcctagcattagtcgacttttacagcgaacgctttaatggcgaagaacgctatatcatcctgacaaacgattcaaattatatgccatctgaagaacatcttgaagatttagctgatattttgaataaagtgtacatttatgtcgttcaagacggcgagattattgaagagagagcgatggagaaggaaatatttgtttttta

SEQ ID NO: 6182 - protein, 986 aa, Thiorhodovibrio sp.
MKSSSVGQEWRYSTVHNSACLCLEEQTLWGQTVCRVWLPNQDAVVRVPRSALRSLSSDLQPEIEAGRIAYVAAAAKVAEVLEGSLFSSGSATDGHVLLAPMESNVIPLPHQIHALSQAISGDRVRYLLADEVGLGKTIEAGLVMRELKLRGLVRRILVVSPKGIATQWVAEMQTHFNEPFQLVLGDDIGTLQRLAPQFGKSPDHRKSAWSMFDQVIVSLDSVKPMDKRRGWNAERVAEYNRSRFEDLVTAGWDLVIVDEAHRLGGSTDQVARYKLGRGLAEAAPYVLLLSATPHQGKTDAFHRLMNLLDDDAFPDTDSVSRDRVAPYVIRTEKRKAIDADGKPLFKPRRTQMAPVAWESRHQLQQLLYEAVTDYVREGYNQALREKKRHIGFLMILMQRLVVSSTRAIRTTLERRLGALKDGEQQASLRLLELEKSELENGAEGSESPDDDIAELYDMDGQELLDALLKSHVSALQSERSHVETLLDAAVRCEQAGPDAKAEALIERIYTLQAEENEPDLKVLIFTEFVPTQQMLKEFLEARGISVVTLNGSMGMEERGAAQDAFRKSRRVLVSTDAGGEGLNLQFAHIIINYDIPWNPMRLEQRIGRVDRIGQPKAVRAINFVFEDSVEFRVREVLEQKLSVILKEFGIDKTGDVLDSAQAGELFEDVFAQALVNPDGIETSVDHTVARIRDEIQQVRESSAIYGLSEEPDVQAAERLRSHPLPHWVERMTVAYINSHGGAATRKRSWWDLNWPDGEEHRKAVFSAREADRLTDATLLNPENSRVRGLAMNLPQVAPGQPLPCVAVSGLPASISGLWGLFEIRLHAGVQPTDQPYHQSLRIPPMRRDWFSLFLNQEGQVFLPTARHIWDTLVSTDPEVRSSLDQDASRIAFASLLTAAEEAGQTIFDTLRQTHHDALGREEERGQTAFSARRRAIERLGLPEVRHYRRTRCDAEESEWRQALETARALMPDIRPLLALRITPEER

SEQ ID NO: 6183 - DNA, 2961 bp, Thiorhodovibrio sp.
atgaaatcttccagcgttggtcaggagtggcgatacagcaccgttcataacagcgcctgcttgtgtctcgaagaacagaccttgtgggggcagacggtgtgccgtgtctggttgccgaaccaggacgcggtggtgcgcgtgccccgctccgccttgcggtcgctgagttccgatctgcagccggagatcgaggccgggcggattgcctatgtggccgcagcagccaaggttgccgaggtgctcgaaggcagcttgttctctagcggcagcgccaccgacggccatgtattgctggcccccatggaatccaatgtcatcccgctgccgcaccagatccacgccttgtcccaggccatctccggcgaccgcgtgcgctatctgctggccgacgaggtgggcctcggcaagaccatcgaggccgggctggtcatgcgcgagcttaagctgcgcgggctggttcggcgaattctggtcgtctcgcccaaaggcatcgctacccagtgggtggcggaaatgcagacccacttcaacgagccgttccagctcgtgctgggcgacgacatcggcaccttgcaacgcctggccccccaatttggaaagagcccggaccaccggaaatcagcctggtcgatgttcgatcaggtcattgtttctctggattcggtcaagcccatggacaagcggcgcggttggaacgccgagcgcgttgccgaatacaaccgcagccggttcgaggatctggtgaccgccggttgggatctggtgatcgtggacgaagcgcaccgcttgggtggcagcaccgatcaggtcgcacgctacaaactcggccggggattggccgaggccgcgccctatgtgctgctcctttcggcgaccccccaccaggggaagaccgatgccttccatcgcctgatgaacctgctggatgacgacgcctttccggatacggacagcgtctcccgcgaccgggtggctccgtatgtcatccgtaccgagaagcgcaaggccatcgatgccgacggcaagccgctcttcaaaccccggcggacgcagatggccccggtggcctgggagagccgtcaccaactgcagcagcttctctacgaggcggtgactgactatgtgcgcgagggctacaaccaggctctgcgcgagaagaagcgccacatcggctttctgatgattctgatgcagcgcctggtggtctccagcacccgggcgattcgcaccaccttggaacggcgactcggggcgctcaaggatggcgagcaacaagccagcctgcgcctcctagaattggaaaagagtgagcttgaaaatggcgcggagggatcggaaagcccagacgatgacatcgccgagctgtacgacatggacggccaggagctgctcgatgcgctgctgaaatcccatgtatcggctctgcagagcgaacgcagccatgtggaaaccctgctggatgcagcggttcgctgtgaacaggctggccccgatgccaaggccgaggccctgatcgagaggatctacacgctgcaagccgaggaaaacgaaccggacctgaaggtgctgatcttcaccgagttcgtgccgacccagcagatgttaaaagagtttctggaagcccggggaatctcggtggtcaccctgaacggctccatgggcatggaggaacgtggggcagcccaggatgccttccgcaaatcgcgccgcgtattggtctccaccgatgcaggcggtgagggtctgaacttgcagttcgcccacattatcatcaactacgacatcccctggaacccgatgcggctggaacagcgaatcggtcgcgtggaccgtatcggccagccaaaagcggtaagggcaatcaatttcgtatttgaagattcggtcgagtttcgtgttcgcgaagtgctggagcaaaagctctcagtgatcttgaaagaattcggcatcgacaagaccggcgacgtgctcgactccgcccaggccggtgagttgttcgaggatgtgttcgcgcaggccttggtgaatcctgacggcatcgaaacctcggtcgatcacacggtggccaggattcgcgatgagattcagcaggtgcgcgagtcctccgccatctatggcctctccgaagaaccggatgtgcaggcggctgagaggctgcgctcgcatccgttgccccactgggtggagcggatgacggtagcctacatcaactcccatggaggtgcggccacccgcaagcgctcctggtgggatctgaactggccggacggcgaggagcatcgcaaagccgtgttcagcgcccgagaggcggatcgtctcaccgacgcaaccctgctcaatcctgaaaacagccgcgttcgtgggctggccatgaacctgccgcaggtcgcgccaggtcagccattgccttgcgtcgccgtgagcggcctgccagccagcatctccgggctttgggggctgtttgagatccgccttcacgccggcgtccaaccaaccgaccagccatatcaccaatccctgcgcattccgccgatgcgccgcgactggttcagcctgttcctgaatcaggaaggacaggttttcctgccgactgcccgccacatctgggacacgctggtcagcaccgaccccgaggtgcgttcatcgctcgaccaagacgcctcccgaatcgccttcgcatctttgctcactgccgccgaagaagctgggcagaccattttcgacaccttgcgccagacgcaccacgacgccttaggccgcgaggaagaacgcggccaaaccgccttcagtgcgcggcgccgtgcgattgaacggcttggcctgccggaggtgcggcactaccgccgcacgcgctgcgatgccgaagaatccgaatggcgtcaggcgcttgaaaccgcgcgcgcattgatgcccgacattcgccctttgctggcgttgcgcattactccggaggaaagatga

SEQ ID NO: 6184 - protein, 940 aa, Nitrococcus mobilis
MSEGFAIGDWCWHARQGSPCRVVDRQDVWGETAYRVWLPAKDALVRARDQDLGDLSCVRPTVEQILHTAAAAKLLDAIEDNLLLAPIQSSVVPLPHQLYALNRAMSRDRIRYLLADEVGLGKTIEAGLILRELKLRGMAQRVLVVAPKGLVRQWQAEMRLHFGEHFRFIEPSELAAFRQWRDNGTQGDENLWRMHDQVICSLDSVKPIDGRRGWSVEQLATYNRERFEDLISASWDLVIIDESHRLGGSTDQVARYKLGAALAEASPYLLLLSATPHQGKTDQFMRLMQLLDRETFPDESSINRDRVRPFVIRTEKRAAIDAEGQPLFKPRTTRLQAVAWQERHAAQQRLYEAVTDYVRHGYNQAMAAKQRHIGFLMILMQRLVTSSTAAIRTTLEKRRALLETPQAQTQLVDRPELDEWTELDGQAQLDVVIQGSGWEREKAEVGLLLDLAIETEHQGTDAKAETLLELIYKLQQEENDPQLKVLIFTEFVPTQAMLAEFLESRGFSIALLNGGMDLDARTRAQQVFSRDARVLISTDAGGEGLNLQFCHVIVNFDMPWNPMRLEQRIGRVDRIGQPHVVRAINFVLEDTVEHRVREVLGEKLSVIAQEFGVDKAADVMDSAEVEPIFDELFVHGLQDPASIDKECDAVIDQVRQRVAANRQDADLLAEEHTLEVDDARKWRDHPAQYWLERAITAGLPSRGGAAERVGDAWRVKWVDGSESPCVCFDARTAEQNPEMEWITLEDPRARAVISELPRHVAGQPLAVAAVTGLPDTVRGVWSLWEISLSASHVSENFSRRRFLPIFVTEDGRTFVPTAKRIWDLLLTESVSLAPDVEVENASSSFEASLAAAKAQGERLFADLLEEHRTWLAEERERTRYAFESRYQAIGRIGLPAVREHRRRRLEAEHEARMASLADAEVCTPDLDAVLLLRVGHPEGA

SEQ ID NO: 6185 - DNA, 2823 bp, Nitrococcus mobilis
atgagcgagggcttcgccatcggcgactggtgctggcacgcccgacagggatcaccctgccgggtagtcgatcgccaagacgtttggggtgagactgcctaccgcgtctggctaccggccaaggatgcgctggtgcgcgcccgagaccaggatcttggcgacctctcctgtgtgcgcccgaccgtggagcagattctgcacacggcggcagcggcaaaactactcgacgcgatcgaggacaacctgctactggcaccgatccagtcgagcgtggtgccgctgccgcatcagctctatgccctgaatcgtgccatgagccgcgaccgcatccgctacctgctggcagacgaggtcgggctgggaaagactatcgaggccggtctgattctgcgcgaattgaagcttcgtggcatggcgcagcgggtgctggtggtggcaccgaagggactcgtacgccaatggcaggcggagatgcgccttcacttcggtgagcactttcgtttcatcgaaccatctgaactggctgccttccgtcagtggcgtgacaacggtacccagggggacgaaaacctctggcgtatgcatgatcaggtgatctgttcgctggactcggtgaagccgattgatggtcggcgcgggtggagcgtggagcagctggccacctacaaccgcgaacgcttcgaagacctgatatccgcctcttgggatctcgtgatcatcgacgaatcgcatcggcttggcggtagcactgatcaggtcgcccgctacaagctgggcgctgcgttggccgaggcgtcgccatatctgctgttgctgtccgctacccctcaccagggcaagaccgaccagttcatgcggctgatgcagttgctggaccgggaaacctttccggatgagagcagcatcaaccgtgaccgggtgcggccgttcgtaatccgtacggaaaagcgtgctgccattgatgccgagggacagcccctgttcaagccacggacgacgcgcctgcaggcggtggcgtggcaggagcgccatgccgcccagcaaagactgtacgaggctgtgaccgactacgtgcgtcatggttacaaccaggcaatggcggccaagcagcgacatatcggatttctgatgatcctgatgcagcggctggtgacgtctagtacggctgccatccgcacgaccctggagaagcgcagggctctgctggagaccccgcaggcgcagacgcagctcgttgataggcccgagttggacgagtggaccgaacttgacggccaagcgcagctcgacgtggtgatccagggtagtggctgggagcgcgagaaggcagaggtcgggctgttgctcgaccttgctatcgagacggaacaccaaggaacagatgccaaggcggagaccctgctcgagctgatctacaaactccagcaggaagagaacgacccacagctcaaggtgctgatcttcaccgagtttgtgcccacacaggccatgctggcggagttcctggaaagccggggcttttctatagcgttgctcaacggtggaatggacttggacgcgcgcacgcgtgcacagcaggtcttctcgcgagacgcacgagtgcttatctcgacggacgcaggcggcgagggcctgaatctgcagttctgtcatgtcatcgtcaactttgatatgccgtggaacccgatgcggctagagcagcgcattggccgcgtggaccgaatcggccagccgcatgtcgtacgagccataaacttcgtgctggaagacacggtcgaacaccgggtgcgcgaggtgttgggggagaagctctccgtcattgcacaagagttcggcgtcgataaggcggccgatgtgatggactcggcagaggtagaaccgatcttcgacgagctgttcgtgcatggactgcaagacccggcttcaatcgacaaggaatgcgatgcggtcatcgaccaggtacgacagagggtagcggcgaatcgccaggatgctgacctgctggcggaggagcatacgcttgaagtggatgatgcccgtaagtggcgcgaccatccggcgcaatattggctggagcgtgccatcaccgctggattgccatcgcgcggtggcgcagctgagagagttggcgacgcatggcgcgtgaagtgggtcgacggcagcgagtcaccctgtgtctgcttcgacgcgcgcaccgcggagcagaacccagaaatggagtggatcacactcgaggacccacgcgcacgcgcagtgatcagtgagctgccgcgccacgtcgctggacagccgttggctgtagccgcggtcacaggcttgcccgatacggtgcgaggggtgtggtcactgtgggaaatcagcctgagcgcgtcccacgtctccgagaatttcagccggcgacgattcttacccatcttcgttaccgaagacggccgcacctttgtgccgaccgccaagcggatctgggatttgctgttgacggagtcggtgtcgctcgcgccggacgtcgaggtggagaacgcttcaagcagcttcgaagcatcgctggctgcggccaaggcgcaaggggagcggctttttgcggatctgctggaagagcaccgtacttggctcgccgaggaacgcgagcggacgcggtatgctttcgagtcgcgctatcaggcgataggccgcatcggattgcccgcggtcagagagcaccgacgcaggaggctcgaagctgaacacgaggcccgtatggcgtcgctagcggatgcggaagtctgcacgccggatctcgacgcggtgttgttgcttcgcgtgggtcacccggagggcgcctga

SEQ ID NO: 6186 - protein, 1410 aa, Rhodopirellula sp.
MTMTPEAKGQLSKTIRALRARLLEDFKSANDSTYKYSIRRIDQARLSEANATRRRRIEAWTAEQVRGEAGKKKKREAEDFRRDLEKQAAYTLLNRLLILRLMEAGGLHAGDLVAKGWQSDVFGQLRFFSGEIVESDETEGFGFWLRMVFDDLAIDMPGLYGDAGMSEYIPIRTQTLRAVVEAFADPALDSCWTDDMTLGWVYQYWNDPERERLDKKINDGGKIEPHEIASKTQMFTERYMVDWLLQNSLGPMWLAMCQKHGWTPLAESTGTLETLENRRVEWRAKRDAGDVELVDLMPLETELEHRWAYYVPQPIPDDAVEHAPESVRGLKILDPAVGSGHFLIVAFDLLFALYEEEARHRGDIDAEENWSPKAIVESILENNLHGVDLDPRAVQIAAAALWIKAKAKCAIAHPSRLNLVASNLGIARLPDNDPALVELRETVEKETGIPASLTNQIIEALRGADHLGSLLKIDKAIDDAITNYAVEIGWEGNAMQLNMFPDGRMEQQNLPFPKERATRTLLAAIETFLEKHSGADELGLRLHGEQLATGVRFMRIVKEGRYDLVIANPPYQGTSKLVTSTYIDKEYSTAKADLYAAFILRGLMLVRSGGTSAMLTMRNWMFIQQYDAFREFLLPNYDLRSLGDFAVGAFDEVPNDILSVVASVFRKCTVADLPGVAIQPTPPGVPEYDRQRTKRKRATVLCQYGSFTFKSESFQNIPSMPAIYWWSDEFVRSYSSASKLGDDSSGKFGINLGNNTRFVVRPWEPTPTSFVSIAIDSEIVPELTQRTFTRYLMGAKGTAWCDPVENLVRWKDRGLEVKVSAEYRYGSYTRKVTNEAFYFLPGIAFSTVGSQFTARLHQWRCVIDGSGSSVYPSDCGQTICVMNASVSKKILESLNPTISFTVGDVNRLALIEIEEASAIISRVQGAFERHENCREPSTLFRSPGSSSWEMIQDWAQQAVDTPGGESLPTFDEQFTPETATDHLSFAVGVSLGRFGANGEGLLDPNTDSLDHALPNGMLFLDGTLDESDDRDSLGHPAAAPLRAAWAEYGPQLKTRRNLRQWLIHDFFKDVHKDMYENRPIHWPISSKNKTFVAFVNIHRWNANTLRHLLADHLRTGSLPRLDGELEDLRANRGDKDTDARFAKVKAWKEELDEFIAMVNQCSEKGPPPTDEACPDREVDARYDPDLDDGVMINSAALWPLLEPQWKDPKKWWKQLALANPKGNKDYDWSHLAMRYWPTRVDEKCQEDPSLGVAHGCFWKYHPARAWAWELRLQSEIAPDFRIEEASYRNDGGDTEHRAAYLRDDPLEAIAAIEKEVHRRRKDEKGKFLRELTILEPGLWSAEPEACWDMETRIIKKQEFGFRLIAPDEETARAKLLKETPQKATGRNKLLQNRGGDSGYLVGWQEAVEEA

SEQ ID NO: 6187 - DNA, 4233 bp, Rhodopirellula sp.
atgacgatgacacccgaggccaaaggccaactttctaaaacgatacgtgcacttcgtgcccgactgctggaagacttcaagtcggccaacgattcgacgtacaagtattccattcgacgcatcgaccaagcccgactcagcgaagccaatgcgacgcggcggcgacggatcgaggcgtggacggcggagcaggtgcgcggtgaggcgggcaagaaaaagaaacgtgaagctgaagacttccgtcgagatcttgaaaagcaagccgcttacacactgctaaaccgactgctgatcctgcggttaatggaagcgggtgggctgcacgctggcgatctggtcgccaagggttggcagagcgatgtgtttgggcaattgcgattcttctcgggagagatcgttgagagcgacgagaccgaggggtttggcttctggcttcggatggttttcgacgatctcgcgatcgacatgcccggcttgtacggcgacgccggtatgtcggagtacatcccgatccgaactcaaactttgcgagctgtcgtcgaggcatttgcggatccggcgttggattcctgctggaccgacgacatgacactcggttgggtctaccaatattggaacgaccccgagcgggaaaggctggacaagaagatcaacgacggcggcaagatcgagccgcacgagatcgccagcaaaacgcagatgtttaccgagcgatacatggtcgattggctgttacaaaacagcctcggcccgatgtggttggcgatgtgccaaaagcatggctggacaccgctggctgaatcaacgggcacgctggagacgctggaaaatcggcgagtcgagtggcgggccaaacgggatgctggcgacgtcgaacttgtcgacctgatgccgttggagacggaactggaacatcgctgggcgtactacgttccgcaaccgatccccgatgacgcggtcgagcacgctcccgaatcggtccgcggtttgaagatcctggatcccgccgttggttcggggcactttctgattgtcgcgtttgatttgctatttgccctgtatgaggaagaagcgagacatcgcggcgatattgacgcggaggagaattggtcgccaaaagcgatcgttgaatccattctcgaaaacaacctgcacggcgtagacctggatccacgtgccgtacaaatcgcagcggcagcgttgtggatcaaggccaaggcgaaatgtgccattgctcatccatcgcgtctgaatcttgtcgcatcgaacctgggcatcgcacgactgccagacaacgatccggcgttagtcgagttacgcgagaccgttgagaaggaaaccggcatccccgcatcgctgaccaaccaaatcatcgaagcccttcgcggagccgatcatttgggtagcttgctgaagatcgacaaagccattgatgatgcgatcacgaactacgcggtcgagattggttgggaagggaacgcgatgcaactaaatatgttccctgacggtcggatggaacaacaaaaccttccgtttccaaaagagcgggcaacgagaactctactcgcagcgattgagacttttttggagaagcactccggtgccgatgaacttggcttgcggctacacggtgagcaattggcgactggcgtgcgtttcatgcgaatcgtaaaggagggtcggtacgatcttgtaatcgcgaatccgccctatcaggggacgagtaagcttgtgacgtcaacatacattgacaaagagtactccacggcgaaagcggatctttacgccgcatttatcttacgagggttgatgcttgttcggtcgggcggcacctctgcaatgctgacaatgcgaaattggatgttcatccaacagtacgacgcattcagagaatttttgcttccaaactatgacctgcgatcactgggcgatttcgccgttggcgcgtttgacgaggtacctaacgatattctgtcggtcgttgcgagcgtctttcgcaaatgcactgttgccgacctccccggcgtggcaatccagccgacgcccccgggcgtcccagagtatgacaggcaacgaacaaaacgcaaacgagctaccgttttgtgtcagtatggttcgtttactttcaaatcagagagttttcagaatattccaagtatgccagccatctattggtggtccgatgaattcgttcggagctattcatctgcgtcaaagctaggagatgattcgtccggaaaattcggcataaacctcggcaacaatactcgctttgtagtccgaccttgggagccaacgccgacctcttttgtgtccatcgcgatcgacagtgagattgtcccagaacttacccaacggacatttacacgttatttaatgggagccaaaggcaccgcttggtgtgacccggttgagaatttggttcgctggaaagacagaggacttgaagtaaaggtttctgctgaataccgatacggaagctatacaagaaaagttacgaatgaggcgttttacttcctgccaggaattgctttttcaacggttggctcgcagttcacagcacgtcttcatcaatggcgttgtgtgatcgacggtagcggatcttcggtctacccaagcgattgtgggcaaaccatttgcgtcatgaatgcctcagtatcgaaaaagattttagaatcgctcaacccaacgatctccttcaccgttggcgatgtaaatcgccttgctctaattgaaattgaagaagcatcggcaatcatctcacgagtgcaaggcgcattcgagcgtcacgagaactgccgcgagccttcgacgctatttaggagtccagggtcgtcgtcttgggaaatgatacaagattgggcgcagcaagctgttgatacacccggcggagaatctctccctactttcgacgaacaattcactcctgaaacagcgaccgaccatcttagtttcgcggttggtgtttcattgggcaggttcggggcaaatggtgaggggcttcttgatccgaacactgattcgctcgatcacgctttaccgaacggcatgttgttcctcgatggtaccctcgatgaaagcgatgaccgcgatagcctgggacatccggcagccgctccgctgcgcgctgcttgggcagagtacgggccgcaacttaaaacgcggcgaaatttgcggcagtggttgatccatgattttttcaaagacgtccacaaggacatgtacgagaaccggcccatccactggccgatttcgtctaagaacaagacttttgttgccttcgtcaacattcatcgttggaacgccaacacgctacgccacttgctagccgatcacttacggaccggttcactaccgagactcgatggcgaactggaagacttgcgggccaatcgcggcgacaaagacaccgacgctcgattcgcgaaagtcaaggcgtggaaagaggaactcgacgagttcatcgcgatggtgaaccagtgcagcgaaaaaggtccgccgccgaccgacgaggcttgcccggaccgtgaagtcgacgctcgctacgatcccgacctggacgacggcgtgatgatcaacagcgcggccctgtggccgctgctggaaccgcaatggaaggatcccaagaagtggtggaagcaactcgccctggccaaccccaaaggcaacaaggattacgactggtcgcacctggcgatgcggtactggccgactcgcgtcgatgagaaatgccaagaggatccatccctgggcgtcgcacacggttgcttctggaaataccacccggcccgagcctgggcatgggagctacgtctgcagagtgagatcgcacccgacttccgtatcgaagaggcttcctaccgcaacgacggaggcgacaccgaacatcgagccgcctacctccgcgacgatccgctcgaggccattgcagcgatcgagaaagaagtccaccgtcgccgcaaagatgagaagggaaaattcctccgcgaactgacgatcctggaacccggtctctggtccgccgaacccgaagcgtgctgggacatggaaacccgcatcatcaagaaacaagaattcggcttccgcctaatcgcccccgacgaagaaaccgcccgtgccaaactgctgaaagaaactcctcaaaaagccaccgggcgcaacaagctgctgcaaaaccgcggcggtgactctggctacttggtcggatggcaggaggcggtcgaagaagcatga

SEQ ID NO: 6188 - protein, 1416 aa, Pseudanabaena biceps
MTYLTPTAKSQLSKTIRNLRDRLITDLHNAVESTYLMGVKLEQVQLDEERHCKRERLEKYLEELVKGDLAVHKGKQSPKLKQELRDRHRQDLEKLAAATWLNRLAVIKHLEAMGLLKPKLVTGGWQSPAFKEFRDYAPEFLQEEDQGYGLLLRLVFDELALDLSGLFGRGGLNGYIELIPMPALTLRYLVEALDKVEADAWRDDTTLGWIYQYWNDPERESIDQKMNDGGKVEPHEIASKTQMFTERYMVEWLLQNSLNNQWLDICAANGWVAEAVSDRTLETLETRRQDWRQRREAGDVALDELMPIENEQEQRWKYWVRSPLAPLVKGGKDSLEVSPHKEDGRSPLTPLEKGGKDSLSLLPPSQGGLGGIETLQRRQTDLNEQSSLDKANLSLRNLKLIDPACGSGHFLVIAFDLLFAFYQEELRHRGEVWSDAAIANSILENNLYGIDIDARAVQMAAAALWLKAKGLCKDAAPKQINLVAANLNLANLPKDDPELLNFYDEVKQETGIPPKLTMQIVEALKGADVWGSLLKVDGAVTQAIADYETQVKVLLEPQQGSLFEGFRPAQARLDFDKALAQVTVLEALERFLQQRSQSDDLGVRLWGEQLAAGVRFVRMVREGQYDLVIGNPPYQGTSKMADAGYLSKHYPKGKADLYAAFLQRGLELAKDGGFSALLTMRNWMFISQYSAIREFLIENYDLRLLGDIDRGGFEAIVDEVVSTVMSIFVKKNPSESFSIAIQPTPLDDNSRDSQRTNRKRAAVLAHVGRYEFKTQNFNVIKEKPLIYWWDDAFLKLYDKTPKLGDETDVKQGMATANNTRFLRYPWEINPNELFICPIDDLSELPQYKWVPYIKGASGKSWFEPLDIVIRWENSAIEKQILYDYFGSKGGGNGMPSRSFYFRKGIAFSMIGSSFRGRIHRYKSVFGNKGSSIFPERFANCLCLINSNLSQEILISLNPSVGFEVGDVNRLPLFPIESADEIFRELEKAFSEHEAGRETSVEFISPRPSPWRTAQTWAQTAVDRPAGTPLPPYHPEYDPPTAQDFISYAVGLALGRFGRPSSPQPPSPRTGEGGAREFAPLSLNGRGAGGEGLSILYLSAYSQDLPEIGDRLTHPAAAPIHQAWAEHGANISKKTLREWLRQDYFKEDHLKRYDQRPIYFPISSTKKNFVAIIPIHQWTDNTLQTLLADHLLPDQNHLLGEINDLMAARNQADTKARATAEKRYSELIKLQEELQDLITKVQAIAERGAPPTKPSDPPREVDATFKMDLDDGVMINSATLWTLLEPQWNKPKTWWSELSTAQNKKDYDWSHLAARYFPSRVDEKCQKDPSLAVAHSLFWKYHPAKAYEWELRLQDEISPDFHIEEPDSQSLRDAFIKDNPELVLDLRQKEQKRRERKKNKEEDLLLLELEEETVPQG

SEQ ID NO: 6189 - DNA, 4251 bp, Pseudanabaena sp.
atgacctacctcactcctacagctaaatctcaactctccaaaaccattcgcaatttgcgcgatcgcctgattactgacctacacaacgccgtggagtccacatacctgatgggcgtaaagctagaacaggtgcagctagatgaggagcgtcattgtaagcgggagaggttagagaaatatctggaagaactggtgaagggggatcttgcggttcataagggcaagcaatcgccaaaactcaaacaggaattacgcgatcgccatcggcaggatctcgaaaagttggcggcggcgacttggctgaatcggttagcggtgattaagcatttagaggcgatggggttgctgaagcccaaattagttacaggaggatggcaaagccctgcgtttaaggaatttcgggactatgcaccagagtttttgcaagaggaagatcagggctatgggttgctgttgcgattggtgtttgatgaattggcgctagacttgtcgggtttatttgggcgcggcggattgaatggctatattgagcttattcctatgcctgcgttgactttgcggtatttagtggaggcgctagacaaggttgaggcggatgcttggcgtgatgatacgaccttgggatggatctatcaatattggaatgatcctgaacgggagagtattgatcaaaagatgaatgatggcggtaaggtagagccgcacgaaatcgccagtaagacgcaaatgtttacggagcgctatatggtggagtggctattgcaaaatagcttgaataatcaatggctcgatatttgcgcggcgaatggttgggttgcggaggcggtgagcgatcgcactctggaaactctagaaacaaggcgacaggattggcgacaaaggcgggaggcgggggatgtggcgctagatgagttgatgcccattgagaatgagcaagaacagcgttggaagtattgggtgagatcccccctagccccccttgtaaaggggggaaaagattctcttgaagtttctccgcacaaggaggatggaagatcccccctaaccccccttgaaaaggggggaaaagattctctttctcttctccccccttcacaaggggggctgggggggatcgaaaccttgcaacgtagacaaacagacttgaatgaacagagtagccttgataaagctaatctttccctccgcaacctcaaactcatcgatcctgcctgtgggtcggggcatttccttgtgattgcttttgacttgctgtttgctttttatcaagaagaattgcggcatcggggggaagtttggtcggatgcggcgatcgctaatagcatcttagagaataatctctatgggattgatattgatgcgcgggcggtgcagatggcggcggcggcgttgtggctgaaggcgaaggggctttgtaaggatgctgcaccgaagcagattaatctggtggcggcgaatttgaatttggcgaatttgccgaaagatgatcctgagttgttgaatttttatgatgaggtgaagcaggagacggggattccgccgaagttgacgatgcagattgtggaggcgctgaagggggcggatgtgtggggtagtttgctgaaggtggatggggcggtgacacaggcgatcgctgattatgaaacacaggtgaaggtgttgctagagccgcagcagggtagtttgtttgagggttttcgtcctgctcaggcgcgattagattttgataaggcgctggcgcaggtgacggtgttggaggcgttggagaggtttttgcagcagcgatcgcagagtgatgatctgggggtgcggctgtggggtgagcagttggcggcgggggtgaggtttgtgaggatggtgcgggaaggtcagtatgatctggtaattgggaatccgccgtatcaggggacaagtaagatggcggatgctggttatttgtcgaagcattaccccaaggggaaggcggatctctatgcggcgtttttgcagcgtggtttggagttggcaaaggatggtggtttttcggcgttgctgacgatgcgaaattggatgtttatcagtcaatattcggcaattcgggagtttttgattgagaattatgatctgcgattgttaggggatatagatcgcggtggttttgaggcaattgttgatgaagttgtttctacggtgatgagtatttttgtaaaaaagaatccatcagaatcttttagtattgcgatccaaccgactccattagatgacaattcaagggatagccagcgaacgaatcgcaaacgggcggcggtattggctcatgtgggaagatatgagttcaaaacgcaaaattttaatgtcatcaaagaaaagcctctcatttactggtgggatgatgcctttcttaaactctacgacaaaactccaaaattaggcgatgaaacagatgttaagcaaggaatggcaacggcaaataatactagattccttcgctatccttgggagataaacccgaatgaactatttatttgtcccatagatgatttatcagaattacctcaatataaatgggttccttatattaaaggagcgtctggaaagtcgtggtttgaaccacttgatatagttatacgttgggaaaattctgctattgaaaagcaaattctatatgactatttcggctctaaaggaggtggaaatggtatgccaagccgttctttttactttaggaaaggcattgctttctctatgataggatcttcatttagaggtaggatacatagatataagagtgtatttgggaataaaggatcatctatttttccagaaagatttgcaaactgtctttgtctaatcaacagtaatttgtcacaagaaattttaatctcactaaatcccagtgtaggttttgaagttggagatgtaaaccgacttccattattccccatagaatccgcagacgagatatttagagaacttgaaaaagcatttagcgaacatgaagcaggacgcgagacatccgtagaatttattagcccccgacctagcccttggcgcaccgcccaaacatgggcgcaaaccgccgtagaccgacccgcaggcacacccctccctccctaccatcccgaatacgacccacccaccgcgcaagactttatttcctacgctgtggggttagcattgggacggtttggaagaccctcatccccccagcccccttctcccagaacgggagaagggggagcaagagaatttgctcccctctccctcaatgggagaggggctgggggtgagggtctttctatcctctacctctccgcctatagccaagacctccccgaaatcggcgatcgcctcacccaccccgccgccgcccccatccatcaggcatgggcagaacatggcgcaaatatctctaaaaaaacactccgcgaatggttacgccaagactacttcaaagaagaccacctcaaacgctacgaccaacgcccgatctacttccccatctcatccaccaaaaagaactttgtcgcgatcatccccatccaccaatggacagacaacaccctgcaaaccctcctcgctgaccacctcctccccgaccaaaaccacctcctcggtgagatcaacgacctcatggcggcgcgtaaccaagctgacactaaggcaagagccacagccgaaaaacgctatagcgaactaatcaaactccaagaagaactgcaagacctgatcaccaaagtccaagcgatcgccgaacgtggcgcaccacccaccaaacccagtgatccaccccgtgaagtcgatgccaccttcaaaatggatctcgatgacggcgtaatgatcaacagcgccaccctctggacattgctcgaaccccaatggaacaagcccaaaacatggtggtcagaactcagcaccgcccaaaacaaaaaagactatgactggtcacacctcgccgcccgctatttccccagccgcgtcgatgaaaaatgccaaaaagacccatccctagccgtcgcccacagtctcttctggaaatatcaccccgccaaagcctacgagtgggaactgcgtttgcaggatgaaatatctcccgatttccacatcgaagaacccgattctcaatctctacgcgatgcgtttatcaaagacaatcctgagctagttttagacttacgacaaaaggaacaaaaacgcagggaacgcaaaaagaataaagaagaagatcttttactccttgaattggaagaagaaaccgtgccgcaggggtag

SEQ ID NO: 6190 - protein, 1296 aa, Bacteroides xylanisolvens; identical to SEQ ID NO: 3224

SEQ ID NO: 6191 - DNA, 3891 bp, Bacteroides xylanisolvens; identical to SEQ ID NO: 2709

SEQ ID NO: 6192 - protein, 627 aa, Bifidobacterium angulatum
MNTSKLQAFATDARRQLMNAVRARLDAALVPNSDAQVDDPRAFDFLQREIERAGGSEQGRKHVVERYAYRWFNRIIAFRYMDVHGFTGTPVVSPVGLTSTNGLPEVLAAAKRGEYDSRVFSLRVNDKAKERIEGLLSGSILADDPQGRAYGLLLQSECRFWNRNLPFMFENVGKEAGRVDELLMPADLLAEGSVLRNAVEVMTPEDCGVDDPSGNVEIIGWLYQYYISERKNEVMDGFKKNHKAGANEIPAATQLFTPDWIVRYLVQNTVGRLWMQSHPDSQLHKNWDYYIWPSENDSVGNEDILAIRTPEDLTVCDPACGSGHMLTYAFDLLYEIYEEEGYAPSDIPSLILKHNLYGMEIDERAASLAAFALTMKARSRSRRFFKKQVEPNIQRIAPITFKEDDVAELNDLYQVNLDSMVWNTYAKADVYGSLIQPPQELVELAASAQKNADDIGTLFDPLLREHAEEVFAQTRYLACKYAAVVANPPYMGAKNMSGELKQFVQDHYEDGKADLFAVFIMRNRQFLRHNAMLGMITMQSWMFLSSFEALRRDILQKCTITTMAHLGTRAFGSIGGEVVSTTAFVLLNSFVSHYLGTFIQLVNGESEKEKERMLRTAALQESGNQNE

SEQ ID NO: 6193 - DNA, 1884 bp, Bifidobacterium angulatum
atgaacacgtcgaaactgcaagccttcgcaacggatgcgcgccgacagctcatgaacgcggtgagggcccggcttgacgccgcattggtgccgaattccgacgcccaggttgacgacccgcgtgcgttcgattttctgcagcgtgagatcgagcgtgccggtggaagtgagcagggccgcaagcatgtggtggaacgttatgcgtaccgatggttcaaccgcatcatcgcgttccgttacatggatgtgcacgggttcaccggcacgccggtggtctctccagtcggtttgaccagcacgaatggtctgccggaagtgcttgcagcggcgaaacgaggcgagtatgacagcagggtgttctcgttgcgggtgaatgataaggccaaagagcgcattgaaggattgctgagtggttccattctggcggatgatccgcagggccgcgcgtatggtctgctgctgcaatccgaatgccggttctggaatcgtaacctgccgttcatgttcgaaaacgtcggcaaggaggccggcagagtggatgaactgctcatgccagccgatctgctcgccgagggttccgtgttgaggaatgcggtggaggtcatgaccccggaggattgcggtgttgacgatccgtccggcaatgtggagatcatcggctggctgtaccagtactacatttcggaacgcaagaacgaggtgatggacgggttcaagaagaaccacaaagccggagccaatgagattcccgccgccacccagctgttcacgccggattggatcgtgcgctacctcgtgcagaacaccgtgggcaggttgtggatgcagtcgcatccggatagccagctgcacaaaaactgggattattacatctggccttcagagaatgattccgtcgggaacgaggatattctcgcaatccggactccggaagacctgaccgtatgcgatcctgcatgcggttccggccacatgcttacctacgcgttcgacctgctgtatgagatctacgaggaggaggggtatgcgccgagcgatattcccagcctgattctcaaacacaacctgtacggcatggaaatcgacgagcgagccgcaagccttgccgccttcgctctgaccatgaaggcacgctcccgttcccgtagattcttcaagaagcaggtggagccgaatattcagcgcattgcgccgattacgttcaaggaagacgacgtcgccgagctgaatgacctataccaggtgaatctggattccatggtatggaacacctatgcgaaggcggacgtgtatggttcgttgattcagccgccgcaggagcttgttgaattggcggcgtcagcgcagaaaaatgctgatgacattggcacgctgttcgacccgcttctgcgtgaacatgcggaggaggttttcgctcaaacaaggtatcttgcctgcaaatacgcggcagtggtggcgaacccgccatacatgggcgcaaagaacatgagcggcgagctcaaacagttcgtacaggaccattatgaggatggtaaggctgacctcttcgccgtattcatcatgcgtaaccggcaattcctgcggcataacgcgatgttaggcatgattacgatgcaatcgtggatgtttctttcctcgtttgaagcgttaagaagggatattctccaaaagtgcactataactactatggctcatcttggaacaagagcatttggtagcattggtggagaagtagtatccacgacggcatttgtattgttaaattcgtttgtctcccattatctcggcacgttcattcaactcgtgaatggcgaatccgagaaagagaaagagcgtatgctcagaactgctgctcttcaggaaagtggtaatcaaaatgagtga

SEQ ID NO: 6194 - protein, 887 aa, Bacteroides coprophilus
MTEQLDKPMQRLLVKIWDKMKYAGEAGMLIKMEQEIEAEIEDLRKNWSKINVVQTASLFDSDTKKDEIYAEGLKIVAMNKQEAKENFFATVVEKLQEALYTVSSRLSEEEGYENTLFANDAVRGFAFIELCQKRYDVILMNPPFGEGSESTIGYLDSHYSCWCKNLVCAFFDRMQELLVNDGLVGAIFDRTVLIKSSYEPFRKKNICGYISACADTGWNVLDASVETSTLVLSKTPSESREGVFFDVLDDEPACKAEIIKQSIETLIYGKNNRNTFIRNSAEFATLPNSINGYYFDNKILEAFERESIENRGFYAMQGIGFVSSSHFRIFYELRNQVNYKHMYNGSSYSLFYTTYCDMTNWENDGVYVKAHKSYRSSNLSSQFIPGVCYGERGDILDMHFLKSNMFFTKEGLSIVNLKWNEALVLNSMFNSIYGQYFLNLYSGQHKWTGYTNLLPMPDYATRQSDIERIITEIIDIKRWWFSLDETNLEYHGLIAQVMHGHHLAESLDQLQEKLTADYSRYQKLVKENDDLWMDLAEIEADSDFRATLNAYKSRRPYEELLSIDGAGNGNVINKQVMAQEIVMELVGMAFGRWNIRYATQPETIPPFGDVFDALPFMPVVSLQSEEAQLYPLTLPTDGILMGDDSHPDSLVKRVQEVMHSLWKNDADEMESELCQLIGVDSLQTYLESPNGFFDYHFKRYTKSRRKAPIYWPVSSPEGEITLWVYYPQLSSQTLPHLLLLLSKEHTAAQSDLTAAQLANDKKREAALLNLMGDIRTLEAELQQLNDLPYKPNHDDGVPVTAAPLRNVFRHNAWKKECLNNWEDLQKGEYDWSHLAYALYPARIREKAKKDWCMALTHGLEELCENKPKEKKPRKKRSEEPTMQLFDE

SEQ ID NO: 6195 - DNA, 2664 bp, Bacteroides coprophilus
ttgaccgaacaattggacaaacccatgcaacgcttactggtaaagatatgggataagatgaagtatgccggcgaggcgggtatgctcatcaagatggagcaggaaatagaggccgaaattgaagatttacgcaagaattggagcaaaatcaatgtggttcagacagccagtttgtttgattctgatacaaagaaagatgaaatctatgctgaaggattaaaaatagtggcaatgaacaagcaggaagcaaaagagaatttctttgctacggttgtggagaagctacaagaggcattgtacacggtttcctctcgtttgtcggaagaagaaggctacgaaaacaccctgtttgccaatgatgcggtacgcgggtttgctttcattgaattgtgccagaaacgatacgatgttattctgatgaatccgccttttggtgaaggttcggaaagcacgattggctatttagattctcattattcctgttggtgcaaaaatcttgtttgcgctttcttcgatcgcatgcaggaattattggttaatgacggactagttggggctatctttgaccgtactgtgctcatcaaatcctcttacgaacctttccgaaagaagaatatttgcggttatatttcagcttgtgcagatacggggtggaatgttttagacgctagtgtagaaacttcaacactggtattatctaaaactccttctgaaagtagagaaggggtattcttcgatgtgcttgatgatgagcctgcatgtaaagctgaaataatcaagcaatcaattgagacattaatctacggaaaaaataaccgcaatacattcattcgtaattcagctgaatttgcgacactccctaattccataaatggatattattttgataataaaatacttgaagcgtttgaaagggaatctatagaaaatagaggattctatgcaatgcagggaattggttttgtttcctcaagccattttcggattttctatgagttaagaaatcaagtaaactataagcacatgtacaatggcagctcctatagtttattttacacaacttattgcgacatgaccaattgggaaaatgatggagtttatgtaaaagctcataaatcttacagaagttccaatctaagcagccaatttatccctggtgtatgttatggagaacgaggagatattctagacatgcatttccttaaatcaaacatgttttttacaaaggaaggattatcaattgtaaatttaaaatggaatgaagcgctggttttaaattcaatgtttaattcaatatatggacagtatttcttaaatttatattcaggtcaacataaatggacaggttataccaatctcctccccatgcccgactatgccacccgccaatctgacatcgaacgcatcatcaccgaaatcattgacatcaaacgctggtggttcagtttagatgaaaccaacctggaatatcatggtctgattgcacaagtgatgcacggtcaccatttggcagaaagtttggatcaactgcaagaaaagcttactgccgattacagccgctaccaaaaattagtgaaggagaacgatgatttatggatggacttggcagagattgaagcagacagtgactttagagccacgctcaatgcctataagagtcgccgtccttatgaagaactactctccattgatggtgccggcaatggaaacgtgatcaacaaacaagtgatggcacaagaaatcgtcatggagttggttggcatggctttcggcagatggaatatccgctatgcaacccagcccgaaaccattcctccctttggcgatgtattcgacgctttaccctttatgcctgtagtatcactccagtctgaagaagcacagctatatccgcttacattacccactgacggcatactgatgggagacgacagccaccccgacagtctggtgaagcgcgtacaggaagtgatgcacagcctctggaaaaatgatgcagacgaaatggaaagcgaactctgccagctgataggtgtggacagtttgcagacctatctggaatcgcccaatggtttcttcgattaccattttaagcgctataccaagagccgcagaaaagcacccatctattggccggtttcttcacccgaaggagaaattaccctttgggtgtattatccgcaactgagcagtcaaacactgcctcacctgctcttgttgttgagcaaagaacacaccgctgcacaaagtgatttgactgcagcccaactggcaaacgacaagaaacgtgaggctgccttgctcaacctgatgggcgatatacgcacgttggaggcagaactccaacaattgaatgacctgccctataaacccaatcatgacgatggtgtcccggtaacagccgctccgttgcgcaatgtattccgccacaacgcatggaaaaaggaatgcctgaacaattgggaggatttacaaaaaggtgaatacgactggagccacttggcttatgccctctatccggcacgcatccgagaaaaagcgaaaaaggactggtgcatggccttgacccatggtcttgaggaattgtgcgaaaacaagcccaaggaaaagaaaccaagaaaaaaacgcagcgaagaaccaacgatgcaattgtttgacgaataa

SEQ ID NO: 6196 - protein, 1237 aa, Bacteroides sp.
MLRERLKHLQAALPETEEDKDRLAVGQLIAEQAFTQLNRFCALRMCEERDLILESIRGGYDAVGFQSYDAIAQTIGVSKYNRYRWYLHSIFDELSIELPAVFDRYSPYGLVFPDESTLLKLIELINDSQLSDWYDEQNGTTVNFWKEDETLGWMFQYYNSLEERRKMRDESNKPRNSREMAVRNQFFTPEYVVRFLTDNSLGRIWYEMTGGQSRIGEEQCQYMVRRPNEEMKERAIKEPTEILSLDPTCGSMHFGLYLYEVYEYIYTDAWDNYPELLHKYRELHTRESFLREVPRLILTHNIYGCEIDPRALQIAALSLWLRAQRSYGEMGIDATERPLITKSNLVLAEAMPGNKRLLKGLMEELDAPMQRLITKIWDKMKFVGEAGLLFKMEKEIEEDIEYLRKNWSKVNQSRNADLFATEEERARIDAENEARKLLRQNKSAFFEEITDRLKEALEQLSAKLSEEEGYENALFSEDATRGFAFIELCQKRFDCIVMNPPFGEGSENTSSYLDNNYPAWCRNLVCAFFDRMQEMLDADGRLGAIFDRTVMIKSSYEDFRKRNLCGYITNCADIGWGVLDASVETSTLVLNKHSSDVEGVFMDILDVNAEEKNAQLIALIHAMCDGDEVKWSYIASSKDFANLPNAIIGYYFDVNILSVFKMQNMEERNLVSKKGHDLAANIYPRLYYEITNTLGFSLMYNGGAFSMFYFPYNDVVFWNEEIIRNNSLCNLRSLHLQKLGTVGYGKRGDILDAHVLKKGFIFTREGIGVPNLSISDGYSALAYLNSIVAQYTINLYCAQHKGNGYVNILPMPDYDKSLSDIESIVNSIIDIKRHWFSLDETNLEYHGLIAQMSISDSIEDSINRMQEGITADYQHYQELVKENDNLWMDLANIDRESEFRQTLNEYKNRRPYEELLSIDNASNQNIIDKKVIAQEIVQELVGMAFGRWDTAYAQKVKQIPEFGDVFDALPFMPTVSLSEIPSDYALQIPEDGILNNQADSPDSLVNRVRDVMQHIWGKHADELEYELCQLIGCKNLQVYFEAPTGFFDYHFKRYTKSRRKAPIYWPLSSEDGSYTYWVYYPKLSRNTLPSLLIKLRSEDEQLRSGINAAMAGHDKAQESSLRAKQAQVEGMMEEINQILASGYEPNHDDGVPVTSAPMLKLVAHRGWNNECKDNLEKLTKGEYDWSHLAMSMFPARVTQKAKKDWCLALTHGLEHLCENKPKEKKARKKKDNNQTLF

SEQ ID NO: 6197 - DNA, 3714 bp, Bacteroides sp.
atgcttcgtgaacgtctgaagcacttgcaagctgcgcttccggaaacagaagaagacaaagatagattggctgttggtcaattgatagccgagcaggcatttacccagctcaaccgattctgtgcacttcgcatgtgcgaggaacgtgacctaatattggaaagcatacgtggtggttatgatgcggtaggattccaaagctatgatgccattgctcagacgataggtgtatctaaatacaacagatacagatggtaccttcatagtatcttcgatgaactgagcattgaattgccagccgtgttcgaccgttattcgccctacggattagtgtttcccgatgaaagcactttgttgaaattgatagagttgattaacgacagccaactatccgattggtatgacgaacagaacggaaccactgtcaacttctggaaggaagacgaaacattggggtggatgttccaatactacaattcattggaagaacgtcgcaagatgcgtgatgagagcaacaaacctcgcaatagtcgtgaaatggcggtacgcaaccaattctttacaccggaatatgtggtgcgtttcctaaccgacaactctttaggacgcatttggtatgaaatgacaggcggacaaagccgtattggcgaagaacaatgccaatatatggtgcgccgtcccaatgaagaaatgaaggaacgtgccatcaaggaaccgacagaaatactttcacttgaccctacgtgtggtagtatgcatttcggactttatctttatgaggtttatgaatatatctataccgacgcatgggataattaccctgagctattgcataaatatagagagttacatacccgtgagagtttcttgcgagaagtgcctcgtctgattctgacccacaacatttatggttgtgagattgatccacgtgcccttcagatagctgcacttagtctttggctccgcgcccagcgcagttatggtgaaatgggaattgatgccaccgaacgaccactcattaccaaaagtaatctcgtgttggctgaagcaatgcctggcaacaaacgtttgctaaaggggttgatggaagagttggatgcacctatgcagcgtcttatcaccaagatatgggataagatgaagttcgtgggtgaagctggtttgcttttcaaaatggagaaggaaatagaagaggacatcgagtatttgcgtaagaactggagcaaagtaaaccaaagtcgcaatgccgacctctttgccaccgaagaagaacgagcacgtatcgatgcggagaatgaagctcgcaaattgcttcgtcagaacaaatcggcattcttcgaagagataaccgaccgtcttaaagaggcattggaacaattgtcagctaaattgagtgaagaagaaggttacgaaaatgcgctctttagcgaagacgccacccgtggtttcgcatttattgagctttgccaaaagcggttcgattgtattgtgatgaatccaccgtttggtgaaggtagtgagaacaccagtagttatctggataataactatccggcttggtgtcgcaatttggtttgtgcattctttgaccgtatgcaggaaatgcttgatgcagatgggcgattgggagcaatctttgaccgcaccgtaatgataaagtcaagctatgaggatttccgtaaacgtaatctttgtggatacatcaccaactgtgcagatatcggctggggagtgcttgatgcgagtgtagaaacatctactttagttctcaataaacactcttcagatgttgaaggagtatttatggatattcttgatgttaatgcagaagaaaagaatgcccaacttattgctttgattcatgcaatgtgtgatggagatgaagttaagtggagctatatagcatcatctaaagattttgcgaacttgccgaacgctataataggttattatttcgatgtaaacatattaagtgttttcaaaatgcaaaatatggaagaacggaatctggtttctaaaaaaggtcatgatttggctgcaaatatttaccctagattatactacgaaataacaaatacccttggattctctttaatgtataatggaggtgctttttctatgttttattttccttataacgatgttgtattttggaatgaagagattataagaaataattctctttgtaatcttagaagtcttcatctccaaaaacttggaactgtcggatatggaaagagaggtgacatattagatgcacatgttttaaaaaaaggattcatttttacacgtgaaggtattggcgttcccaatttatcaatatctgatggttatagtgctcttgcttatttaaattcgatagtagcacaatatacaattaatttatattgtgcacaacataagggtaatggatatgtgaatatacttcctatgcccgattacgacaaaagtctgtctgatattgaaagtatagttaattccatcattgatattaaacgccattggtttagccttgatgaaaccaatttggaatatcatggacttattgcacagatgagtatcagcgatagtattgaagatagcatcaatcgaatgcaagaaggcatcactgctgattatcaacactatcaagagcttgtgaaagagaatgataacctctggatggatttagcaaacatagaccgcgaaagtgaattccgccagacattaaatgaatataagaaccgtcgtccatacgaggaattgctctctattgataatgccagcaaccagaacatcatcgacaaaaaggtgatagcacaagagattgtacaagaattggtgggtatggcatttggcagatgggacacagcatacgcccaaaaagtaaagcagatacctgagttcggtgatgtgtttgacgcattgccttttatgccaaccgtaagcctaagcgaaataccttcggattatgcgttgcaaatccctgaagacggcattttgaataaccaagcagatagtcctgatagtcttgtcaatcgtgttcgcgatgtgatgcaacatatttggggaaagcatgccgacgaactggaatacgaattgtgccaattgataggatgcaagaacctgcaagtctattttgaagcaccaaccggtttcttcgactaccatttcaaacgatacaccaaaagtcgtcgcaaggctcctatctattggccgttatcaagtgaagatggttcatatacttattgggtatattatccaaagttgtcaagaaatacactaccttcgctcttgattaagctccgcagtgaggatgaacaattgcgtagtggcatcaatgcagcaatggcaggtcatgacaaggcgcaagaatcctcccttcgggccaaacaagcgcaggtggaaggcatgatggaagaaatcaaccagattcttgcatccggttacgagccaaatcatgatgatggagtgcccgtaacatcagcaccaatgcttaagctggtagcacaccgaggatggaacaacgaatgtaaggacaatttggaaaaactcacaaaaggagaatacgactggagccaccttgccatgagtatgtttccagcccgtgtcacccaaaaagccaagaaagactggtgtcttgcccttactcacggtttggaacatctttgtgaaaacaagcctaaggaaaagaaagcgagaaagaaaaaagataataatcaaactttattttaa

SEQ ID NO: 6198 - protein, 390 aa, Cylindrospermopsis raciborskii
MNSTTASLSPTLNFEVGQISNFPILNNTFDKITINSLENIEQAINIAREDWDNFETSWDFQTHPLLRENSPNISTSFTNWQNRTETAFRQLQLLEQENNRYWIKSYGLETELTPEVPLNEITLTCNPHYRYDHTKPQTELETLLLADTIKEYISYAVGCMFGRYSLDQPGLILANQGETLPDYLKQIPNPTFTPTKNNVIPILDGQWFTDDMSDRFRQFLRLTFGEEHYEENLKFIEKALGKDIRKYFLKDFYNDHIKRYKKRPIYWLFSSPKSNFNALIYLHRYRPDTVSIVLNDYLREFRAKLEARQNHLKRVEVSADASQSEKTKAVKEINKLATIIEELNDYEREILYPLAIEQIHIDLDDGVKVNYPKFGLALKKIPGLETKEED

SEQ ID NO: 6199 - DNA, 1173 bp, Cylindrospermopsis raciborskii
atgaatagtacaaccgcctccctttctcccacattaaattttgaagttggacaaatatcaaactttcccatacttaataatacttttgataaaattacaattaacagtcttgaaaatatagaacaagcgattaacattgctcgagaagactgggataactttgaaacttcctgggacttccaaacccaccccttgctgcgagaaaactcccccaatatatccacatccttcaccaattggcaaaaccgcacagaaaccgcatttcgacaactccaactgctagaacaagaaaataaccgatactggataaaatcctacggactagaaacagaactcacccccgaagttcccctgaacgaaatcaccctcacctgtaacccccactaccgctacgaccacaccaaaccccaaaccgaactagaaacccttctcctcgccgacaccattaaagaatacatctcctacgcagtagggtgcatgtttggacgctactccctcgaccaaccaggactcatcctcgccaaccaaggagaaaccctcccagactacctcaaacaaatccccaatcccacctttacccccacaaaaaacaacgttatccccattctcgatggccaatggttcaccgacgatatgagcgatcgcttccgccaattcctgcgccttaccttcggtgaagaacactacgaagaaaacctaaaattcatcgaaaaagccctaggcaaagatatccgcaaatacttcctcaaagacttctacaacgaccacatcaaacgctacaaaaaacgccccatctactggcttttctcctcccccaaaagcaacttcaacgccctcatctacctacaccgctatcgcccagatacagtcagtatagtgctaaacgattacctgcgggaattccgagccaaactagaagcccgtcaaaatcacctcaaacgagttgaagtaagtgctgatgcctcccagtcagagaaaaccaaagcagtcaaagaaatcaacaaacttgctaccataatcgaagagctcaatgactacgaacgagagatcctctatcccctggccatagagcaaatccacattgacctggatgacggtgtcaaggtaaattacccaaaatttgggttagctttaaagaaaatcccgggattggagacaaaggaggaggactaa

SEQ ID NO: 6200 - protein, 633 aa, Thiorhodovibrio sp.
MAFDKATRNALQKFVSRARRLLSEEFTRQLQATYGMDPKTGTVADMAALGHLDNQQFQTATTLRETLHHYLAVTPGKNDQNRLQQVLERMVREQAFTLLNRLAALRMAEARAVVLESLAQGQASQGFQLYQMVAGAALGEVGATYRQYLFSLFDEFSQDLAVLFDRHSPQGLLFPKDSVLLELLDAINHPDIAWLWAEDETIGWIYQYYNDPDERKNMRAESAAPRNSRELAVRNQFFTPRYVVEFLTDNTLGRLWFNATGGKTRLRDACRYLLVKPDEPPKPATKPRDPRSLKWLDPACGSMHFGLYAFDLFVEIYREAWDWEQAHGPGSLDSSTAPAAALKPLSQTYADEAAFQHDIPRLIIEHNLYGVDIDPRAAQIASLALWLRAQRAWHEAGIKANDRPLIGRGQVLAAIAPPAEPELRAQLAGQLDHLDAELFEHTLQLLEGLPELGVLLRAERALPALIRAVYGEHGPMFRDADLAQWQQAEERLRCALTDLAQAAQSSYQGRLFAQDALAGLRLIDLCRQTFDVVVMNPPFGALAAGTKERLGKAYPRSKNDLLAVMVERGLELLRPGGRLGAITSRTCFFLSSFQKWREAVVLGLAEPEVMADLGHGVMDDAMVEAAAYCLVKT

SEQ ID NO: 6201 - DNA, 1902 bp, Thiorhodovibrio sp.
atggccttcgacaaagccacccgcaacgcgctgcagaaattcgtctcccgtgcacgccgtttgctcagtgaagaattcacccgccaattgcaggccacctacggcatggaccccaagaccgggactgtggccgacatggccgccttgggtcacctcgacaaccagcagttccaaacggccaccaccctgcgcgagaccctgcaccactacctggcggtcacccccggcaagaacgaccagaaccgcctccaacaggtgctggagcgaatggttcgcgaacaagcctttaccctgctcaaccgcctcgccgccctgcgcatggccgaagcgcgcgccgtcgtgctcgaatccctcgcccaggggcaagcctcccaaggctttcagttgtatcaaatggtggccggtgccgccttgggcgaggtcggtgcgacctatcgccagtatctgttcagcctgttcgatgagttcagccaggatctcgccgtcctcttcgaccgccacagcccgcaaggtctgctgtttcccaaggactcggtcttgctcgaactgctcgacgccatcaatcatccggacatcgcctggctgtgggccgaagacgaaaccatcggttggatctaccagtattacaacgacccggacgagcgcaagaacatgcgcgccgagtcggctgcgccacgcaactcccgcgaactggcagtgcgcaaccagttttttaccccgcgctatgtggttgagtttctcaccgacaacaccctcggccgactgtggttcaacgccaccggcggcaagacccgtctgcgcgacgcgtgccgctacctgctggtcaagcccgatgaaccacccaagcccgccaccaaaccgcgcgacccgcgcagcttgaaatggctcgatccggcctgcggttctatgcacttcggtctctatgccttcgatctgtttgtcgagatctaccgcgaagcctgggactgggaacaagcacacggccccggctcactggacagttccaccgcgcccgctgctgcgctcaagccgctgagccaaacctatgccgatgaagccgcctttcagcatgacatcccgcgcctgatcatcgagcataacctctatggtgtggacatcgacccgcgcgccgcgcagatcgcctcgctggcgctgtggctgcgcgcgcagcgcgcctggcacgaagccggcatcaaagccaacgaccgcccgctgatcggtcgcggccaagtgctcgccgccatcgcgccgccggcggaacccgagttgcgcgcgcaactggccgggcaactggatcacctggacgccgagctgttcgagcacaccctgcaactgcttgagggactgcccgagctgggcgtgctgctccgggccgagcgcgccttgccggcgttgatccgcgccgtttatggcgagcatggcccgatgtttcgcgacgccgacctggcccagtggcaacaagccgaggagcgtctgcgctgcgccctgacggacttggcccaagccgcgcaatccagctatcaagggcggctatttgcccaggatgccctggccggcttgcgcctgatcgacctgtgccgccaaacgttcgacgtggtggtgatgaatccgcccttcggcgcgctcgccgccggcaccaaggagcggttgggcaaggcctatccgcgcagcaagaacgacttgctcgcggtcatggtcgaacgtggactggagctgctgcgccccggcggtcggctcggggccatcacctcgcgcacctgtttctttctctccagctttcagaagtggcgcgaggctgtggtgctggggctggccgagccggaggtcatggccgatctgggccatggcgtgatggatgacgccatggtggaagcagcggcctattgtttagtcaaaacctga

SEQ ID NO: 6202 - protein, 682 aa, Methanobrevibacter smithii; identical to SEQ ID NO: 6165

SEQ ID NO: 6203 - DNA, 2049 bp, Methanobrevibacter smithii; identical to SEQ ID NO: 6166

SEQ ID NO: 6204 - protein, 849 aa, Actinomyces sp.
MSGIDASRLAEELNALLEHGRIVTWLDRNGEYAEDLDAVRELLDGATLITINANLFETKLRIFAEDTKSRYVLYCGGELPPLEEDLLADVRCGYPTFKADASTLLVRELGVDPGLAAVIDEYAPFFNSTARVADLKKHLGAISDADKRSDRRTFLAAMSAVLLKTQQRSFSVLFAKLASMTQDNPLDALKWGLDAYFWEGAHAIWGYDGEHSFDALMTWLFVMNANGWDHRHNSAQRDFSMWTRDVATRDDARRWARRVDEATGASAALRDAATDALLIDTTTPGVDRELISRLVRGIIDGSVGVAQVEEQRGRRREGLWFDDTEALWDAARAGARLLTHLRALPGIAFSDAAEGFARYTNPDSGLWAIDQEYRHYVRASRAVHVDDVLTDLDRHVENAYCDDYLRPLSRTWDDALRGMRTWDIAVPSSSGRIDSFHRLLVAGSHRRTVVIISDALRYEAGVELADHLRSLGRGAIALNPWYTMLPSITALGMAALLPHRELTLNVRGKDQVVVEADGRPTSGIDARRTILEGADGRAFTYQELASDSVKSMRSKFKGASAVYIYHDVIDAIGDHAASESDTPDAVNRAIAELSGLVGKLISADITRILVTADHGFLFQDSEPANDDTAKQDGVPRGRSVSVKKRRYVLGKDLGSTDDFVAFDATSVGLTDGPSIALPYGTRRIRTQGRGNRFVHGGASLQEITTPVIEVSVGSRGAEDVRDVGIALHYDDMSLKVNRFSPRVIQREPISPTRRPLTVTIGLESMLGEQLSSTRVLTLDAAERSEVSLKQSSELILFDGVLQRHSGEAVRIVAYKTVHGQVVGEAVATHELTLNDNGFGGFGGFGGFDL

SEQ ID NO: 6205 - DNA, 2550 bp, Actinomyces sp.; identical to SEQ ID NO: 1367

SEQ ID NO: 6206 - protein, 182 aa, Vibrio cholerae; identical to SEQ ID NO: 5680

SEQ ID NO: 6207 - DNA, 549 bp, Vibrio cholerae; identical to SEQ ID NO: 5528

SEQ ID NO: 6208 - protein, 182 aa, Glaciecola polaris; identical to SEQ ID NO: 5680

SEQ ID NO: 6209 - DNA, 549 bp, Glaciecola polaris
atgccctttatagctgatcacaaacaaaagtttgctgacctagactttaatattgaaaaccaagatcagcttcgtcggcaagccaatggtggtaacagtatattgttttcctattgtccaggtgaggaaaatttatacattgacaaagcgagagatatttatgaagagaaagcggaattcatagatatcagtcaattacttgtcagatttatagattccgatggctgggatgctttctccgagtactacagagatttcattaacactccacatgttgttttcaaatctgacgatccagaacaagacctttttgacatgattatttcagccattaaacaggcttgtgaaaaggataagattccatttcttattcgaagtggttgcttgtatggcacgggtatagagaatgtgaacataatggagcacaaagatgttatgcagctaaagcatccacttgtcattttctatccatcgaaaatatcagaagacaacattttattcttgaattttagaccagcatcaaagtatcgctgtacgttagtgaaatag

SEQ ID NO: 6210 - DNA, 23239 bp, Artificial Sequence
  Bacillus cereus_PYZA_with pglX deletion
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaggtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttggcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgggggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagtttgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaggcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcctcaactggtgcctggagaaatgctctttctatttgggaacctgtctgcaatgaaattttcgatcgcctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggccaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgctacaggccagaaagcataactggcctgaatattctctctgggcccactgttccacttgtatcgtcggactgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcagtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacggcctcctcacccggtcacgtgagctcatttaacccactccacaaaaaggctcaacaggttggtggttctcaccaccaaaagcaccacaccccacgcaaaaacaagtttttgctgatttttctttataaatagagtgttatgaaaaattagtttctcttactctctttatgatatttaaaaaagcggtgtcggcgcggctacaacaacgcgccgacaccgttttgtaggggtggtactgactatttttataaaaaacattattttatattaggggtgctgctagcggcgcggtgtgtttttttataggataccgctaggggcgctgctagcggtgcgtccctgtttgcattatgaattagttacgctagggataacagggtaatatagaacccgaacgaccgagcgcagcggcggccgcgctgataccgccgccccgggtgcctgcatgagctgatttgggaatggcaaaccggcaacctgatggcggagatcgctgttgtcatcagtaaccatgaggaagcgagagagctggttgagcgcctgaacattccattccactatatgaaagcgaacaaagacatcagagcggaagtcgaaaagaagcagcttgaactgctggagcagtacgatgttgatgtgatcgtgctcgcacgctatatgcagattctaactcctgattttgtttcggctcatccgaatcgcatcatcaatatccaccattcattcctgccagcttttatcggtgcgaatccgtacaaacgggcctacgagcgcggcgtgaaactgatcggtgcgacatctcattatgtgacaaacgatcttgatgaagggccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgcaagaggcccgcgcaatgcgggctatttttgatgacaaaaaaccttgacaagtgtcttttttctttgcataatataaaaaaatcattgagcgttgaagaggattagtaagcagacctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacgaatagcaaaggaagcattgatgaggcaaaaatcagagagcatgttcaggcgatttccgtgttaaaaaaagcggggcatgaaatgattctgattacctcgggtgccgtagcggcggggttttccagcctcggttatccatcccgtcccgttaccatcaaaggaaaacaggcggcgtagatctggagctgtaatataaaaaccttcttcaactaacggggcaggttagtgacattagaaaaccgactgtaaaaagtacagtcggcattatctcatattataaaagccagtcattaggcctatctgacaattcctgaatagagttcataaacaatcctgcatgataaccatcacaaacagaatgatgtacctgtaaagatagcggtaaatatattgaattacctttattaatgaattttcctgctgtaataatgggtagaaggtaattactattattattgatatttaagttaaacccagtaaatgaagtccatggaataatagaaagagaaaaagcattttcaggtataggtgttttgggaaacaatttccccgaaccattatatttctctacatcagaaaggtataaatcataaaactctttgaagtcattctttacaggagtccaaataccagagaatgttttagatacaccatcaaaaattgtataaagtggctctaacttatcccaataacctaactctccgtcgctattgtaaccagttctaaaagctgtatttgagtttatcacccttgtcactaagaaaataaatgcagggtaaaatttatatccttcttgttttatgtttcggtataaaacactaatatcaatttctgtggttatactaaaagtcgtttgttggttcaaataatgattaaatatctcttttctcttccaattgtctaaatcaattttattaaagttcatttgatatgcctcctaaatttttatctaaagtgaatttaggaggcttacttgtctgctttcttcattagaatcaatccttttttaaaagtcaatattactggtttttcgcctctaaatactcatccattactcttaaaaaaccttcacgcaaattactactcatattaccgcccttttctccattatctcttgtatattttttaacatttcatcatcattaaaggtataccattctcaccctcacaaacagttacaattgcaattacaattacaattacaattacaattacaattactaccattttatcaaactatatatacgcataaaagaaaaatcatacgtcattccgtatgatttaataattcctattctcctgactactttcctcaagatctccctttccccaaaactctcctaatcttgcttcctcaacattctcttccaaatatcactctcagccgtcttcttaataatatcatcctggcaaatacctcttctttcgtcaggtctttcagtgtgaggttttaaaaagcaacatcaactccttattcttcccacgtcggaatgacactatttggtaccctttttcctctaaaagccccttacacatgttatagatggtaacaataagcatttctataacatctaatataactacttattcacaaaataaatatctatttcattgttactatttaataatataaaaggcaaatggaatttccccatttgccttttatattattctacccctaaagctttaaacaccgcatcttctgcactttgataaaaacctatttgaaatttagcaaacaattcgggtggtacagttggtatatctacagccgataccatcggtaaaagtatttttttcgcccctgaatcaaaacaaacttgtaatacattggctaattcttctactttattaattgttccacttatactaatagatcctaatacaaccatttgactttgtactggtttattcaatgcacctgaacataatgcgataaatgctgcaagcgataactcaccagttaatccaactccatgaatatcttgaatatgcattaagtagtcttttgttgttgtactaatagtaccacttatatttttattatttgctttaaagaatcgaaaggcggtatctatactttctttagcatctcgatctgaatttaatcccgttttttcaaacttaccattaccactcacaacttctgtttccaatttataagtaccaatcattccagtctttccacgagcaactgtataaatatgccctggtttgttcatcccctctgggattaaagttcctccaccttgttctggaaccgatacaaactcttcattcattgattcattatcaatataagagaaattgacatcataaaactccatgccaccaattttctttaattgttccttcacacgtctgcgccctattagagcgtaacgtagtacttcttccacatcttcttttatatattcaccgttcggatataacaacttaatcaaacccgaaacagttttacgcactgcgattacatctcgttgatttaaattatttcctaatctaaaatatttatcgatcgcatctgagaaagaacgttttcgcatttcccttaaaaactctgctaaataatctgttatgaagccatattcatttgtgaaaaactcgggtctcattttaggaatttcccacccaggtaaatagtaatgcattcgatcgaaaaatgccgaatcatatgccattgcttctgggaacgggtcaaacaagtgtgaggttttcaataatacatctacactttgattaatatttcctacaaaaaccatagaagcgctagcatttttttcttcacggcctcgggcaaaagaacctgaagccatataatctttcataatctggataccatctttatctttaaatgtaattcctgcaacttcatcaaatgctaccgtatcccacatgccaactaatcctatttttctagtcgacatattataaaataaattcgcaaccgttgtttgaccacccgatactagaatcgaattaggtgaaatctctttatagatatgtgatttccctgtccccctcggcccaagttcacataaattgtaattattctctacgagtggtaccattctttcaagcaaatgccactttactgtgtcttctaattgagttggttccataccagttgaacgaataagaacatcgatccattcttctttggaaaattgccttctttgttcaaacatctcttctaaatccatattaggcatttgaattggtgtaacgctctcaatgctaaatggacttgtaccttttgattcttcatcaaaataatattccatttttacaatgcaccatataccacctgcaaggagcttatcaaattcttttacataatgtgaagaaatcggaaccccatttagtccaagattagaaaactctgcttcatatatgtcttttttatcatttaattttacgccaattttatcaatgaccgtatacttgccaagctccttaactttcgactttactttctctgcttcatctgggcgtacgaaattatccgataaaatctttttgaccatttgtacgccatcattcatactcttttcatcgtccgttgcacaatacataccaagcaagtactcaagtacatatactggtacattcgcaccttctttaattttttttgttaaatctttacgtactacttttcctgcaaaatgtgcgtttaactttatatttaaatcctccatctccactcaaccccacatttcttttagaaaccaaaatcatttgtaatggctatatcaatcggaaatgctactttctcataaatattttcaacagcctcttcttcatcctctaacactaaataatatttcttcgttttatcataagtcatgctctttagcacaaacttttctttaaacgtacgatcctctggcttagaagactgactatctgcgataataatattttcattagaaattcgatttccctcttcatcagtgaaataaacctttaagcgcaatggtgttttcttaccttcaattttttccgtttggaagaactccagatatgtaatactgtttgtaatctttcttgttaaacttgttaatttcacttcaacctttctcacatcattcttactagacttactacgatcatttttaaacttaattactggcactactatttcttgtagcattgcaccaccgtgtacatagtttgctcctgtaccttgaacagcgaaacgattcgcccctcgtggcacttttacatactttccagaaccttcacctaacacatagtccattgaaaaattcattgtaccttctatagaattggattcactagagataataaatcgtcgtttttcaatatctgtattcagaaaatcttttttcactttatcactagcttgcaatgtatctcgattataaataaatccgtgatccgccgtaataacgatattagatgcgctaacagtattaataagctgatctactaaagaacgaatatcttttaatgtttgttccaccgcatgaaacacttcatgttctgttgctgcatgatcgccccgtgcatcaattacattatgataaatataacttactttttttccagaaaagacatcgcgaaattgttgacgattcattgcggctaaatccttatattgaatagctgtagagtctttataatgctttgaaagaatcgttgctctattttctgtacttgatgctttgtaatcatttacatatacttcagcattttcattaaaagtgattgacttatacggaagtagtgtcgccatccctaagtccgtatatgaaggcagaacaccttgcatcgcgacaatatcagtcgatgcttttcgttccacattcaacatattagataattccttcgcaacttcatagcggagtgcatctgatataattacaaacactctctcttctttattaacaaatggttgtacaaatgagcgataaaatgtatgttgtgactctagacctgcaattggccaatattcttcttgttcaccctcaagcgcatctgaccattttattgctaaatcatttatatatacatttgtatatatgttttctactttatctcgaagtgccctaaaaccatctttatcttcaatctgatcgaatgctacataaaattttctatatgctgtgtctatattgtgatatttactctcgtatgctttaaataaatcaaatggctgtgattcagtaattgcattacccatttcatatatttgttgaaataactgaatcgcttgatacagtgcttcgtactcattacggaatacactaaaccaatgcaactttcttcttgccgcaattatttctatatatgacgtgtaatcatgaattgcattcattaattgttttgtaatataagtaataatgtttgtatcaaaacaacagaacgtatctgacgttatataatcttttatttctttactttgtagatgttccgtcactttcacttgtttttccaccgtatttgcgagctcattgtaaattacttcatccgcactatgattcataaattgattcataaatacaatagcattcattggtatagctgaaatgtatggttgccatgttttgggtatatctccgctcaatgtttcactaacatttgttaataagaagaaaataaggagtgaattaattgacttatcttgtaaattgtagccgtatgttttctctacaaggttccaaaatgtctcttcattaccaaactttcgaatgttctcccaatacttattcgtttcttttagttgttctctaaataacgcctttattacttcatctaaattcacaatattacatttacataaagatgctaatacaacaagatcaatttgctcttctgtatattcaggaactgaaaacgatttaaacaacgcttcacgttctttgctcttaaagaactttgtatatttcttaaatacatctcgcaaagcagcatcatttgttatgcctagctctcgcatcatgacagtcattttatctgttgcaaactcttgactatatttatacacatcaagtaaccaatcttctcttgctgaaggcttagccatatttgcataaattaaaaagttagaattcacatcatttttttctacttctaacttagtagcaaacatattatgcggggttaatttccaaatacgaacaccttctaaattcagctcatctatatcttcgataaactcgccagcttcatcataccaaaaaacaatatgacgcttctttccttctgttaactctttattgaacgtatcttgtaggacacgatttatttcttttgtattcatacctcaccaactctcaatagtaagaaatagactcagcgttaccgctgaatctattgtagttttcacatattataacacgttaaatctttgctaatagattagccttaagttatgtattcctccattttacttatagaaagggaggatagcacctcccctttttattactttacactaatttgataactgaagcgtcttctaattctttttgtaattgttttcgaatttcatctagtactgcttcaatatcttcttcattttcaattgttttcgttccgcgaagtattgtatttttactaattgttttctttttagctttatattcaacgatcggatcaataacagtagtacaggtagttcctgtacatggtgatgtgacaggtggtttacgtctttcaacttcatttgcaatgtcatcaatacatcttactttcaatcgatcactttctgtttgcattgcaattgcttcatagaaattgtttacacggttcaatctatcctttataccatcaaaactatttttaaatttgttaaagaacatacttttaatctcttcatgcttattaagttcttctaaaacagtttgataatcagattcaattacattcttaactggttcacattctttttctaacaattctacaaatagttcatcaaactctttaataagccctggcaattgatgaatatttttatacggttctttatgtttcacaatcttcgagatactctcaatgaaaccagttaccttttggtcagttacatatgtttgattcttctcaaagatgtttaatcgtttcactgcatcgtcataaatatctcgctgtgtttcaaagaaagcttttacaggctccacatcttctgcatagtccaagaagtcattttgtaattgttttactttattatagaaacttgtcgtatctgaaatgtttagtagctgttcaatcgattctttaccatcttgcaatacatcttgtcctggataaaaagtattacgatattgaactagcagtacattaattttatttttctcagatactagtaattctttaaatcgattcattaatccatcttcatcatctggtaaagcagtaacttcaaacacttcttttgaaagatctttaacaactttcattagtgcgggtgaaatacgttccctctttttcacaacgacacgttctacataatcacgcttcgttatgtaatttactaaatcgcgctcacttgttgttaaattactactattcaattgtaatttaatttcttgccctttaaacaatttaataataaatgaagcaatatcaagatctttccacccatatggttgttttgtaaaatgggttgtgatgcccttaatcgtaatctgttggttgcgggttgttaaacgagtgatatagtcatttacctctttaaccgctaactgattagcatcttcattatcgtccgacagcgttaactgcgttgtattttcaactaacaattcatttaattgcttcgctgtatcaataaatttcttcacataatgcagcttattatataaattatcaatcaatactttaaaagcatcattaattctctcaacaggatttttctctttcacatctaattgctgcgaattaacaaagatttgggcatgttttaatgcttctgttatataaatatgaacgcgatcttttcgttcattcgcttctcttgatttacgcactttaatatcttcgatcgcttgggaagctgctgtgccacttttgattttcaagtatgcttgtattcttaatatctctgtcatttcatctaaataagaagtgtcttgaggtaattttaatattacattactctcacgcatagacatcattttcaattcagagtcatttaattcagtcgttgcatcgaaatatggcgtgatgatcttcaagccaatatcattcgtctgcataccaatcggacgatcgtcaataattgtattaaaactaaaatgatatttaggagaataacgatattttttatcttgatagactacattaaaaatgacatcaccaattttttggataacttccgctgagtcaacatgcatatttttaatttcacggttaacatcttgttcatcatttgttaagaaaatatactcttgtccatttttttgaattaatgtttctttacttaatcgaattaatgaactttcaattttcttcttcagctcaattttatcgtcacttatgttttgaatcattaacgttgctaaattttctaggtttgcaggtagttcttttacatatttaattaagaatagtaatttcaatacttctacatcgtatgcatttaagcgtgaattgttttgagcatggatgattacagtacgaatactcgaatctaaaaatgcttcaattgtttgatagaacgccgaaaatgggataagagctccagtctcactttcagcatatttcattgctgattcttggaatgcactcaataaagagcgctccccttctgctaaatgctttcctgatgccccatgaattcgaatacctgtaaatactttttgtagtaaattaaattggtatggaataaacggataaacatctacgaaatcttcctcattattaaatattttcatttctgctgtatcaccagagaatgtaattaaattctttaagatggaactgttatcaccataaaggagtcgtaaagtttgtttaccaacttcgttttttaataaaatacgttttttaattacttcatctacgtgagcactagacaggcttaatcttgtatcaaaacgaccttgaattttcgaaaagtcgtttccgttaactttaacaacagagtcaatatcttgctgacttgttaccaatacccatacttttcctccgcactgcgttccgatatcttctactactgtttgcagattcaacattagttgtgaatcattaccgatatattgtcctaattcatctataaggaaaacaacatgatggttatttcctttcgcttctacatattcacgcacacgtttagcaaaacgatcgatactaatgaaataatcctcttctgcacgttcataccaattacgtgctgcatcttcactcattttcgttgtttttgacaacgcttctataatcgaatcttcttcataataaaaatcttctcgagcttcttcccatgtattacccgaaatcttttcaaattccgccttaaattcctcataacgcccatctttcaccatttgacgttctaaatcagctatccaagggatcgagccacaaaatccttgcatttcattaaatactttattaaacacttttacaattgcatttttatccgactttgaatccgattcgcttttagaatcaatattaaaaagaattacatctgttgttgtatttccggccagtttcatatctgcgaggaccatcggatctaatattttattattaaaaaacgaaatggcatctttattgatttcattttcatccattacatgtttattctctaataaataagaaaggatttttaagaagtgtgatttaccagatccgaagaaacctgaaatccaaactcccattttatccgtatgccccgtaataccttttttatatgatttaaagaattcacccatatgatgtaacaactcattggttacgacatactcatctaattcttgataaatatttttatcatcatcttgtccaactttaataacacccttaatatcacggttaatctctttttcaaacattttttgaatttgcatatactacctctcctccaattctctctattatttatcaatcaattgaaatgctctatagtaattatcatctttgatttcaccaaataatacgagctccagtccatcatatgtgcctgggaaaaacatcactaacggtacattgtcgactgctttatgtaagttatttaatatcgtatgcgagcgaatgattggaaacacttttcctactcctgtcaaaaaaacaatatcattaggttgtactctatctgtaatatactgcacaactaaatcattgttacttgttagacgcaaagcttttcgtgtcgcatttaagataaagtcgctcccttttttttgctccatatcgatatttttttgcaagtagcctttttcctctaatatttctagcatcacttcatataaatcgaattctcttatatgtagagaactatcattttttaaccgttcttgcatataaacaatatgttctctcacaagcatctcgtatttcggatcataatcaaaaatataaaaccctatctcattgcctaatcctttattttcacgaaaggatgcatctgtaattttcggtaaaatttcatctagacgttcatttattcttctcacactattcacctactaaaatatccatatatataccgtcacctaatgcgcgtatatgttctactacatcaatatttaataacggtctttcaatttctcgattacctttttgattctttaaataaccagcttcaaataatattctaatgtacacttgtttcaatttataaaatgtataatcattccatgatgcaaccttttcactttgctgctgtttattttcaaagaatatattaaaatcagcatctgtcagaaaagtttcaccaaaaacaaacttctctttaaacacttcattcataaattcaaaaaataaacggtctgttttcataatggaatataatacaatagccttgctggattctatatctccatgtccaatttccctaattaaataatcatctaatatttttaaacgggccaaaacacttgatgcaatttccttttttctcgattccgtattaacttgaaaaatattttctgaaatcgccttttctttcacttcgaactctttaaaccctttatttaataggattgaaactttcttcatctctaaaaacagaagtggacgggacttaatagttgacttataaacttgctcttttaccattttttcacattccttcgggccacttttttgatatttctattgtacccttttaagtaaataaataaaagaaatttctatattaaaataaaatctagcattatttacgtcacatatataattacttacagataaacaaatataagaatattaatcactaaacttaaccatccccccataccacccactactctcctccaaaaaacccctcgtctccccactccccttataaaacccctcccaaccccgctccctcaaaatccccttccaactatcactctcaaccatcttcttaataatgctatcccaataagcaacctcttcctccgtcatagatggttgagagtgatagttggaatcttttgggcccataattcctttccagtgctggaatatgacgttgattccttgttctttccatgttgggatttctggtagtcgatctagtcgttttggtgcggatacggctagtatttttattttgccggatttgtattgtttttcggcttcagatagggtcatggttgcggactggtcggacaaacactgttaatgcagcaatatatgaatcaatttaaacaatactcactgactccgggacaaatccttttaacgagaaatgatttttcgaaaagagaacggtatcgaaacgcgtatgctacgataatggaattattagagcggggcgtcattccgattatcaacgagaacgattctacatctgttgaagaattgacattcggagataatgatatgctttctgcgttagtcagcggattgattcacgcggaccagctcatgattctcactgacattaacggactgtatgatgccaatccaaatgaaaatcctgaggcgaaacgatttgattatttgccagagatcacgcctgaattgcttggatatgcaggttcagctggatcaaaggtcggcaccggcggaatgaaatcaaagctgttagccacacaaaccgcgctgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaagaggcgatgatccataatggaagcagccttttgcccgctggagttgtgggcgtgaacggaagctttccgaaaggggcggttgtggaagtcaggggaccgggcggcgtgatcggcaaaggccaaactcattactcctccgaggagattatggaggctaaaggcaaacgcagtgacgaacttgattttgagaaaacgtttgaggttattcataggaatgactgggtcaatgtaaaagactaggaggcggaaaaatgagtgaagtttctgtaaaagcgaagctggcgaaagaagcagcagccgaaatgatcatgaaaacaacagccgagaaggatgaggcgctcagcctcattgcaaacggactccgcaaagaactggattttctcttggcggagaatgcaaaagacattgtgaacggaaaagagaatggtttaacaccggacatcattgaccgtctctcattggatgagaaacggatacgcgatatcgcccggg

SEQ ID NO: 6211 - DNA, 20 bp, Artificial Sequence
  Single strand DNA oligonucleotide
gaggttcgctagggcgaaat

SEQ ID NO: 6212 - DNA, 23 bp, Artificial Sequence
  Single strand DNA oligonucleotide
tctctgctttgattcgtccatga

SEQ ID NO: 6213 - DNA, 20 bp, Artificial Sequence
  Single strand DNA oligonucleotide
tgcctgcatgagctgatttg

SEQ ID NO: 6214 - DNA, 24 bp, Artificial Sequence
  Single strand DNA oligonucleotide
ggcaggaatgaatggtggatattg

SEQ ID NO: 6215 - DNA, 20 bp, Artificial Sequence
  Single strand DNA oligonucleotide
tcatgctccggatttgcgat

SEQ ID NO: 6216 - DNA, 23 bp, Artificial Sequence
  Single strand DNA oligonucleotide
tgcctcctttcgattttgttacc

SEQ ID NO: 6217 - DNA, 20 bp, Artificial Sequence
  Single strand DNA oligonucleotide
tggatttcagctggggaaga

SEQ ID NO: 6218 - DNA, 25 bp, Artificial Sequence
  Single strand DNA oligonucleotide
aacttgtctctatcttatcacctgt
